United States Patent 7,892,730 (COMPOSITIONS AND METHODS FOR CANCER) - sequence listing, part 2

SEQ ID NO: 115 - DNA, 34460 bp, Mus musculus
  misc_feature (1)...(34460): n = A,T,C or G
agccatgccttctccagtgctgggattacaggcatccacctctttccttgttgtgtcagcgaacatggtgaggtttgagcaagtgtctcatttgtacgatgcttatctttcccgctccaggctctgggttcagtcactagcactatgtcaaaactttatgttcctggatgcctgaaacatacacttgataaatggtctcccctgtgttccaaatgtggtagtgcatggcttaaattccatcacttgggaggcagagtcaggttgatctctgatcaagatccagacagccagaattacacaagtgaaaaacactgtctcaaaaaaacaaacaaaaccaaaaagtaaagtaggaatcaagtctggttaccttcagtgtttgactctaggtggagaaattaagagccttcttctaagtttttggtcttaataaagtctcatagtcttggctggctttgaatttgatatatatcccaggctgaccttgaactcatgattttcctgtttttgttccctaagtgcttgtattatataggcttgtggcactatgctttgctggtgtatgtgtgtgtgcgcgcatggatgtatgtgtgtgcctgagtgtgtgtgtgtgtgtgtgtgtgtgtgtgtgtgtagccctggagggtgcttttgtgttttgaaatgggaaatgtagcccaggctggactgaccttctgtactcctatctcagtgcccttagtgctgggcgtatgagtatgggccaccatgtctggtggacggccattacagcagtgtcctgcgtgttcctttatttttcccagtcatgtatccctgttttcttaaacatgaagattttaggactgagataacttgtacacacacattgtagaaatttgaaatttgctggtgagatggctcagtgggtaagagcacccgactgttcttccaaaggtccggagttcaaatcccagcaaccacatggtgactcacaaccatccgtaacgagatctgactccctcttctggagtgtctgaagacagctacagtgtacttacatataataaataaataaatcttaaaaaaaaaaaaaaaaaaaaagaaatttgaaattatatcttccagcgcgtgggaatcggatagggaagatgagaagttcctgacagctttagctgcattccaagtgcagggttatgggagacgattaaaaacaggaagcgagcaaggaaacagaaaccctgaaattaccaagaagaggtgaatttttaccagggggaagtatttaatcactttagattatttttttaaaagaatattttaaactgtgtgcctcatgcccatggaggtcagaaggaaaggtcttacatacctgaagctagagttacaaccacttgggtgctgggaactgaagccagtgtccggctgccatcaatcattccagcccctagatcacactccccccccaccccggcccccccatgaaaggtatctctgtatcttgcagttatctctaagtagggagactagaactggctttaggttttgaacgtcccttttacgagagctccttgagtggttaagatggattacgtgatgaggagtctgagcagaaggaagcagccccagaggggccttgaaatggggctgtcttggcagctgaaagagtgaccgctttttgtgctttgcataaaatgtggggtgacactaacctctcctccagactttgagatgtagtcgttactggacttccataggttttttttttttttttttttctgtttttgtttttaaggtctaagtatttggactggagatgcaggcacagcacctgtgtagcatggctatggcccgtataataccctgctaacccacccattactttctgctattacaagaaatgttttccttatctgcatgttttgaatattctcactttaaatttttttatgagtgtttatgtgcttaagctgacaatgagtatgcataccgcacacatgcagatacccactgaagtaaggagaaaggagccgcagttacaaaccactgggagccaccatgtgggtctgggacccaaacctgggtcctctgccaaagcagttgagtgctttgattgctttcatttttatgaggcaggttttaggtgattgcctgttagaaggagtgcacagtaaggttggggtactgaactgaatgtgtgagctttaaagttttgtttggagcagaagagcatttttctataatttcctgttcaaagtttagttgtatctaagggaagtggagaccttgaattctctttctttctttctttctttctttctttctttctttctttcttcctccctccctccttccctccctctctccctccctctctctctctttctttctgtttttttttgagacagggtttctctgtgttctctggctgtcctggaacttactttgtagaccaggctggcctcgaactcagaaatccacctgcctctgcctcccaactgctggtattaaaggcgtgcgccaccgccgcctggtggaggccttgaattcttgaaagtggtggtagctaaccattgtggtacttgctgaacacaggcactgttctcatggttggaagcatcccctagatgttgttgttgtctagatattgaagctgtaactatatatctgacactgtgtatgccaaagctggggtgatgtctacatctgggatcccagcacctttgggaggttgaggcaggtagatcgccagaagtcccaggagagcttaggccatagaatgccatgtttcagtgatggcgcagcaggtgaaggtgctttccttcaaagctgactacctgagttagatcccctggaacccatacggtggaaagagtaaatcgactttggcaagaaattctctgacctccaaacctgtgcgtgtgccccgtagattattgggctatttctatctccactagcttccaaatgaatgagactccgactatgatttatttatttagctttagcacagttactaggcagataccagtacttagtatttgaatgcacagcagccccagactaaccccaacatgctcccgataaataaacgtcatgattttttttttttaaagcaaacaagggactctagagacagcttagtggttaaaagctatcatggtacttagtgatactctttgtggtactgttcttataaaggatatgagtttggttcccagctcataactgagatgtagcctataatgccagttctgtggcgatctgatacctgtgatcactgaaggcacctacattcatgttcacacacaacatacgcacatacacatacatacgcacacttaaaaataataaagagaaatatttaaaaccaagcaaacaaattgaaataaaataccccacccccaaacacatacacacaaaagacaaatgtggaccagaccgcacttcatagaggatgaccactttctgcaatagaggaatatcttattttctgggatcatactgtagcaaaactgacaccttaagacacataaagcacacttttttcttttttaacctgaggacaggtcccctaaggttgtctgcttctttgaaataaatatcttgcttctttgcccttaggttgtaggttctagatcagatctgaattaaatttcaagttgatgacattaatctagtttaaaaagttccaggcctgccgttgtctctccagagagttcagaggtcacacaggacagcaaaaccgtttcttcagtgttgacgttgagtaatacaccttcctgtctgcgggaggaagtgcggaccctttagcgaggaggagggagcaagaaggggattgtgtgcctgaacagtgccctgtaatctcccggtgctgcctggcgcttggaactagatgatcttcctgcttcttccttttaagagtacaagcaaaacagaagctatttttaacttttcagagctgatgtaagttctaaagataaacactttccaaatagctcttggcttgagaaaaacgactatcaggcatcattcagtgttataaatgcaaaattcaggttatgcacacacacacacacacacacacacacacacacacacgacacacatacacatattcatatccacacagactcaacatgacacagatagacagacagacgacaccagcacacactggtgttttttggaaaacaaggctgtagagcagtgtgacctttatcttggaaggggctttcatgcttctccttttggctttttgaagcagggtttcactgtgtagccccagctggcctagaacttatggctgtcctcttactttcctctctcagtttctggcatcacaggcctgagccactgccttggctgtgactaatggaaagtatatttagcagtgtatacacatccacacaagacctctcacgtggggaggtggtgttgattatcgtgacatagccattactttttggagctgttggacttctctgcaggccttggatatattttgctttgtttagtaactacacatccatgtaactctagggtattttgatccaaggttgggaaacagctgatagtgttgttagagccacatcacaactctcgtggaccaccagtaaggtacttcactcttgcttctttgcttgcttgttttctggtttttcgagaaagggtttctctgtgtgccctggctgtcctggaaagcttattgtttgctgctgctgctccttctcctgctgctgctccttctccttctcctccttctgctgctgctgctcctcctcctcctcctcctgctcctgctcctgctcctcctcctcctcctctttaagtagggtcagttcaggctgattttgaacttgtattcctcttgcctcagcctcctcacagttctgggataaattacctctgaaaatggagtttaaaatattttgaaagatgaaaggtgtagctcagttaccagagtgctttcatagtatgcatgaagctctgggctcagtcttcagcaccacaaaaactgcatggttgtgcaggctagtaattccagcactggggggttagaggccacaggacacaagttcaaggtcatcttcggctacacatcaagttttaggcaagcctcaggtacttaagatttggtttcaaaaaatttggttgaatcattatttgtgaagtacttaatttttcctcaggcactcgcttttttgtttgtttatttgttttttgagacagggtttctctgtgtatacctggctgcccaggaactcattatgtacaccaggttggcctcaaactcagggaactgcctgccactgcctattcagtgctgggactaaaggcttacactactgtgctgggcgtaggtagtcacctttaacattttttattgatttttgtgtgtataagcattttgggcatatgtatgtcagatggtcagaagagggtgtagctcctgcaactggagttgcaggtagttgtggccgcttaactgggaaccgaactaggtcccctgagagcaataggtgcttgtaattgctgagccatctctcctgccacttgggcagtcactttaaatgagatcgagtctttggcaagaagagtacccttggatggaggaagttgcaggatagtgttgtctgataggactatctgccctgtgtgtagtgattggaattgttgtgtctctggcactgtcgctagttaatcgtacatttggatgtgactgaagcattacatttaacatggagtgcctagagacagggttccagggttaagaacttttgtcactcatgcagggggctggagtttgggcagctccaccacacctagggcgcattatgctcttttggtttccacgcgcacctgcacacttatatacagggagggggcagtaaagctaataagaaaaaagtaggtcaggtgtggctgaggcgggcaggtctgtgtgagttctaggccagtctgctgatgtgcatggtaagtttcaggccatccagggcttcactgtgagaccctatctcaacaacacacacacacacacacacacacacacacacacacacacacgcacacacacacaaaaccacaagtagctggaggttaccatacttgaaaacacagaggccacatactgagcttttggtctcacagactggaagtctgagatacaaaaaaaatgtatcaaataaaggcaagctgtaggatatctagcctagtccactccctgtgtctggtagtagaaaggctggatgtggtctcctgtgctcagcggtagctagtcttcacagctatactcgttcttgccagagtgtcgtctcaagagttctagatgatagtcttccccgaagtccccttgtgagcaccatccctgccgctcaggactctgctctcctgcgttagcctgaggccagcagccccagctcggacctgtactgactagcgcaccgagtgaggatttcaaacgaaccacggaaaggctgctggccctgggcttcagatttgcctgttaatgggagtgagactaaagtaaccgagatgaactcttgaaataagtatgaagtctgagatgctgtagacagctttcattgtgctagtagactcctgtaataaaggccctgcatctgaggtgaagggttagggaagttgaatagtttcttcattcattaattgatcggaggctcttgagcatctcctgcagttttccctttagacttgatttcttagaggaatcctctgatgctcatccaactgagctcactgtccaatccacaggctttgtcctttgccatctcctctgcctcccgactgtaacgtctgtttccttccagctcacacatgctttgctttttgccttgctctcgaagccttttccttgtactctggtccacccttttggccttctaggacagttttgggataatcacatggcttgttatgtcttataagtggcattgtgtgcttagttatttttttgtgggtgtgaatcttctccccagatacattgtaagttccatatgtttgtatccgttatatattcttatgtcatctgtagtgagcaggaagtacaatttaaaacatattaggtgcgccccagccagtcagagtaaaagtttagagtgttttcctttatttagtgaatgtgtattatatgttgtaggaaatataaaaatggctaaaatgtaatttcttcagagagaatttacagtccacacagagaccgctaaatgtgctggatgctgtgaaaaccacacagactcagtgagttgtggttgcttgtgcctgtatcccagcactgtagaaggccactgccagagaatcgccatgagtttgaggccagtcagtattcccgtgtgacatcctatttcagaaacctagaaacagggctgatgagatggctcagatgccacacaagtctggcaagcatctgagttgagtcctcagatcatactttaaaaggtgaaaggagagagagctgactctataaagttgtcctctgacctcccatgtactcaccctgacacctgtatccacacacacactcacacactcacacacacacacacacacacacacacacacacaacctggttaagcacacatgtaatcccagtactcaggagatggaggcagggggatcagaagttcagttactctcagctacatagtaagtctgagtctctcctggatccacgagagcctgtcataaacaaatagcagacagaccaaacaaaatggacagtgcactggaaagagaaggatggacacgtttgcgttggcgaggagctggggtggttttggaaagcgagtgagtgtaggtttcagcaggtgaagctgaagacttgggaagcagggagaacccctgggaagccatggaggaggcagagtcctgagctgttctggggtcagctgtggacgattcccgggcatgcgattgggaaactgaacttccaattaatccttgatcagtaatttaatggtggttctcagatgctcccgtcagaatcacctgagtggcttatgtgacccagatggctgagtccgcagggtttgttgataggtccgaggtcctcatttctaacaggttctagctgctgctgctgctgcttgagtgtgagcacagtgcatgtgataattgcccgtggagatgccggcatatttggtaactagaacccctggctgttaacgcaccgaggtggtggtgctgctctgtgcatacacaccgggacttccaggctacagatcaggctgtggtatgcacagcccttcctgcagggttggagcagtggtgatgcaagcagtaagtgctgagcatgctttcctggcacccaagtctttaaagtctgagcgagaggcacttggtgctgggggcccttgacaagtgaagatttaaaatctctttaactcttagctaggtgcggtggtgcaggcctttaaccccagcaccagggaagcagaggtgggcaatttttgtgagttttaaacttagcctttgtctatctacacagtgagttccaggataatcagggctatatagtgagaccctgtctcaaacaaaacaaaatagcaaaaaaaccctgtaactctgaataggaaacaaaaatgaatatagcaatatttgggaaacacttttcttagggcttctttgcatttttttttttttttgatttttcaagacagggtttctctgtatagccctggctgtcctggaactcactttgtagaccaggctggcctcgaactcagaaatccgcctgcctctgcctcccatgtgctgggatttttctttgcattcttaaaaattactgagatctccagaagtccccccttaaacccaaacaaaacaacaggctctgtgacttttcttttttaaagatgactttattacttcttgcccgttctttttttttttttttaagatttatttatttattatatctaagtacactgtagcggtcttcagacacaccagaagagggagtcagatctcattacggatggttgtgagccaccatgtggttgctgggatttgaactcaggacctttggaagagcagtcggtgctcttaaccactgagccatctctccagcccccgctctgtgactttttaaaatatattttttccttttttattagatattctctttatttacatttcaaatgttatcccctttcctagtttcccctctgaaaaatccccatccccccccctccccctgctccccagcccacccactcccgcttccaggcccaggcattcccctatactggggcatagaaccttcttcacaggaccaagggcctctcctcccattgatgacagactaggccatcctctgctacatatgtagctggagccatgagtcccttcatgtgttttctttggttggtggtttagtcccagggaactctggggttactggttagttcatattgttgttccttttagggtctgcaacccctttcagctccttgggtactttctctagctccttcattggggaccatgtgctccatctaatggatgactgtgagcatccatttctgtattagtcaatcactggcagagcctctcaggagacagctatatcaggctcctgtcagcaagctcttgttggcatctgcaatagtgtctgggtttggtggttgtttatgggatggatccccaggtggggcaggttctggatggttattccttcagtctctgctccaaactttgtctctgtaagtccttaaaatatattttttaaagacttatttgtttcatgtttgtgggtatgctgtcgctgtcttgagacacaccagaagagggcatcagatcccattacaaatggttgtgagccaccatgtggttgctgggaattgaactcaggacttctggaagaacagtcagtgctcttatccgctgagccatccctgagccatccctccagcccgccactgtggtttttatccctcagattacaagtctgcactactactatgcccagtttggtatttgaagtaactctctcttgatatgtttcctttttcagatttgaccgagaggctgagttctctataggaacacccacatttgtatggatgagtggggaaagatagctgcagcagacaaggaaaaagcgtcctgacctcccgagaacatgagtatgctaaaacccagcggcctgaaggcccctaccaagatccttaagccgggaagcacagccttgaagacgcctgctgctggtaagcgtttacttcttatctttattttatttcatttcattttgagacagggcttctccacatttcaaggctgtcctgaaattcactctgtacaccaggccagcctcaaacttagaggtttacctgcctctacctcctgagtgctaggattaaagatatgtgtcaccatgcatggctacttttaattaaaaaaaaaagctttgctttattatttatttaggtgtgtgtgtgtgtgcatgcagttgcctgaagaagccaaaggagtgtttccaatctcctagagctggagttacaagtggctgtgagccaactgaaatggtcggtcgctgggaactgaactcaggttctctgcaagagcagcaagcgctcttaacctctgagcaatcatgcattatcttatatgagtacactgtagctgtacaggtggttgcaagccttcatgtggtcgctggggattgaattttaggacctctgctcgctccagtcaatgggaatttataaacaacagaaatgtattgctcacagttttggttcttctagttttgcttataccttcctgtcagttaggctcaggccaaatgtcagctcttgggtggaaggaagcaggggcttgtctcctccacagtactcaggctgtctgctttcttgtcttctcagttctcgccttggagagcacagactgtgctgtcttgcttggtttcctgacatagaacaatgcctgggattagtcctagagatgcaggagctccccagacacgtagacaatgaatgaatatgcggagtcattcagttctctcaaatgccctcaaaggaagacgttactgcctccctacaggggaagagattaaacatagagaggttatgtcacatctggagatatgatacgccccataagtgacagtctgcttaggagtgtgcacttccttcagttacactaactatttaataaatccttattagatgacgaatgaataagttttcaatgtaagtacacagctcacaaattaactgttctctttatgataggatagaggttgcacaaaagtttaccttcccagggcatttggccaggtgctatcttatgttttcacctctatttctccttctgccatcgaagaagtaggttttattgtaatagtgttatagtagagatggcgggggtggggtggggtgggcattcctgaatcctttcattcagtaaacaagattgtgtgtctctggtaaaatggtaggagattttgctagcttggctgttcatatgttggagtaagctggtcttggtgggtctgactggattctcgaaatgttcaggaagggcgcagggtaggaatgaactgggaactataaatacagggctgggaaaggactatggcttttttttttttttctttttgccttgatgacttccagtcttagttgcaaatgtagagtaacacacacacacacacacacacacacagagttcacagagctttgacagtgttctgcttccttgcttaaaaaaaatagaatttgctcaacaagtcaacaagttctggtctgtttatgttgctattgttttctctttttatgtttaaaggttttaaaaaaattattattttatgtgtgtgggtgtttaatctatgtgtgtgcctgttgctgggtgaggccagaggaggatgtcagatcccctggaaatggacttatggattgttgcgagccgccgtatgggggctggggattgaacgtgggccccctgcaagaggagccggtgctcttagccattgagcggtctctccaggctgttttccgttttttctttgttagaggacagctgctcagctatgatgtgggacctgttctgattcttcttctgctttcagctgcagctccagtggagaagacaatacccagtgagaaagcctcgggccctccatcctccgagacccaagaggagtttgtggatgactttcgagttggagaacgtgtttgggtgaacgggaataagcccggatttatccagtttcttggggaaactcagttcgcaccaggccagtgggctgggattgttttagacgaacccatagggaagaacgatggctctgtggcgggagtgcggtatttccagtgtgaacctttaaagggcatattcacccgaccttcaaagctaacgaggaaggtgcaggcagaagatgaagccaacggcctgcaggcagctcctgggagaactgcttcacctctgtccactgctgcagctaccatggtgtcttcttctccagccactccctcaaatattccccacaaaccgtcccagtcaacggcaaaagaaccttcggctacacctcaaattagcaacctcacaaaaactgccagtgagtcgatctccaacctttcagaggctggctctgtcaagaagggggagcgggagctcaaggtcggagacagggtgctggtgagtcacaggccactgtggccactgcccttcttccccctcctcccctcccctccttctccctcctcctccttccccttgagagaaggcctctctttgaagtccagctggagccatggtgtgcctccaactttcttctgccatacctggctagctaacatgctaatttgtttttgtttttttttaaatggagtaagggtttctttttttttttttttttttaagatttatttatttattatatgtaagtacactgtggctgtcttcagacactccagaagagggagtcagatcttcttacagatggttgtgagccaccatgtggttgctgggatttgaactccggaccttcggaagagcagtcgggtgctcttacccactgagccatctcaccagcccgctaatttgttttttaaacataaatctttaatctagaaataagaagcattttaactttaaaattcgttaaagaagttaagatttagaaactaaatgtagtggctgggtggtggtaacatgtctctttaatcccagcacttgggagcagaggcaggtggatctctgagtttgaagctagcctggtctacagagcaagttccaggacagccagggctaacagagaaactctgtcttgaaaaaccaaaatgaactggggtggggtgtgtgtgtgtgtggtgggggggatacaaatggatatagatgtataaatatgaaacgtgtgatttaaactttttaaaaaagatttatttattatatgtaagtacactgtagctgtctccagacgccccagaagaaggtatcagctctcattacagatggttgtgagccatcatgtggttgctgggatttgaactcacgaccttcagaagagcagtcggtgctcttaactgctgagccatctctccagccccatgatttaaacttttttttttttttttttttaaagatttatttatttatttggttatttaatttatatgagtacagtgtcactgtctttagacaccccagaagaggacctcagatcccattacagagggttgtgagccaccatgtggttgctgggaactgaactcaggacctctgaaagagcaggcagtgctcttaaccgctgagccatctctccagcccctgatttaaacttttaataattaaaaaaattgccaggcatggagttgcatgcctataatctcagcactgatgagacagaggcagggggattgaaaatttgaagactagctatgctacatagcaagttcctgtgtcaaaaaataaaaacaaccaaaccaaaccaaaaataaataattgggcagggtcatggggattgtatttgctggttttgtgtcaacttgacagaaactggagttatcacagagaaaggagcttcaggtgaggaaatgcctccatgagatccagctgtaaggcattttctcaattagtgatcaagggggaaaggccccttgtgggtggtgtcacctctgggctggtagtcttgggttctataagagagcaagctgagcaagccaggggaagcaagccaggaagtaatgtccctccatggcctctgcatcagctcctgcttcctgccctgcttgagttccagtcctgacttcctttagtgatgaacagcagtatggaagtgtaagctgaataaaccctttcctccccaactttcttcttggtcatgatgtttgtgcaggaatagaaaccctgactaagacaggagttgaggagatagcttagtaaaaccttgcaagtttgaggacttgagtttgatctctatgtaagaagcaaagcatggtaacacatactactactgacgcgcgtttataaccagtgatggcaagatggagatagtgagactctgggctcaggtgctagttaatattgcccaatcagcaagcaccacatcccagtgagacgtcctgtctcaaaaaaaaactagagcgcatcatgtcaagctgtggtcatcacttcttcctacagcaccaggtaacccctttttggctcacttctgaaagtgggatttatatgtataggtatatgatatgtaatgtatgcaatacatatacatatatacatgtgtgcatgaagacattatacataaagctttttctctgagacagggtgtcaccggggagtccagcctgatctagaactctctagttacccctggctgggctcacactcatgttaatcttgcctcaacctcttgaatatatttttatttttaaagcacaacataagaatatcccccaaggaaagatgggtaaaaggcatatgtggtacatccgctctgtggagtaccagttagcagaatgtgtgtctgagttggtttggttttgttttttgttcagtcctttacatcttttgacatagggtctcatatattctagcagcccctggaccctgtgtagatgggggtgaccttgaacaccaatcctctgcctttctctcccaaacgcttcctagtttgttttctgttgctatgacagaattctgatgctaggtaattaagaaagaaaggttgatcttggactctgcctcttgtggctgggctgtgtaacagaacgtgatgctgacctttttccggtaagggcttcatggcagaaggacaatcaatgagtatatccagagaggaactcagaaaagccaaacttgcttgatggcaatctgtgttcctggtgtctaatcctgttagggcttaactcagcagaaagacatcagtgcatttatgaaggctacacttctcgccccttaaaccgcctacctcctggtgggccccacttcctgacactgtagcactgaaaaccaagcttcaatgtgagggttttgttttctttttgagacaaggtctcacatatcctggattgtccttattatataacctaggaagactttgaacttctaagccttttgcctctacttcctgggtactggattacaggtgttgctaccacacctgctttatgtggttctggggaccaaacccagggatttgtgtgcgctaggcaagcactctacaccagagctacacccccagccttcagtgtgagtgttagtgtgctcaggctatgttgggaccgcagtgatagagagtaggaaatgaacctaggtgtccacactgcttatcactgggtatgaaaaaatattgttattttatctcaataaaaattacatttatttattttatgattgttttgtctgcatgtatggatcccctggaactgaagttagaaatgtttgtgagctgccatgtgggaaccaatctcagattccctctgtatgtgcgacaagtgttcttaaacaccaagccatctctccagcacctacagtgaagattttggaagaaagaaaaaggaaaaataaataaataaataaaactacgttaagcccagtagtgcaaatctctactctggctgtttataaagccagaataggaagttcaaagcctggcagatgctgtggcatacctctttagtcctaccatgcagaaggcaaaggcctgtgaatctctgagtttgtgggtagcctggtctacatggtgagctggtgagttccaggccagccgggactacatagtaagatcctgtctaataaaaaaagttcaacacagctgggcgtggtggcgcacgcctttaatctcagcacttgggaggcagaggcaggcggatttctgagttagaggccagcctggtctacagagtgagttccaggacagccagggctacacagagaaaccctgtctcgaaacaaacaaacaaacaaaaaagttcaacacctgcctgtggcacagatgagttcagtacgactggcaccttagtgagaacctgtctccaaaagggaagagcggtagggctggagagtcggctcagtggttaagagcacaggctgctcttccgaaggaccagggttcacttcccagcacccaagtgacagctcatgacgtctgtaactccagttccaggggctctgccatcctctcacagacatacatgtaggccaagcagcactgcacataaaataaagataaataaactagtgagaccctgtgtcagaaagtggggaaagggcggagctggcgctcggtggcatgtttgccctgcaagcacaaggccccgtgttcagcctccatcctgacacaaagctcagggaagaggggagaagacagaaagctggttctgaagaagtgtggtggtaaagagagtgagtgcaggcagcagtgatgcgggttgctaagcagtagtgattaaaatgctgttgccgtgtatgaacctggactacggcgcagacgtgtgctctcacgtatgcatgagagaaaatatagtaatgccgatgataactcatgttcagctatacattaaagtgggtgggaaaatatttttaaaagatcttctttgagcacaggtaaatgaaattgtgaggagtgggttttttttttaaagatttatttatttatttaatgtatgtgagtgcactgttactgtcttcagacacactagaaaaggacatcagatctcattacagatggttgtgagtcaccatatggttgctgggaattgaactcaggacctctataagagcagtcagtgctcttaattgctgagccatctctccagcccaggggtggtattttaaaacagttttaaggagacaaaacctttatagtgtaaaaaccggtagattcaatcattttaaagtattttaaatcctctgccccctagacagagcttctctgtgtagccccgagactcactctacagaccaggcaggcctcaaattcagggatcctcctgcctctgcctaaacttaatatgcaacccaggatggctttgaacttctaaagctcttgcttccagctcctgagtgctgaaattaaaggtgtacaccatcatgcctggttaaagtacttaaaatttcatttgctaatacaattagtgaacccaaaccaaacacgtggactgtgtctttaaaatgcatacgccactgcgttgaggcaaagttaagtataaggaagtatcaggaatgcagacgccatagatgggctctgcttccgtctcatgtcgttgggttttcacttttatagcaaatatttatttccaacaggaaaatctgaagtgatcaagtatttttctaaaagttattttattcattattattgtatatgtgtgtatttgtgggcacacactttgtgaaactagttcttcccttccacatgcgtgtgagtaccaggggttagatggacgtggtaggcatgcatcctggggcagcaagtgcttttacctaagcagtcatcttgccggcatataaccaagtggtttttgttgttgttgttgttgttgtttttaaggacgggaatatgtttgttaacagtgtgaatgattacacgttatgcagggtgatttattgttgcactatcccagacatcatgtccgtcaggcagtgtctctcagtgtggcttcgggacagcttgagaagagctcagaagacaaagcagaggagctgctgatgggatgatggggtgcacctcctgtcatctgtgtcattttgttgggactacaaaggcagaagctattgcagtcatcttaagtctcaccttctttttttcctcttgtaggttggtggcactaaggctggcgtagtccgctttcttggcgagaccgactttgccaagggggagtggtgtggtgtggagttagacgagcctttggggaagaacgatggtgctgtggccggaacgaggttggtctggaattctgggacactgtgtcttcctctcacagctgtgtgctccagcagggctcaccaagtgtgtgtagtaagtgggaactgctgtctgaggagccgtgcttcttgttttgtgagacacttttagcttttggaacaggctggcctggaacctgtgtgacaatcttcctgcccaactcagtcctccaagtatcagggttaaagatatgatctactgtgactgactaggaactatatttttattctgtttatcctaccatttatctatctatctatttatctatctatctatgagttagttagggtctctgtgtagtcatggctgtcctggcacttgctatgtagaccagcggcctctatctcacagaggtcaacctgcttttgccatctagtgctgggattaaaggtgtattaccaccacacctattttttttttttctttcctgagatgctagtttttgtttggttgggttttttctgtcaccctccgtatgcgtgtgtataagtgtgcatgccagaggacaactttgggtgtcaccttgaagatttctcagtgacctagtgtttaccagttaggctagattggctgtccattgagcaccactgtgcccagcaaatatcattttccttctggcttcatcaggtacagagtttgggcaaagagaaggtaactgcctttgacaggaaagaaatgtaaagtgcgtcttcaagattgataagagtcccatcctgggctaagggactgactgccgagcagcccctctgttgtaagagcgctccgctcctactctgccctggtagtactgatgggactcagacagcatagggatctatgggggttccccatccttttttccaggtctcacatagcccatggctgcttctgagcccatgttcctcttcatggttcaggggcttggatgtcagggtatggaatcctgcctggctgagaatgctttgacactgtcggtatgggagatgatacattgttattcttggcatatagtgtattgatctagttaacactgacctataaaccatatataggtgtatggactttaatcagcggaacatcattcttcatggagataaagattaaatatctctcaataagccatcaagccttctcactgttttgtgtgtttcctgtgtatcgaaaacaccaagtcccccacgtaaaggcaagcctttacctctgagccacatccccagcccccaagccattctctcctgttactgaaacagtgtcacagtctctgctattctcagacaactgacatttttagttgacttaggtggctctgccagagtcggggtcttgtttgatttgtcttgtttttcatggctgtaagtgggggtccctaggtggctaaacctctgcttgcatttatcacatagtacaacgacttctatccttacataacttatgcactccgagttggaagagtgtttgttacacctgtcactttttgtgattaatttgtatttgttcctcttcctgctctctgaaggtattttcagtgtcaacccaaatatggattgttcgctcctgtccacaaagtgacaaagattggcttcccgtctactaccccagccaaagccaaagccgccgctgtgaggcgagtgatggccgccacgcccgccagcctgaagcgaagcccttctgcctcctccctcagctccatgagctccgtggcctcctctgtgagcagcaaacccagccggacaggactagtaagcccccctcctcactgcagcaccagcccacagccgggctctgcttcgcttgtctgtgctctccgtgctgcccatagctggttgtgggggtccctgcaaggcagttttgaaaatggaactccagcaaggacacgggttttgaaatacgatttttttttccctgtggcacttttattcataatagccttaatgtatgccagttcttgagaaacctatatgactactatttattgtgtgaaattacttagacccaaatgacagggaaattggagggaatcccagttgtcatgtttgtaggtctctttctctttaatttctaacaattttatggaccaatgtattttgggagaacttaatgctttatatcatcagagtggacagctaatatgtggagtgttcctatgtgggccagaggattcagagggggcctttgaaactcaaagatgctgggaagggccatgttttgttttcttcttgtctttctcccggtcctttctctctcctcctttctccacttggagcattgaaaagtggaattgcgggggagttacataccactgtggtctttctgttaatatggtgtattacatcagaagtgtcagcaaaagtctactcccacctgaattcaggacccgggctctttgatggtgaccttgtggcaacagttagttagatggtgactccagcccagggtccccagtccttgatctcattcaccttctgtggcatcatggtcaggaagagaaaggagggggatgaagtgtctcagtggctgagatgcccctctgctggccagctgcagcttcttccttgtacacacgggtaaagtatttacctctccgattgtttgagttttcatcttcacagtacaattaaaaaaaagtctcaggaccagtggaatggaggtgaggatcaaagccttgttctgaaaggctcagcacatcctaagataggcatctgctctgctgttgtaggctgggtctgctctgaggcactctttccttgagtaactttcatcttcttgtaaattatgtccattgctttggggagcaccaggccctccctgtgccctccagtctcccctactaacatttagcagacaagttctgatttcttatagctcacctcacttactgaagacagttgtcaaatagatacatctctttatctgtttctcggtgtgtttatgtgggaatagctatagtttctaataaaaatgactggaagagtgtaacagggacataaaataatgtgctcttgacctattcctgagaggtgtatttctgtccaaggaaagtagaaatggaaaagttatttttttgaatattcatttatatgtgtgtatgcatgtgggtgtgagtcagatgctttggagctggcatttgtgggacactggtttcttagctgggtgcttagagtcaaaattctgatcctcatactctgacagcaagcactccaagccactgagccgtgtgtccaggtcccaagacaagtgagtatttcaaatgaattcttcagtaactatagtgtcttaccattagggaatatgctcccgttgggctctgcgcatcttcttgagccttggaattgtgctcaacatcaccgggaccttcattccctgtgctgctctgattggtgcatagtgtttgtgttttgtcttcacaactgccaatacccagctctgcagacagggtgccgttcagtggagtgggttacaggctgaggctgaaactgaagtgcctcatctagtcattgcgtgtccaacggctacctctgcatttctttggaattttacacatcctttagtgtccccgtgcactttcagggcccctgaggcatagctactcacaggattggtgacttcatacttaatttacttaaccatgcagcaaagaggaaaagctggtctaatgttagaaagagaggcatggaatctgctctcaacatgtttcagtaattcaagaaattccacagaacgagccacaaaaggtggtgtgggtttgattggattcctttgctctcatagtcatcagattggtggatttttaattgatgaagatgctccctgaggaggtgagggctcggtagactgacggggagcactcagggagcactcagggagcaccccggtgacaaatgatgctttgtttgcagaagaagcaaaggctgaattgatctggagccagcagctaagtcaaggccatgggcaaatatttgccaaggatggggccatatccagacacccacccagcctgcagagccggacggagcctgcagagaggaattgtcagtcactttacccagttacctgccgccatttatgcgggttcatttcctctgggtttaatgtggctgttagcttccagatagaggtggatgtgaaccaacagagattagtagatgtcaagaagacacattctttctcagcatctcctagattttgtctctgccatttcctgtcttcctgtcttctttcttttcttccttcctgtctccctgatgccctgtcctcttcttcccacttaccatttctttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtctgtctgtccatctctgactgattgtcctaacttagacttcccttcttatgttttataattatctagtgattgggattcaggtcctagaagccaggttccagtgtgataccacccgtttttcctttgcaaaggaagatgaaaaagatgctgacaagaatccaactgttcatcggttgagaagatgggactcctagggcgatgttatcatttcttagtgaggtttgggagctttaaaagctctcagctttaagaccaagaaccaaatgtttggccagatgtcatcaccagaagacaaccatagctcaggctggaggagtttaaagaaccttgggatgttttgctttgtttcgttttgagatggtcttattctgtagccaggctggcttccagctcacgggcagtcctcctgcctcatcctctggagtcctggggttacaggtgtgagccactttagagaaacttttaagataggttttgtgaaaactgtcaagattcctacagactttgtcagctgtgctcagagcgcccatgtttaaactacatattcatcttctaaatgtcttctgaacttcgctgtgagcttgtttatccatactttttatgaagtcttactttcttggtgagaactttgcctaaaattttacaaacccacaagctggggcagcacttttgctttgcctaggagatgtgtgctacgcatgcgctgttcgagccgttcctcccggacagcaccatcgtccttgacttctctgactttcctttgcagttgactgaaacctcttctcgctacgcccgcaagatctcgggcaccactgccctccaggaggcgctgaaggagaagcagcagcacattgagcagctgctggctgagcgggacctggagcgggccgaggtggccaaggctaccagccacgtgggggaaatagagcaggagctagccctggcccgagatgggcatgaccaggtgaagactggtgtcgatcttgtgatgatctatggtgatggtttccaaactgagtgatgaggtttaaaagagtgcctggcattcggagccagggggttggttggatttgaacataggaaatgagtgtctgagcttgttgaaaagctgtggtgtgggtgccagtttccgtcatcatgaagttttgttcttctggattttaccgtagccatttggtctttatgtctaggctttgagtctggctgtattaactgctcattactggggccttagtgatcacaggtggtgtttgtagatcattactgacacgtttcagtattggaaaagatgaggcttgtcttactgttgccctctgttgctgtatgctgtgggatggggttttgttttgtcatctagtttccaggaaagttgccaggaataacctaccaagatagaaagcactagacggtatccagagcgatgctctcccatcatggtctcatttatcgatatgtatttggaggtatcctgggctactcactgacatccttgcttccccagcatgtcctggaactagaggccaagatggaccagctacggaccatggtggaagctgctgacagggagaaagtggagctgctcaaccagctggaagaggagaagaggtgagcctgagtgtggcgatgtcagccagaggcagggctgcccagcagcagaagctgagctctgctgtgtgaagaggctgtgctgtgacgtaacttttccaggaagcctggtatcctctagacatgacttgattagcagatgtttactatcattgaatgcttgtcctgagaatcgctttactcagcattaccaaaggaaatcccagccagtttcactacttattagcctttatgaagaaccttatccccgagaaagctgggcttaattggaaaacagggtagaacagttggagttattcaggtcaatatgaacacacatgctaaatgatgtgagatagacacagagagcttggcttttcacaaggagctgtccttcctccctccctgtctccctccctccaaagactgaacctacagacttcttgacaagcacaccaccacagccagtgccccagcccttctgttatcctattttaaaagtcttgcaaagtgggctggactggctcggaactcatgaccctcttggttcagccccacaaatagttagaattgtgggtctgcaccattaggcccgtaatcattggatgaagaagcactaggcataggatgtgctcacatccaaaaagtaaacctacaaacctgtggggggtggtgtatacctgcgttacagcgtgcaggagggcaggaggatatactctctctctctccctctctccctctctccctctctccctctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaattttctgaattctaattttataaggtctagactttaatagcttcttaataatttaatagaaaccttcttcactcatttcacatatagtcacatcctgtagttgacttttgtgttgtcatccatttaaaaacaccccaaagtctcatcagaagtttcatctcatcatctaattcataagaattaccgcctctggggtttgggaaagactaagatagttacattagcagtaggccagtatagtctgtctgataaacttactagaaattaatcaaagttatattgaaaccctaacacagattgaaactttagttgaatctctttttgttgttgtttacttttttttatttttttactgatagcaaaagagcccgatttctgaagatcccgagaatgtaagagggcacttaactgtgtggatatttcccttaacacagattgattccagattaaaatgcttattgatatactcaaatactaaccgcataatctgaccttgggacttttcccgtagtatttctatgcatgtgactttcaaagcaaatgcatttgtatctttaagaaaccgtatgcaatgactaagctctgtggattcttttgttactgataggaaaatatttaaagaagttttgctgaaaagaaaagaaattgtctgagggtgtggcctccttcaccccattcacaatgttttctagtttgggtagacacctgagggaagcataaaacaccttagatggaggggctgtagaaatgctggacacttcccaagcagcccgaccttctgtttgcttttgtgtgtgctcccaatgcagctgataaacccaagcttccctttctggctgtggtatttcccctcctgtctgcaagtagaggccatcgtcctccctgaatatacagggtagtctaggttgttttcaccgagggagctttccctagcagcagtgctgctgtgtggtgctggctctccctcttcttacaaactgccaaagaggcctccagagcaccaattcttgtacccactggcagctgtgctgccagtggagaagacccaaaactgttagctttgatttacaggctcaaaagaacaaaattgaaacaaagaattttttttttttttacttcttaccatctattgagctgaaatagagacctcacattgacattttgatgaggggttcctttttgcgaagctacttcagtgatctgggtctctttcttctctccctccagagcaggtttcgctgcctccagtgtcagtgtgcatgggacctcctcctgcctctctgtgcgcttctcgaaaggcctttgctcttcttccaagccctgtcccaggactttcctcttgggataccacacctcagtctcagaagcagtgatttgaatgggctgccctgttcagtgtcaggtttttaccacaggctgtggcatggaggtgaatcactggcgcccttgctactgacaggtgaaagtccactgtggagcaccccttctataagggagcacgggggcttgctgcactcagctggaaggtctgaacagagggaatagtacatagacgttctctctttttttaaaaagatagggtctcactctgtagcccaggctagccttaaacctgtggtgatcctcctgcctcaggctgctcagtgctagaattgcaagtgagagccacttctttccttttccttttccttttccttttccttttccttttccttttccttttccctttccctttccctttccctttccctttccctttccctttccctttccctttccctcccctcccctcccctcccctctcctctcctctttccttccttccttccttccttcctcttcttttttttttttttaaataggctctggctatgtaatctaggctggccaagaacttgcaatatagcctggcctcctcctcttgattttcctgtctctgcttcctcaggtgctgggactatataggcttgccttgaaatgcctggctggatatttgttttttatctgcacatagtgagtgaccagaggacgcctaattcatggtcaaaggaataggagaccattttctttgactgcgtcctttagtgtgaattcctgaagctttgtgggtctggattaaattgtttgcttgtacaaagagagtattgaacagtttctctctacagcatatgttgatgcaggggaccattaggttttgaaatgtatctcattatctcacagagtatagagagtgtaggtgaagaatgtaaaggaaaaaatgtcttctgtctgattccaggaggcagaggcaggaggatatctttgagctctagaccagcctgctctacagagtttcaggccagccaagcccgtatgatgataccctgtcacaagaaatgttttctgttgtcctttttaatgtcctatggtagttgtttatgtctcagagtgaccttaatgtatcaaagacaccagagtaccagaggacatgtccaaggctttggttttctccttaagcttggtgctactttgttacagcctttctgtcaaattctcctgactgatagacgtcttacgttagctcttacagcatcagtcacttgctgcagtgacagttgggtcagagagatggtggaggaggctccttgagaccaatgtcatgatcatttcaagtggagcaagattcagccacacttgagtctgttaggcagagagatcgtcctaggtcccagccaggtgactgactggataggaagtcaccacaatggtgtggtttccaggtcccactcgccctgagatcccagcagttctctcagcataattgtgttgccatcctttcttaccttatgagctggtaaagaacaaattcatttaagaataaaaacaagtcccttatatctggagtttaactgtcctcttgtctgatctccttaattggcttgtttcagagggagatctttactaaacactggctttgtaatctcaaaccctcccctctcctccacagagagttaagcctttgagaattcccagttgggaggaagttagtttctgtggccttgctctgctgtagagaacctcaccagaaagcatcacccacttctgcagacaccactgctgggtgccttggcactggcttctagagcctgttttatttgttcatttatatataattattttctgagacacggtcttatcctatagctcagccctcaaactcactgtgttagcccaggctagccaaatatttgccgcaatcctcctacctcaggctcaaaagcactgggattataggcttaagccactgtaggctaaagccaccataggcagcccagattcttttttttcttttttttttttagatttatttatttattacatatgtatacactgtagctgtcttcagacactccagaagatggcaacagatttttgttacggatggttgtgagccaccatgtggttgctgggatttgaactcaggacctttggaagagcactcagtgctctcaccagccggcttttattacacattatttgccaggcccagcagtctgctctgagggcctcctgagtgcttgaagactgtggcatcgtcttccccatccatcgtgaaagggtgatgatctttctgagggccaagcagccttgtgaagtccctgagtcagcgacatacactttagtgtcaagtagccattgtgggggaggggagatgatagttagggggggtattaactatgctaatttgtgctgataaacttcacttatcaagataacatatctttggctgcatgcatctgaaacttcatcctgcctcatgtgtcctccatgtttttctttctcaacagactagctcctgccctgctcctgcctccctcctctgttcatagtgcccgccctcactccctccgtccctggcagctccatcctctttctccttgttactctttctgtttgtcccatggcagaaaatactggtggctcggcctgcatgccgctctctctctctctcctctcctcttgtgctggcatgtgatggtggcactgtgtgttcttctcctcttcccttttactaacagacgcagaccaaactggagcatgcccgcactaaggagcttgaacagagcctgctctttgaaaagaccaaagctgacaaactccagagggagttagaagacactagggtaatggctttcactatttcctgaagcagcgtcacgagtgtgagtggtggacacgtcgggcgacaggcgactggcctgctgtcagtctgagccttgacccagtggttcagcctgagtttggtctcagtactgctcaggtattggggagcatagagtgatgagcaggttgtaaagcattttgtcaaaagtaaacttacccgaaatcaagatcagaagccttctaccatataaactccatgggtctctacagcaggacttgagttgtccttcagttctcctattcctagttactgggttttctaaataatttatgctttttcctgcctttgccctggcttgctgggaaaaagaaatggaaacattagctcattttttttttaaatgagaattgaactttgacccctattatctttttctttttctccactcacttctcccctcaatggctgaacttacatctccttcctttctgacaccagattaaaatctcagcgattaggaaggtcagatgtgtgggggaaagaatgacttcttttggggccagggcttcggccctcttgtaattgtttatatattaaagcacctatcgagttgccatgtcactcattctacgtgctttgtaaatattattcaactttttcatcatccttggaagtagattgtattattattgccttttctgtcgacttttgcagaaagtttaaggtttcacagctaataatataataatagaggagccagaagtgccttttaggtcatttggctccagattctgtcctcataattactataggaatcttttgatttgtgttaaaagaaataatcagaatcactcacatgtaaaaaataataaatatacatatgtatattcatatatgtacctgtaaaatcatgtttgaccatgattggcctttaaaatgtcaaaaattactttgcatctatctgatcaaatttgttaccctgacttttctttggaatcaatagtatttgtagaaatttcttctggtgtgaaatcactgatgtaaaaatctagacaatgaataacctcccttttctcagtcacatcccttagttttctaatgaagaggaaagggtagcgagagagtgcacttgtcaggggtctgctttgcaagcccgaggacctggggttagtcctcggaatccatgtttaaaaaggccggacattgcggttcatgcttgtaatgccagccctggggaagcagagacaggcttcctgaagctttctggccagctagccaggcctgtctacttggtaaacttgaagccagtgagagaccatgtttcaaaaacacacgaaagagcccaaggaaagtcacttgaggttgtcatctggctaatatgtgtacttgtggacatattcacatatatacagccacacaaacctatgcacagacaagcaggtcttcaaatcaaagaataaatgagtcaataaataaagctgggcatagtggctcatgcctgtaatcctagcccctgggaggccgagacaggagaattaccctgcctgaaaaaaacaaaagcaaaaagaaaacggttccacttggcctcagaaatgaacatgtatttggtaagaaaaagaaaaaagaaaaaaaagaaagatggagaaaagagtaggtactactttggtgcgaaagacttgctctgggaaatccaaaggacttaggagacagaggcccttgatataactgaagtaagggaatacacattttttttacttctgaattcttctcccatgtcttagacagcaaacagatgcaatgttttctggttttgtactaaggtatccctttagagccatttcgaattagagtttacagccatctgtaacaaacaatgtcttctgttggtcctcactcctactttgccacatgtgaaaagaaccagtggtccaccggcttctcccatcacctgcagtccttttcaggaggcgttttagaattcctccctagcctccttatacccagctcacctggggtggtagaaatccgagcacgaataagaagcagttgctggcttttatggccataaaccggcaggagaattgtgactgagggcaaatgctgggaaatttcaaatagaagtgtcagaatgccacacagagagccaccaccctattgctttttacttggtgttctctgaatttgacagttccattgtgaccgggaacggacctaccggtagactttggtttatttatgctatgatcttgtggcaaagggcttcattgatgttttatatattagttgtaagaaattgatggacctctcctccctagagaccggaatataaatgaattaacgtgtttaatctgagacatttatataactgcaaaggcccacagctgtagtcagttccataatagctagtgactgtgtggtgcctccctccttctttcctcttggacatttatattgctgagcatcacaacatgccggggcaaacataggaagcagaggacacttgtcctgtgttttctgtccctatccaatgtgggcaggaatctgaaagtaggaagaggctggttcttgaaatctgggaccactggtattttaaaactgcttgtattcccttctacttcccaggttagttaaatgatctttatgtccttagataccactttccacatattttttgttccaaactgagagcctaggaaatagcagtagaaaaaaaaaatgtttgtaggataaaaaggcacaagatgacgaagtattttttcccctaactctggagtatttattttttaaaaccccagagctcagataggatcaaagtatgtggaggtagcaagtgtgcagcttagatgtacattcttctcgtgtgtgcactcatgctgagaaccactgggttagggaaacaagatgcaaacatcagagtgcagacacaattaaaaaagccacaaaggggtctgtgtgcgggaggctaatgtataactacaggtaagtgaagttttagtgacagctacaaagtcagtacattttctcccttatccaacggggtgttttagtctacagtcaatacattgctcactgaaacatggggaatttcagaccttgtatatctgctatctctcagatgtagagtgcaagccacataaacagaatcttaagtttctgattgataactacatgaaaagttactggtgaaattaatttgaatagtatataaaacccagtctgtttaaaatgttattttatcatacaatgactatgaaaatcttaagatattttatgtctgtttctctctgagttttcttttttctttttttaagatttatttattacatttatatgagtgccctgtagctgttttcacacacaccagaagagggcatcagatcccattacagtggttgtgagccaccacgtggttgctgggaattgaactcaggacctctggaagaggagtcagtgctcttaaccgctgagccatctctccagccctctctctgagttttcaaatcctgatttgtgtctcatggcacggcttgctttagatgagacacctgtggctaatgactgtgtgcacagtgggcttgaatcgctcctcaggtggagtagcacctaaagcgctcctgaaagcagtctgggtaaaggcaacagaacaaactgaccaaatgagcagtcttgcttccaggaggcaggcagattactgaatctcttatttggaagctactgtctctgttaacttcttatcagttaatgagaacttccagtttaag

SEQ ID NO: 116 - DNA, 1416 bp, Mus musculus
tcagatttgaccgagaggctgagttctctataggaacacccacatttgtatggatgagtggggaaagatagctgcagcagacaaggaaaaagcgtcctgacctcccgagaacatgagtatgctaaaacccagcggcctgaaggcccctaccaagatccttaagccgggaagcacagccttgaagacgcctgctgctgctgcagctccagtggagaagacaatacccagtgagaaagcctcgggccctccatcctccgagacccaagaggagtttgtggatgactttcgagttggagaacgtgtttgggtgaacgggaataagcccggatttatccagtttcttggggaaactcagttcgcaccaggccagtgggctgggattgttttagacgaacccatagggaagaacgatggctctgtggcgggagtgcggtatttccagtgtgaacctttaaagggcatattcacccgaccttcaaagctaacgaggaaggtgcaggcagaagatgaagccaacggcctgcaggcagctcctgggagaactgcttcacctctgtccactgctgcagctaccatggtgtcttcttctccagccactccctcaaatattccccacaaaccgtcccagtcaacggcaaaagaaccttcggctacacctcaaattagcaacctcacaaaaactgccagtgagtcgatctccaacctttcagaggctggctctgtcaagaagggggagcgggagctcaaggtcggagacagggtgctggttggtggcactaaggctggcgtagtccgctttcttggcgagaccgactttgccaagggggagtggtgtggtgtggagttagacgagcctttggggaagaacgatggtgctgtggccggaacgaggtattttcagtgtcaacccaaatatggattgttcgctcctgtccacaaagtgacaaagattggcttcccgtctactaccccagccaaagccaaagccgccgctgtgaggcgagtgatggccgccacgcccgccagcctgaagcgaagcccttctgcctcctccctcagctccatgagctccgtggcctcctctgtgagcagcaaacccagccggacaggactattgactgaaacctcttctcgctacgcccgcaagatctcgggcaccactgccctccaggaggcgctgaaggagaagcagcagcacattgagcagctgctggctgagcgggacctggagcgggccgaggtggccaaggctaccagccacgtgggggaaatagagcaggagctagccctggcccgagatgggcatgaccagcatgtcctggaactagaggccaagatggaccagctacggaccatggtggaagctgctgacagggagaaagtggagctgctcaaccagctggaagaggagaagag

SEQ ID NO: 117 - protein, 439 aa, Mus musculus
  VARIANT (1)...(439): Xaa = Any Amino Acid
PPENMSMLKPSGLKAPTKILKPGSTALKTPAAAAAPVEKTIPSEKASGPPSSETQEEFVDDFRVGERVWVNGNKPGFIQFLGETQFAPGQWAGIVLDEPIGKNDGSVAGVRYFQCEPLKGIFTRPSKLTRKVQAEDEANGLQAAPGRTASPLSTAAATMVSSSPATPSNIPHKPSQSTAKEPSATPQISNLTKTASESISNLSEAGSVKKGERELKVGDRVLVGGTKAGVVRFLGETDFAKGEWCGVELDEPLGKNDGAVAGTRYFQCQPKYGLFAPVHKVTKIGFPSTTPAKAKAAAVRRVMAATPASLKRSPSASSLSSMSSVASSVSSKPSRTGLLTETSSRYARKISGTTALQEALKEKQQHIEQLLAERDLERAEVAKATSHVGEIEQELALARDGHDQHVLELEAKMDQLRTMVEAADREKVELLNQLEEEKX

SEQ ID NO: 118 - DNA, 53242 bp, Homo sapiens
  misc_feature (1)...(53242): n = A,T,C or G
ataaatacccacatacttagagaaatatcagtgaaaatagatcttagtggtcctagcacagtaaagtgacaaaagactaaaaaaaacctagagttacggctcctggaatccttctgacttttttgaccatagtacttgcgagaacgcgtcccttgtgaatctaggcaatgacggcaacaggagccatgcagcagtgacagaacgtctcatgggattacacaggggatgcagatcagtgaagaaatattggtgcttataaatagtcatgacaggaatggaaaaaaggacaggctgagtgactttaatattcaataaaacaagtaatctcatgtgaaaggcatgtgtttttgaagatgatggaatgctcttattctgacacctgactctagaggtggtttaagtcagtcctatagacaaggcagtgaacttgatggggatatgtggaactgaatggaagaatggaagtgtgaacacatggcaccatgttggttttttttttttttgttttttttttttgagatggagtctcgctctgtcacccgggctggagtgcagtggcgcgatcttggctcactgcaacctccgcctcccgggttcacaccattctgcctcagcctcctgagttgttgggactacaggcgcccgccaccatgccaggctaattttttttttttgtatttttattagagacagggtttcactgtgttagccaggatggtcttgatggatccgacctcgtgatccacctgcctcggcctcccaaagtgctgggattacaggcgtgagccactgtacctggcctttgttttttgttttcagatggagtcttgctctgttgcccaggctggagtgctgtggcgcaatcttggctcactgcaacctccacctccccgggttcaagcgattctcctgcctcagactcctgaataactgggattacaggaatgtgccaccacttctagctaatttttatatttttagtagagacaggtttcaccatgttggccagcccgaaggtctcgaactcctagcctcaagtgatttacccaccttggcctcccaaagtactgggattacaggcgtcagccactgcacccggcctattctgttaccttttaaatcagcctactagttgatactgaaaccagtgtctccaggcccctgctttatattctgtccagtgaatctcgcttgttagtgcactgatttgatacattggcccttctgtggcctgcgccccaaactgtgtttggtggcgtcacacacattttccctgtgttcagggccaagctttgggaagccagagtcaacgatgctcttaggtgtctgtcacttgtcctcagctcgcgtagaccgctcactcatgcgcttaccgggtattctaccttggagtgcatgctccctgccttcatgccctgtggtttgattttgagtcacggaactgttgttagggcacacattctgagcagtcacacagtgtcatcatgtcatcggaccactctgtgtaaatgtgcacaaggagtgttctgtatcttattcggaagactaacaagtttcccaggtgttagaatatgggccaatgaaacagctatatgcggctgggcacggtggctcatgtggtaatcccaacactttgggaggccaaggtgggtggttcacctgaggtcaggagttcaagaccagcttggccaacatggtgaaaccctgtctctactaaaaataaaaaaaaattagctgggtgtggtgacgggtgcctgtaataccagctactcaggaggctgaggcaggagaatcgcttgaacccaggaggcagaggttgcagtgagtcgagatcatgccactgcactccagcctgggtaccagagtaagactctgtgccaaaaaaacaaacagaccaaaaaaaaaaaaaaaaaaaaaaacaagaaatgatgtctcctactgtattggccttaaatctccagccacaggttcctttcatgtgctttgagacatacttattaaatttttcatcggtagctcagtctctgtactgtattttgctttgagtttcatgtgggtgtgttttcaaactctttgtgctgagctctcggttttactgggcagtgccttgtgctgccagcagagcttccttatacattatgtatcacctgtcaaatagatattttaaagttcctcttactgtaagtgctattttttccttttctatgctaagaacaattaaattattcctggctcgagattcaggagttttacatttctctgcccttttcctcacatacatgttgtaatggagcacagaagatggatgttgcatatccaggggggcctggggtattatctgcttgttagttttactatcgatgccaagaggagagctgcttgttttctgcttccagtatgtattctagcctggtggtgtcctatgtagtagccacgagccacataatcacgtattgagcacatgaaatgtggtgagtccaaattgaggtgtgctgtaagtataaaatacactctggatttcaaagatctattatgaaaaaagaatgtaaaatgttaataattttacgttaatcacatttgttgttgttagagacgaggtgatatttgttttttgagacagagtcttggtctgtcacccaggctggaatgtagtgctgccacccaggctggagtacagtggcgctatctcagctcactgcaacctccgcctcctgggttcaagcaattctcctgcctcagcctccggagtaggtgggattataggtgcccaccaccacatccgactaatttttatatttttagtagagatggggtttcaccatgttggccaggctgctgtcaaactcttgacctcaagtgatccatgtgcttcggtctcccaaagtgctgggattacaggcatgaaccagcacgcccaggcaggagatgaggtcttgctctgttgcccaggctggagtgcagtgccatgaccagagctctctgcagcttctaactaaactcttgggctcaagcagtcgtcccatctctgcctctggagtagctgggatgcaggtgtgtgccactacacccagctaatttttaaaaattttgtagagatggagtctcactatgttgctcaggcttgtcttgaaatcctgaactcaagtgatccttccacttgggcaggcatgagccaccgtgcccagcccttgattacattttgaaataatattttaaatctactgggctaaataaactatatcatgaaaattaatttcacatgattctttttcatttttaaaaatatggatactagaaaattcagaattatacatttgtactgcattgtatttctactggacagtgctggtctagaaagtataatactgtcaacaaatgtaattatctaatttgagactcacactttttttttttttgagcgggagttttgctcttgttgcccaggctggagtgcaatggcaaaatctcggctcactgcaacccccacctcccaggttcaagtgattctcctgcctcagcctcccgagtagctgggattacaggcatgtgctaccacacctggataattttgtattgttagtggagactggcttcaccatgtctgtcaggctggtcttgaactcctgacctcaggtcatcctcccgccttggcctcccaaagtgctgggattacaggcatgagccagcatgcccagccgagatcatacctgttaaatagcactcattgtaggtagtaattgagcagtttgcccatagcttcattgacctactttcttggagtacaatggcgccatctctgctcaccgcaacctctgcctcccaggtttaagcagttctcctgcctcagcctcctgagtagctgggattacaggcatgtgccaccacgccgcctggctgattttgtatttttagtagagatggggcttcgccgttttggtcaggctggtcttgaattcctgacctcaagtgatctgcccgccttggcctcccaaagtgctaggattaccgtgcccggcccattgacctactttttattaatttgttcattaataattagagatgaggtctcaccaagtttcccaggctggtattgaactcctgggctcaaagcatcctgccacctcagcctcccaaagtgttgggattacaggtgtgaaccaccatacccacccttcattggcccactttttagaaaaggatccaggccagtcgtggtggctcatgtctgtaatcccagcactttgggaggccaagacgggcggatcacctgaggtcgggagttcgagaccagcctgaccaacatggcaaaaccttgtctctactaaaaatacaaaattagccaggcatggtggcacgtgcctgtaatcccagctacttgggaggctaaggcatgagaattgcttaaacccgagaggcggaggttgcagtgagccgagatcgcgccactgcactccagcctgggcgacaagagtgaaactctgtctcaaaaaaaaaaaaaaaaaggatccggagttgggaaaccctgtaatgcttctgtgtttatcaagtgtttagagtgtaagatacagttacttgatgctttagtttgaaaatcgcatcattttgcataattttatggattcttgttttgctgttgactcacttgagaacttttttgaactcttactgtgtatcaaacttttttagattcgttggatgcgaagacaaatcaaatctcatggagcttagtcatagcatgatatgcaaacaagacaggaatgcgtgtgagtcatcattccgtaatcgaagctgcccagtagctggagtagtccagagaaggaagagagggcaagaagagtagtcagaagagactgctgatgtgtctcctgtgttcttggagagccatttcccatgtgcccccaaagcccttctgtgtggcagtatgctgcgcgtggcagtagcgtatggggcctggctctagaaacagccagtacgtgggaaatgaagcccgtccaaggaccttaagctcagttcagccaggagatgtgatgtttttaaattggggctaagcaggcccataatttttttttttttggttacttttccgtgacattggatagttgacttttttgttttactcaagaattgaagaaaatttgcaaatgcccttcaatcttatttatctttttcagtctcttctgtatatacagaaatatgaatgtgaatgaagtggaaggaagaaaatcaaatagcttgccctttcttaaggggaaacaagtcaatttggaaaggtcccagcgttgtgtaagtgttttcagtggctcaagccgaggagctcaggttacactgcatctcctgtgttgggggtggggacagcaagtgacacagcatacttacgtaaccgtgacttcaggggacaggattaagctgtgaatgaacctcccaaacccaggaatatgatatgagaacatagcctttgaatttctctctcaagtttgacttgaaaaatcagcctcagaaacatctttatcttaagatagatttccgttgctctcagaacgtctctcccctgaccttctgttattaagttcatggacatacagcattttagaattaggtgggggctccgaagtctgcgagtgcagctgtgcacaggtaagtcacttcacccgcctggtgctgaatttcctttgggtcttgaagcagggccgcgttgaaacctgggtttctggacgttgtagctaccacgcagcctgtttctggaagcttggtgttaaactccctctcctggcaggttaaattcattgcaaattcttcaactctcctttgcctcccaacagaatttttagatttagtaaataaagtggcattttcattttgtggatggggcaaaatggactggaaagagtctgatgtgtagagatgtgattttcttggggcaacgtgatgccgctctatgtgtgccaggaggtgctgagcctgtttgaagctcttatcagatctgggttctttcttcactgatggcagaggtctgtacttttcactttggcaaagttagagccacagtctttcctttcacttctgaatccttgaccttttgcttacaggatttggatttgatacccaaaacaggactagaactgtgaaggtatggagttagaaacagatcttatttaattagtgtcctcaggttgaagttgggaatactgagccggggaaggggttatgtgagttgttcagggtcatccaactggggtggaatttaggtgtctcacttcctagtccagctctctgttcatacttttttatttatttgaaccatgacatttaaaaaataggagtaaacataaccttaagaaatcagatgagaatatgaagaatattactgctttttgtatgaacataattttcaccattcttgtttttgggaactgcttgttttgtggaacctcttgtttctgtaaattgcttaaggttttttttttttttttttttggatatctggtcaggaggaagggggattagattttattaaaatatatattttctataataagtgtctttttttcttaaactttttaaaaaaagattttagagataaagtcttgctaatattgcctaggctggactcaatctcctgggctcaagcgatcctcccacctcagtctccgaagtagctgggattccaggcaggcgccaccatgcccggctaattaaaaaaaattttttttttttagagatggggtttcactatgttgcccaggcagctctcagactcctggacttaagtgatccacctgccttggcctcccaaaatgctgggattataggtgtgagccaccatgcctgggcaaacttgtgtgttttaaaaacatattttgttcttacgagtaaaatgtctctgcttttataaaaatatagtactttaattattcacattataatgctttttgtgatataaagcatttcaatcttagaggctcgtccttaaaattaattttttttttttttttaaggtggagtctcattctgtcgcccaggctggagtgcagtggcgtgatctcggctcactgcaacctccacctccagggttcaagctattctcctcagcctcccaagtagctggtattacaggcgcctgccaccacgaccagctaattttttttttttttttttgtattttcagtagagacagggtttcaccatgttggccaggctggtctcaaattcctgacctctggtgatccggctgccttggccttccgaagtgctgcgattacaggcatgagccaccaagcccagtcccttaaaattaatttatttgaggaatttacttggccaagatgattcaaagctctaagcaaagtttttatctgtttgccactgtattacataaaataagcttgccactataccatataagcccacttatttcagtggctgaaactgataagttaattttcttttttttttgtttttttttgagacggcgtctcactctgttgcccaggctggagtgcagtggcacaatcttggctcactgcaacctctgcctcctggcttcaagcgattatcctgcctcagcctactgagtagctgggattacaggcgtgcgcctccactctcgactaatttttatattttttttttagtaaagatggggtttcaccatgttggccaggctggtctcgaactcctgaccttgtgatcggactgcctcccaaagtgctgggattataggtgtgagccaccatgcgtggccgataagttgattttcagttttggaaaagtttaggatacatatttactgatgggaaaatggggagaggtgattcaggtgtctagacttctttcttcctttttttttttttttttttttttttggagatggagtctggctctgtcgcccagactggagggcagtggtgtgatcttggctcactgcaacctctgagattacaggcgtgcaccactatgcccggctaatttttgtatttttttgtagagagaggtttttgccatgttgcccaggctggtctcaaactcctgacctcagatgatccacccactttggtctcccaaagtgctgggattacaggcatgagccacacgctgaactcttccatcttttgattctgttgtcttcagtacatgctttcgaggttgctgggcttgtctccatcaagccatcagaagggcaaagagcatgggggattgtacacagtaggttcctctgggctaggcctagagtggcacatgcctcacacacttattccactggctagaactcagtcacgtgatcatactgaactgtagcgggagctgggaaatatggtgtgaatccaggaagaaaaagaggccaggcacggtggcttacgcctgtaatcccagcactttgggaggccaaggttggtggatcgcttgcacccaggagttcaagaccagcctaggcaacatggtaaaaccccatctctacaaaaaaaaaaaaaaaaaaaaaaaaaatttgccgggtgtggtggtgtctgcctgtagtcccagctacttgggaggctgaggtggaaggatggctggagtctgggaggtcaaggctgccatgagccatgagtgcatcactgcagttcaacctgggcaacagggcaagactctgcctcaaaaaaaaaaaaataaacaacaacaaaaaagtcttggtgaacagctagccaccctctccccctctccatatgtattcacttccatcctggcttggctgtactgcactcttgtttctgtggagaaagcagctcagtagagtctgtttcttcactctttcggttgaagccgttttactgtggctcaaaagaattttttttctgcctgtgaaattaattatacctgttcattaaataaaatttctatagacccaagaaaacacagataaaaattaccagtgattccattgagataattgttctgagtccctgttacagttcccttcaatttcagaatttttaagcacttagaaataataaaatgtcactaattcttactctgtgctggcttgcaaacttcaaaactcttaagagggaggaaacaacagcctggccattttgccttttcctcacaaagatacacagggctattccggagctgtcccgaggctttattcttctggcattttcaaaatgacttagacatcttaatctccacttctccttagtaaacagggtaaatattggggctggtgaactcaatagtttattaggatggcaagggtaacattttaagtttatgatttatttcctactcagttatcaggattcttttttctttcctttttctttttttttttttgagatggagtcttgctctatcgccaggcaggagtgcagtggcacgatctcggctcactgcaacctccacctcccaggttcaagagattctcctgcctcagtctcccaagtagctgggactacacgcacgcaccaccatgcccagctaatttttgtattagtagagacggggtttcaccatgttggccagggttgtctctatctcttgacctcatgatcagcctgccttggcctcccaaagtactgcgattacaggcgtgagccaccacgcctggcggggatgcttaaatgtagcccaatcctccagtaaagaatactaagaaaaagtgtttggaaccgaaccaaaataaaaacttgcgtaccagaagtttgcaggtaatacagatatgcgtacatgactggtgttcagctatttaggtggacttgcttgtctctgcttacctgtgttgctgatgctggtcagcagtggagaaaactgagattagatgctgctaatctcagatgggaggataatttcttaggaggaaggacatttcttgagtcatcagctccagattcctttaaagtggtgaggcttcagcccagagggcgactaacatgagaattcctgtttgtgaggtcattgtcatgacctcatagccaggctgttcaaaatgtttgcccagcttctggcaggatatgagctgatgcctgccccgattctacagacaccatgaggtactattttcatattctagatttgtgttgattttcttcaacttcttatagataaaaagtaaagacattgacaccaggccctctttattttgctgaaagagatcgtataatgatgagaaaattattgtgagtatcctctggcaggacttttaaaggcagaaaactccacagttgaatagaaagtgtttttactgtgtgtacgtgattagtcagtagctctatttgctacggaatttactatccattttttctgcaaataaacataaagttttttcttctgtgaaaaagtaacagtttgaaatgattagactaggttatcagtggcagaaattctttatgacccagaggtctcaattcagatgcatcacaatcgagaagttgtcaccatctgtttttgattattttgccttgtgctgtttatacctgtttcagttggagttggaagaaaaggtgttggttcgtacagatattcagaaagctagtctctgagggttaatattaactttttaaaggattgtccttctttttttttatttttgagccggagtctcatgttgtcgccagactggagtgcagtgatgcaatctcggctcactgcaacctccgcctcctgggagctgggattacaggcgcgcaccaccacacccagctaatttttgtatttttagtagagacggtgtttcacaatgttggccaggatggtctcgatctcctgatctcgtgatccgtccacctcggcctcccaaaatgctgggattacaggcatgagccactgtgcctggcctaaaggattgtccctttaagtaaataaaaacttagaaaaccctgtgtttctgtattctgggtgcaaacacttgataaattgtccctttccatctttttttttttttttttttttttttgagacagcgtctcactgtgttgcccaggctggagtgcagtggcgaaatcttggctcactgcaacctccgcttcccggcttcaaacgattctcgtgcctgagcctccagagtaactgggattataggcacgtgccaccacgcccagctgatttttttgtatttttagtagagacggggtttcaccatgttggccaggctggtctcaaactcacctcaagtgatccgcccgcctcagtctcccaaagtactgggattacaggcgtgagccaccacgcccggccccttttcatcttttatttaagtaatgcagtacgtaaacaatggaacttttttctaagtttgactgtgagtttaagtggagagatgatgcaccacctcccaaataataattttcttattgctttgcacccataaagcatgtcagtgtcagagagacatcacatcctgttttttgaagtagactgtgcttttaaaagcattgccctgtgtgttctctgtttttccccctccgaaacagtcacatgtccctattttcttaaatacataaaacctagaatcttttttttttttttttttttttttttttggagacagaatctcactctgtcacccaggctggagtgcagtggtctgatctcagctaaccacaacttctgcctcccaggttcaagtgattctcctggcttagcctgctgaatagctgggactactggtgcgcaccaccacacccggctaatttttgtagtttagtagagatggggggtttcaccttgttgtccaggctggtctcgaactactgacctcaggtgatctgtctgcctcagcttcccaaagtgctgggattacaggtgggagccaccgtgcccagcnnnnnnnnnnnnnnnnnnnntctggcttttctttccatggcatgtgggtgggtaccactggcactactcatgagtatcagccttgtttaaactcgggttttcagtgcaggaggcaagtaggaaggaacagagttgagaaaaggtaaaaaatatacatatgccatacaacttgagattaaggaaagagaaaacatataaaagggaaggtaattttctgagatggaataaactgagttagatttattttaatttatttaattagacagcaagcatcctgcctcgccaacagagggcgcctacggccagtacagctactgccctgataatcacagtttaggggcctcattcaatatgaaggggcctcattcaatatgaaacctaactgtgttcgatgtataacttggaagggctctgtgtttagtaaaactaagtagtcaataacatttcaaagcagtgcgttaccaaaggcgaagggatagattaaaaaaaaaaaaaaaaaaaagagaccctcctggccaatatggtgaaacctcgtctctactaaaaatacaaaaaattagctgggcatggtggcacacgcctgtaatcccaactacttgggaggttgaggcaggagaatcccttgaacccaggaggcagaggttgcagtaaggcgagatgccactgtactccagcctaggtgacagagtgagactccatctaaaaaaaaaaaaaaaacaagattgccaatctgcagtgaattttagccacagggacaatatataacttctttagatcaagtttcattattaaaaacatttctggctgggtgtggtggttcacacctgtaatcccagcactttgggaggccgaggtgggtggatcacttgaggtcaggagttcaagaccagcctggccaacatagcgaaaccctgtctctactaaaaatacaaaaattagccgggggtggtggtgtgtgcctgtagtcccagttactcgggaggctgaggcaggaggattgcttgagcctgggaggtggaagttgtagtgaactgagagtgggccactgcactccagcctgggcaacaggaatgaaaccctgtctcaaaaaaaaaccaaaaaacaatttttgtgcttttagtatgtattcttattagggagaatagaagtgaatctttaacctttgaattcacattcaccttgcaagatctctttcacggaagggtagttactgagatgtgtctgagtggtagcgggcattagagtgggagtgattctcgagccggcttgccatggtggttttctggggctcctggaacagtgactgccctctgtgctttgcgtgaagtgttgtacagcactaacttcaccaccaaactttgggattcattgctggggccctgttttgttttcattcaagatcctggtaactcactcactctcttctaccacaagtcaattttttccttatgtggatattttgaatattcttaccttaatgaggcaggttataggggattgcttattaaaaggaataaatacagaaagcatatttttatgttttgagaaggctatggtcttgaactgtatgtatacccaacctcagatttccttctttcttttgttttgtttttagagatggggctcgttctattgcccaggctggagtgcagtcgtgtaatcataggtcactgcagtcttggcctcatgggctcaagccgttctcctgcctcggcctcctgagtagctcgctctataggcgtgatccaccacacacagttaatttgtatttttttgtagagatgggggtctcactgtgttgcccaggctggtctcaaactcctggacttaagcaatcctctcacctcagccccctaacgtgctaggattacaggtgtgaaccactgtgcctggcttggaagacagatttttatgtaatttactgttcaaataatgtgtagtgataagaagtgatatctgagaggaaaatgaggagcttggattcttagaattagtgatacaactaacatttgtgattcttgtatggactggtggtggtgcattcaaatggtgttccaactatttgaaacatcccccaggtgctggtgttttccaggcattgaggctatgacagtatctaacgcgctaaatactaaatcttgactttatgaagggtagaacacatttttgtgttgttgggaggaagaatagtcctactttcaggaatactaaatttgacatcccaaatgtcatttatttttcatgtcctaaagctgacatgaagttcttattactattttatttattattttctttttgagacgaagtctcgcttctgtgccccaggctggagtacgatggcgcgatctcagctcactgcaccctccgcctcctgggttcaagcgattttcctgcctcagcctcccgagtagctgggattacaggcacctgccactatgcccagctaatttttgtatttttagtagagatggggtgtcaccgtgttggccaggctggtcttgaactcctgacctcaggtgatccacctgcctcagcctcccaaagtgctgggattacaggcgtgagccactgcacctggccttgttcttctttttgttagacggagtcttgctttgtcacccgggctggagtgcagtgacatggtcttagctcactgcagatcctgcctcctggattcaagcattcctcctgcctcagcctcctaagtagctgggattacaggtgcccgccaccacatctggctaatttttgtatttttagtagagacggggtttcgctatgttggccaggctggtctcaaactgccaacctcaagtgatctgcccgtcccggcctcccaagtgttgggattacaagtgtgagccaccacaccgagccggaagtgtaaaccttttatgagcaggaagagaagtgattgtatggctgagcaatctgttcatggagccctactccctggtgcgtagttggggctttgaagtagatctccctgcttctcatattcgagggagtacaagcaaagcagtagctgtttttgactctttggaagtgacttaagttctagagataaacattttattcttttttttttttcatacctcatctggcagaagagagataaacattatacaaatggttcttgacttgaaaaaaaatggtctagccgtggtgtcagtcaatggtttcaacagtggattctaggggttaatgtgtaggtatattttgtcacattatagtttggaaagcaagattacatgacttttaaaagcaaatgatgccaggtgcagtggctcacacctgtaatcccaacactttgggaggccgaggtgggcggatcacttgaggccaggagttccagaccagactagccaacatgtccaaactccacctctactaaaaatgcaaaaattagctgggcgtggtggcgcatacctgtagtcccagctactggagaggctgagataggagaatcgtttgaacccaggaggtggaggttgcagtgagccgagattgtgccactgcacttcagcctgggtgcagagcgagactccgtttaaaaaaaaaataatatatatatatatacatatatatatatatatatatatatgtatatatatatgtgtgtgtatatatgtgtatatatatgtgtgtgtatatatgtgtgtatatatatgtgtgtatatatatattatatatatatatatatatatatatctgagactgtgtaatttattagaaaagagattgaattggctcacagttgtgcagcctggagaggaagcatagcagcatctgtttctggggaggctcaggaagcttctaatcatggtggaaggcaaagggggaacaggcgcgtcacatggcacctgttccagaagcgagaaagagaatgagggagaggaagtgccacacacttttaaatgacccaccctgcaagaactcactgtcaaaaagacagcacctagccatgagggatccgcccccatgacccaaacacctcccaccgggccccccctccagcactggtgttgacagttcaacatgagatttagcagaagacagatatccaaactgtatctctccccaactacattataaattctttttttttttttttttttttttttttgagacaggatctcattctgctctcctggctggaatgcagtggtgcgatctcgactcactgcaacctctgccttctgggtttaagcaattctcatgcctcagcctcctaagtagctgggcctacaggcatgcaccaccacgcccggctaatttttgtatgtttagtagagacggggtttcgccatgttggccaggttggtctcgaacacctaacctcaagtgatccgccggctttggcctcccaaagtgctgggattacaggcgtgagccaccgcacccggccctttataaattctttgggcttagatgtctgtcatatagttttgtgtcatctgtagcaagcaccagctgtaattttggtttggtattggatatacctcagctggtttgtagagtcatttaaatacttcagactatttttctcattcattttatttagtaaacattgtttataaagtgctgggtaaaacataaaggtgactaaaatacagtttcttcccttgagagatttctagtgtggtggaatctgtgagctacacacatggccaagtgtgcaaggggctattgcaggggcacagacttgccatgggtagtggaaggatgaacagattttcattgcaaggactggagtaagttttgtggggcagatgaatgcctgagtttgcccttgagccaagtttcagcacctgaagaccacaagacttggaaaggacattcgaagcaaaggggacccccagccttgaaaacatggaggaggggaagctgctgtagaggtgttggggaagtcagttgtgtaggtgatttatgtccatatcattgagaagttgaacctcagattacttcttgatgaataacttagcagtggttctcaaactttagcatctgggctgggtgcagttgttcatgcctatgaccccagcactttgggaggccgaggcagtaggattacttgagcctaggagtttaaaaccagcctgggcagcacagtgagacccagtctctacaaaaaagaaataaaaaacaattacctggacttggtcgcacacgcctgtagtcccagctactcaggaggttggggttcgtgaatcacttgagcccagaattcaaagggtgcggtgagctaccattgtgtcactgcactctaatctgggtgataaaacaagaccttgtctctgaaacaacagcaacaataataaacttcagcatccaaatagcctgaaggcttgttaaaatacagatagttggccgggtggtggctcacgcctgtaatcccagcactttaggaggccgaggcaggcagatcatgaggtcaggagatggagaccatcctggctaacacggtgaaaccccgtctctactaaaaatacaaaaaattagccgggcgtggttgcaggtgcctgtagtcccagctacttgggaggctgaggcaggagaatggcctgaacccgggaggcggagcttgcagtgagccgagatcgcgccactgcgctccagcctgggcggcagagtgagactccatctcaaaaaaaaaaaaaaaatagctggcctaccctcagggtttgtttcagtaggtttgggatttgcatttctaacaaactttcatgtgatgccgattctgtacattttgagaacctctgctgtagaaccagtgcttctgatgactgctttatagaaatgcatgttttatgtatagttgactcttgaataacacaagtttgaactgtgtcaccacacccagccctctgacattcttaaaaacgaatgagatctctaaagagcttttgtttatgtatgttatagctgttaatatttaccatattagaaattaaaacttgagaatatttaaaaatattaattcattagaaataataataggccaggtgcagtggttcacgcctttaatcccagcactttgggagactgaagcaggaggatcgcttgagcccaggagttccagtccagcctgggcaacatagcagaccgcacttctacaaaaaaataaaaatttggccaagcatggtggtgtgtgcctgtagtctcagctgctcgggaggatggcttgagtccaggaggttgaggctacagtgagctgtgatcgtgccactgcactcctgtctgggtgtcagagcaagaccttgtttctaaaaaaaaaaaaaaaaaaaaaaaaaatatatatatttatttttatatatttatatttatttatttatatgaaaaggcatgtattcaggggttgaaatttaacaaaattatttatctcctttatgaaatgcttcatcacactcttaagtgacagtagtcctcccccccgcctccacaagcacttgtgatgtaaaatacagaaaagaatagtgcagtttggttccattgccttgaaacagcatgtacagttcttatccaccattgcttttgtaccatcagtgcaagtgtcaacatagtgaaaaaggcaaatgatgtcttagtattattatgaaaatagttttgattctctaaaagagtctcaaaggttccctgggagtgcaccgaccacactttgagaaccactgtattatagtaatgaaagtcagaggctgggcacggtggtgcacgcctgtaatcccagtgctttgggaggctgaggcgggaggatcccttgggcccaggagttcaagaccattctgggcaatgtggagaaaccccatctctacaaacatatttaaaaattagctgggtgtggtggcatgtacctgtagtactagatacatgggaggcgaaggtgggagaatcacttgagcttgggagttagaggctgcagtgaactgtgatcgtgctactgcactccagcttgagcaacagggcaagaccctatcttaaaaaaaccaagtcacgattggcaggatgatcttaccgtcagctttgtaagctcagaatctctctctctttttttttttttttttgagacatattgcccagggctggtctcaaactctttggcttaaacgatcctcctgcctcggcttctcaaagtcttgggattacagatgtgaaccactgtgccagccagaatctcattttttaaaaaaatcgtttactcaaagattagattcttgaatcacacaaattgagagattgtagtttataaaaaataaccgtgtatttataatcagagaaatgccaaaaagacactattctctttggtcactgttgaaaatctaaactgtaatctgagcatagaattttggaacactgacttgactatccaaatgcctatttttatccagctttgtgatcctgacaaaccttttccataacaatggtgtacctgctccacggactcactgtctcttttcaagagaaccttttcccattagtcaatagacgttttcttcatagcttcctttttctagactttttggactatacttctttttagtttggcaacacatacttaacatttcttcattttgatgtattttctttttttcttttctttttttgagatggagtcttgcacttgcccaggctggagtgcagtggtgtgatctcggctcactgcaacctctgtctcctgggttcaagcggtcctcctaactcagcctcccaagtaactgggactacaggcgtgcaacaccacatccggctaatttttgtatttttagtagagatggggttttgccatgttggccaggctggtctcgaactcctgacctcaggtgatccgcccacctcagcctttccaaagtgctgggattataggtatgagccactgcgcccggccttcgaagtgccaccacttctttgaccttggaaaggtcacttaaccttgtagatcgtcattctctttattcctgattggactaatggtaattgcacacctaccttcacagctgaagcctgatacacaggcagttttgtatttgtgctatgtgagctcttgatgccatacatatgtaggtcattcttgtagtagcagaactgatgtttttcatcttgatgagtgctatctcctaagttttaatattaaatttagtgaaaagagatgaactttggaatcacaatacctgtgttcgcatctgtgccactgagccgaatgaccttaggagacaggtgatgaacaagtgaggaaacacatctgttaatttcttaatttctgcagcatttcttcatttgtaaaaaagaggtaataatagtggctaattcatagtattgtaatgctcaaatgggatagtaattcacataaaaattatttctgaattataatgttctatgtgttatggtccttacatgttgggagggtgggggagaagggtagtttgtcttattttaggtccaaatctcctgattcattgagcacaagtgtcaaaaattcaaatatgctcagcttattagtgaggcaacaatgtctttttttttttgttttgcacattttttggaattgattagtttcaatgtgacattcactgaccttgaaacattatacagagatgttgcctcttgatcactgcatgttgtgggtaccatgacaaagactttgatcttttgtttttttgaagcaagcctgacatgccagtcattaataatgcatgaaaaagaaattataaattggaagatttaaaaaatcaacactggcgttgttgctgctaattcttttattgagacagactagatttttctccttcattaaaccttggtcacagttctccgcgttaggattcaaggaacacagatggaccgacaaccagaggcatgaggattggacaacagagccctagacagagcttatgattagtctttggtttgtaataaccacatgcttctgtgttttaggcggaggcttgaagatggtcagatttttgtgagtttatgatactgagctgcaagatttgaaagttcccttgttaggtcttgtggccgttttcaaaattcctctttagggagtgcttgacgtgagcccaacagctccctgttgtgtgcaagtgaaataatttaaggagcattttgttctttcattttgtcaccgtaaaaggttttccagaaccacagtgcctgctccgtctgttctctgtcagttctacctggcccttgtcactctatgaggttggcccagggtgaagagtagggaaggccctagggaatttctacacttagcctgtttgcatccttctcaaattttatggacgtagacatggtcgttgttggctgagtctagaggagacttggccaatcccttctatctgtctgaggcagcagcaggaacaaataactctgcttgaaacttgcaagctgtgtggtgagagtctgacagtaaagcaggtggtttcaaacctgactgtgaatcagaactacggccttagcgtagggactcccacccggatctctttccctcatcactgatggcagtggtgatggtggtaatggcggtgaggagcttgggaattttatattcataatcaggatagtgacttctgtcttcaggtaaatgccagttcttactctgtccttcagaatcttctcccaaaccacacttatttatttatttatttatttatttattgagacatagtctcactctaccacctagggtggagtgcagtgcacgatctcggctcactgcagcctctgcctcctgggttcagccaattctcctgccacctgagtacctgggattacaggtgtgtaccaccatgcctgacctctgcctctgttttcacgtggccttctttctatgtgttctcatctttttttttttctttttcgaggtggtgtctcgctcagttgcctaggctcactacaaccttcatcttctgggatcaagggattctcgtgcctcagccttccaagtaactgggactacaggaggcacgcgccacaacgcctggctaattttttttttttttgagacggagttttgctctcgttgcccaggcgggagtgcaatggcacaacctgggctcactacagcctctgcctcccgggttcaagcagttctcctgctgcagcctctcgagtagctgggattataggcatgcaccaccatgcccggctaattttatatttttagtagagacagagtttctccatgttggtcaggctggtctcaaacccccaacctcaggtgatctgcctgcctcggcctctcaaagtgctgggattacaggtgtgagccaccacgcccggccataatttttgtatttttaggagagacgaggtttcaccaggttcaccaggctggccttggactcctgacctcaagtgatccgtccaccttggcgtcccaaagtgttgggattacaggcgtgagccagtgcacctggtcacttcttcttatagggatgcttttcattgggttttgggcctaccaaggtaatccaggatgatcttatctcaagattcttaattatatctgcaaagatgctttttccaaataagatcactttcacaggtgctgggggacatgtctttgggggagggcactgttccatccgctggagtgggctgcatgtacctttgtcatccctggccagattctttgccagtggctggcgttggctgtgagggagacaagatgagaaagtgaggtctgtgcttcatcatccaagctctgctcgcagagaaaaatgcagaacattgtcatttgacagagtcattaaatggcagcatttttctctttgaattgttctgtttttaggtattatgtctgaaaatatttccctatattccaaaaccccaaggtaatttcaattcactttctatggaggtgaagagaatatgacaggatactattttaccttagtccaaaagtcatagattcatatctggtcttgagtaaaccagcagtatattgtttttttctagatagaaacaaggtaattttccctcatcacttcccaggtagggctttttcttacatagttttaatcttcctgtagtttaacatatatatagttttatattgtaaattgcataattctgtggatttaaaaaatatagctaatacaggcttgttgtagtaaaacttaagcaatatagaaatgaaagtaaaaaactgaaagcttcctttttctccccgcattgtttggtgtagatttttctgaaccctcttttatggattgtgtgggttttaggaactgtactgagctaagaacattagatatataaaacaaagcaaacactttgtttgtcttaattgcttatttttgtttttgtgttttttgtttgtttgttttgagttggggtcttgctctgtcacccaggctggagtacagtggtgtgatcgatcatggctcactgcagcctcaaactcctgggctcatgaaatccttccccctcagcctcatggctaatttatttttatttttatttttgtagagacagggtcttgctatattgatcaggctggtctcgaactcctggcctcaaacagtcctcctatcttagcctcccaaagtgctgggattacagatgtgaggagtgggtcatggcacctggctaactgcttgtcttgaggatagtaaattgcctttaaatccatttcagcagcattttcatgtgtttaataaccagagtcttctaggttcctaggttcagcctggagatggattattgtcaaatgaaaggaaagctttagtctatgaaagctacctgttgttcctacttgctcctgtagattataaaatctttttatttctttctctttgcagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctggtaatactttacgcttttcctttccttatcctatatggagacttcaatttgctttttaattttaaaacattattttatatctgttcatattcttgaaaatatttgaaagatttttttttttttttgagatggaatctaactctgtcacccaggctggagtgcagtggcgcaatcttggctcactgcaggctccgcctcctgggttcaagcgattctcctgcctcagcctcccaagtagctgggaatataggcgcatactaccacgctcagctaatttttgtattattagtagagatggggtttcaccatattggccaggctggtctcgatctcctgacctcgtgatccgcccacctcggcctcccaaagtgctgagattacaggcgtgagccactgtgccttgcattttttttttttttttttttttaaagatggagtcttgctctattccccaggctggagtgcagtggcacaatctcggctcactgcaacctccacctccggggttcaagcgattctcctgcctcagcctccccagtagctgggattacagacacatgccaccatacccagcttatttttgtatttttagtggagatggggtttcaccatgttggccaggctggtcttgaactcctgacctcaagttatctgcctaccacagcctcccaaagtgctggattataggtgtgagccaccatgcctggcctgaaagaatttttaattgaaagacataaaattttatatgtggagagcttaatgaatttttgtagggttttttgtttgcttctttgtttttgagacaaggtttcactctgtcgcccaggctggagggcagtggtactgtcatggctctcagcgtcccaagtagctgggattacaggcgcgctccaccacgtctggctaaattttgtatttttagtagagatggggtttcaccatgttgcccaggctggtcttgaactcctgacctcaggttatctgcctgccttggcttcccaaagtgctgggattacaggcatgagccaccatgccaggcctggtttttgtttttttttttttttgagatgctgtattgttctgttatcaaggctggaatgcagtggctcaatctcggctcactgcaacctccacctcccaggttcaagcgattctcctgcctcagcctccagagtagctgggattaatggcacccaccactatgcctggctaatttttgtttttttttggttttgttttgttttttgagacggagtttcactcttgttgcccaggcaagagtgcagtgacatgatttcggctcactgcaacctctgcctcccaggtgcaagcgattctcctgcctcagcctcccgagtagctgggactacaggcgcgctccaccatgcccggctaattttgtatttttagtagagatggggtttctccacattggtcaggctggtctcaaactcccgacctcaggtgatctgcccgcctcggcctcccaaagtgctgggattacaggtgtgagccactgcacccggccctatattttttagtaggaatggggtttcatcatgttgactgggctggtctcaaactccagacctcaaatgatccacccacctcagcctctcaaagaagtgggattacaggcgtgagccactgtgcctggaatagtcctagtttttatcagcttcgattgactactcaattgtggagtagtgctatttagtgaatgtgaatggatatttgctcatgatgtgcagggtggcgggtgtagcaaataatgaaatcagaccaattatgaatataggcctggaaaaaggactgattttatttttttcttactttgactttttctaatcttaattgcaaataaaggaataaacctcaactaccagtttgcggagtttagcagcattgaagatggtagtgaaggatcagttattcttggcttccttgtttaaaacaaaacagcacaaaacaaacaaaaacactttggtgaggcacagtggctcatgcctgtaatcctaacactttgggaggctgaggcgggaggttcacctgaggtcaggagtttgagaccagcctggccaacgtggtgagaccccgtctctactaaaaatacaaaaattagccagatatggtggtgcacatctgtaatcctagctactcaggaggctgaaggaggagaatcacttgtacccggaaggtggaggttgcagtgagccgagatcacaccactgcattctagcctgggcgacagagcgagactgtctcaaaagaacaaaaaaccacactttaaaacacctttctaagagttctgggctactcctgtgggctgttggctttctctagtttttctttaagttagaggttgtctgcttgaaaattaaatcgaatctcttatgatcttttgttttcagttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggtgagtagagaaacattctgaggtcatttcattgaactgagatataaacaccagtgagtggttgaaatacacacacatcagggctgggcgcggtggctcacacctataatcccagcactttgggaggctgaggcgggtggatcacgaggtcaggagttcaagaccagcctggccaagatggtgaaaccctgtctctactaaaaatacaaaaaaattagctgggattggtgggggcgcctgtaatcccagctactcaggaggctgaggcagagaattgcctgaacctgggaggtggaggttgcagtgagccgagattgcgccactacactccagcctgggcgagagagtgagactctgtctcaaaaaaaaaaaaaaaatgccagaaatacacacataggatactccttggctcagagtctgttctggagggatgaccactcttttatagagaaattaatcagttcagtttatgggtaactacgcaacaaattagaaactggctgtgcagtttgtgtctagaaagagcagtgaactattctagttgtatctagcagtttagctaaaagaatattgagtttataatttctaaatatttacttttattattaaaaattttcttggccaggtgccgtggctcatgcctgtaatcccagcactttgggagtcccaggtgggtggatcacgaggtcaggagatcaagaccatcctggctaatgcggtgaaaccccatctctactaaaaaaatacaaaaaaaattagccgggcatggtggcatgcgcctgtagtcccagctactcgggaggctgaggcaagagaatggcctgaacccaggaggcggagcttgcagtgagccgagattgcgccaccgcactccagcctaggagacagagcgagactctgtctcaaagaaaaaaaaaattttttttcttaatattatatggctccctgttggggactcaaactccagtctccacatgacaggcagaaacactcaccactatactaacaaggaacttgtaaatagtaaggtaaccgtggctaggtacggtggcttacgcctgtaatcccagcattttgggaggccaaggtgggaggatcacttgaacctgggcaacaaagtgagaccctgtctctataaaaaataaaataattggccgggcggggtggctcattcctgtaatcccagtagtttgggaggctaagcgggtggatcacttgaggtcaggagttcaagaccagcctggccaacatggcgacaccccgtctctactaaaaatacaaaaattagacaggcatggtggcaggcacctgtaatccaagctacttggaggtttaggcaggagaatcacttaaacccaggaggtggaggttgcagtgagccaagatcgcgtcactacactccagcctgggcaacaaagcaagactccatataaaacaaaattaaaataagccggacatggggtctcacgcctgtagtcccagctactcaggaggctgagcctgggagatggaagctgcagggaactatgattatgtcatggcactccagcaagaccctgtttcaaaaaaaaaaaaaaaagagtaactttattgacaaaataagctcagaagtgaacttagatgtgtttataaaaattggattttttttccccttctgatttttaatttttggtttagtgaaattatatgggtgtgtataagattctgctaccttaaatggcttggaaaactcaaggcatcagaggatgttactcaagaatttctgggccaaggccaggtgcagtggctcatgcctataataccagcagttttggaggccgaggcaggcatatcacctaaggtcaggagttcaagaccagcctggtcaacatggtgaaaccccgtctctactaaaaatacaaaaattagctgagctcagtggcacacacctgtaatcccagctacttgggaagctgaggcaggagaattggttgaacccaggatggggaggttgcagtgaactgagtttgcgccactgcactctagcctgggcaacagagtgagactctatgtcaaagaaaaaaaaaaaaaaagaatttcagggcctttcaaatgataaggtttagatttaggaagaggaaggaaatgtacagtagctactgtttgactaataagcagaaacacaaggtgtaaggtctacatgctctacattctagaacctcagaatttagtgattttttttttaaagaggggcagcgtatcatagtgctaagaagacaaactaagtccctgctttgcctttgggacctcagtgagatatttaacaactttgtttcctaacctccataagcaaggctacagtgctgcatttagattatatttgatatttctaggatgtgatgtcaggttcttggacaatttgactgacgcccagctgttgtgtttcaacgtggttgtctccatgccttggactgcatgttctgtgctgaatttttagctcatgaccatatatgaggaggtgacttgtcagctttttagatttgaactgacaagctttatctttctgtgagctactccccagggctcttacactaagaatcttagagtagaattttcttgttctcaacactctttttttttatttttggagacagagtctcgctctgttgcccaggctagagtgcagtggcgcgatcttggctcactgtaacctccgcctcctgggttcaagcagttctcctgcctcagcctcctgagtagctgggattacaggcgcccaccaccatgcccagctactttttgtatttttagtagagacagggtttcaccatgttggtcaggctagtctcaaacccctgacctcgtgatccacccgactcggcctcccaaagtgctgggattacaggtgtgagccaccgcgcctggctgctaatttttttttttggtatttttagtagagacggggtttcaccatgttagccaggatggtctcgatctcttgacctcgtgatctgcctgcctcggcctcccaaactgctgggattacaggtgtgagccactgcgcccggccgctatttttttttttttttttttgtatttttagtagagacggggtttcactgtgttagccaggatggtctcgatctcctgaccttgtgatctgcctgcctccgcctcccaaagtgttggggttacaggcgtgagctaccacgcccagcctaatttttgtatttttaatagagacagggtttcaccatattggccaggctgttctcaaactcctgacctcgtgatccgctctccttggcctcccaaagtgctaggattacaggcacgagctcaacacttgttatacaggtctttgatactgtgaaaggggaaaaatatcttcctgagaattaaaaaaaatatttacaagatttgttttgcttgtgtttgaaccttaaataactataatttatccagtatgtgctttttttgtgtctgtcttcatttgctgaacattatttttgtgaggtttgtctataatatgtagaagtgaaacacacacatagtgaggtcttattacatataagccattttcataatatgctttcgtagattgtagactgtagatttggggcacttgtatggaagcaaatacaggtcttaatttaaaacagtaagctgctgtttcatattatactctttggatgtactatacctgatttaatcatacacatttagattgcacccatttttcccctagaaatgaaatttgagtcaaggggtataaataatttaaaattgttaatagatattgccaaattgcaatccaaaaagcctttatttttgtttccacaaacagtatacaagtatgtccttcctggtaagtttttttttttttcagtcttactggtgctttttttcaccttgtttattaagttaattaaagctctttttttagattcatttaccatattaactttttttttttcttttttttgagacagagtctcactctgtccccctaggttggagtgcagtggcgcaatcttggctcactgcaacctctgcctgccgggttcaagcgattctcgtgcctcagcctccggagctgggactacagacgtgcgccaccacacctggctaattctttgtatttttagtagagatggggttttgtcatgttgcccaagctagtcttgaactcctgagctcaggcaatccacctgcctctgcctcccaaagtgctgcgattacaggcgtgagccaccacgcccggcccttattaacttttttaattaaattttttttattaccgtaggttattggggaaccagtggtgtttgcttacgtgagtgagttctttagtggtgttttgtgagattttggtgcacccatcttccgagcagtatacgctgcacctaataattcgattttttctgtttttctcaatcctcttatcggtgacttagaacctcaaacctatgagcctggttgtgaccttgcatttacattgagtgtttcttcattgtctacttggggaattcttgggctctttttgggtgggagtttatgctctggggaagttgttctttacctgaaatccatttgcctagattgctgatggagtagttagtggcaggatttgctgttttgtgtggtccacaattgagaagatgccagatagtcacatttagttaaaagccccttttggctgaatcttgagatcgtttctaacacaatggattttacttagcttaattcctttgcgatgaggtttgctgcagatttgaataattattttttctgattttagttttgtttttttttttttaatcaagatggaatctcgctcttttgcccagctggagtgcagtggcatgatctcagttcactgcatcctctgccccgtgagttcaagcgattctcctgcctcagcttcccaagtagcgtagctgggattacaggcacccaccaccacacccgactaattttttttttttttctttagaccaggtttcactcttgtcgcccaggctggagtgcaatggcgcaatctcactgcaacctccgcctcccgggttcaagtgattctcctgtctcagcctcctgagtagctgggattatctggatgtgccaccacgcctggctaattttgtatttttagtagagacggggtttttccatgttggtcaggctggtcttgaactcctgacctcaggtgatctgctcgcctcggcctcccaaagcattgggattacaggtgtgagccaccacacccagactgtattttttttttttccccatagagacagggtttcaccatgttggccagtatggtctcgaactcctgacctcaagtgatccgcccaccttggcctcccaaagttctgggattacaggcgtgagccactgtgcccggccaagtttttttttcatttttcagtttcccagttctaaacttcacctagtgtaaccttttagggttgtccaggagggaaatacatggccccttatgctgctgcagagaagctgcgttaagcagctttttcctgtttgcacacagcagactcagtggggtcacattttagcaggtcatcgttgtcagtgctcttcctgctccttgctttcagttttgagagggttccccagttttccttttgaggcttggaaacacaggaaaccgtccacctgcctgtcagatcccatgcctctggtctcactgtccatcctcctcgcctgtgtcctgtgccctgtgccctgactgctttgggtcaggccatcatcatctttacctggacttgcatggcactgtccatgccacttgccttgtctctcctcacctctattctttgcacaattacagagagatcaattaaaatgtcaatttggtgatgctgttcctttgcctaaactctttttaatagtgcccagtctgcctgcaacgttggctttgattttcacaatgtttggagcgttttctatggtgctcagtaattgggcggtggtttctttttctaaacctgagccaatatcctaaccccaaaggtgccaaatttggtgtctgtctagacttgagaactttgtataggctcttggggcttgggagtttggagcttttctgtgttgaggagcccatgccactgctttgggacttggggagagggaggtttggccacacaggcctgagtactgagtgccagtgttgtcttattactggatcacatctcctaacttttaacaactttattgtccctgtgaattctctaagcataatcacaaaaatatcttgagcctcagacacttggtagcttatgatcttttgtagatttaaaaagcaaactttgctaatattttggtcaagtgggtgccatataaaagactgcttctggtgaataaatattctgcattttatcaacccccagggttagaagaggtgatttttttttttttcttttttttttttgagacagagtcctgctctgttgcccaggctggagtgcagtggcatgatctcggctcactgcaacctctgcctcccaggttcaggcgattctcttgtcccagcctcccatgtagctgggattacaggcatgcattaccctttcctgtgtcttgatattcttggggtcctggatcctgtggaagctcagatgcctttcagaagcggagattaagtagttccgagacataaagtgcaagtcaagtaaaacatcatcttttagccaaagcgtctattcataattgtgcatcttttgtttacctgttagttctagggagttagacttacaagagggtatctgttatatgtcatctgctcttgtcatatttctttttaaggggatttatttaatgtcacctgttagagattgggagactcaaaatgatatcataaaaggaataaagtaactgggactgtttatttagcctagagaaaatatgatggctttataaaggctgtgtttaatgctctgcaattcattcagaaaatatcctgagcgtctgctatgcaccggaagttgttccaggtgttgtagatatggcaccaacgaagaccaacacatcgtgatctaaaggggctcctcatggcattaaaataaaaatcgaaactccttccttggacttgcagtgccccttgttctctggaccctgcccaccctcccgacctcttgtccttctcacacccctttctcactctgcttcagctacactggcccctttgctgtttcttttctttcttcttcttctttttttttttttttgagataggttttgctctgttgcccaggctgaagtgcagcagcgccatttcggctcattgcaccctctgcctacagggctcaagcaattgtcgcgccccagcctcctgagtagctgggactacaggcgtgagccaccacagctggctaatttttgtatttttagtagagacagggtttcgccatgttgcccaggctggtctcgaattcctgtcctcaaatgatctgtctgccttggcctcccaaagtgctggaattacaggtgtgagccaccatgcctggccccctttgctgtttctaaacacccagactcattcccactttagaatttgttgtttcttctgcttgggatgttttgtgcccggtgcctcgtggtcacttaagtcatgctcaagtgttacctcctcaggcatcccttccttggccaccccaactaaagacaccttctatggcagtgtcacactaccctgttttatttttttcatagccctcttcaccagttgaaaattatctttcatttttttacttgcttattgtccatttctccctgcccagaatttaacctccatgaaagcacggaaactttctgtctcattcactgtcacacccacaacacttaggacagggcctggcacatagtaggagctcattaaatagtgtggagagaatcagagggttttgaatacagtcgtcactttatacccatgaaggagagagtaaagtagggcaagcagaggtcgacttaggaccagtgaagattttacccttctctgtaggagagttgctggaaggtgaactggcccttcactggaggtaattatattacttgaggtaatcaaaagtggccagacgtggtggctcacgtctgtaatcctagcattttgggaggtcaaggtgggtggaatcagttgaggtcaggagttggagactagcctggccaacatggtgaaaccctgtctctactaaaaatacaaaaatattagccgggcgtggtggcacatgcctgtaatcccagctgcttgggaggctgaggcaggaaaatctctggaacccgggaggcagaggttgtagtgagctgagatcatgccactgcactccagcctggacgacagagcgaaactccgtctcaaaaagaaggaaaaaaaaaaaagtaccatgctttggctctttcatgtcacaggcaattaagttttaagtgaggcttacatttgtatttggcaaataccagctaaccatgtttattttattttattttttttttattgaagtgcagtggtgtgatcttgggtcactgcaacctccacctctggggttgaagtgattttcccgcctcaacctcccgagtagctgggattacaggtgcttgccaccatgcccgactaatttttgtatttttagtagagacagaatttcaggcctgtctcaaactcctgacctcaagtgatctgcctgcctcggcctcccaaagagctaggattgcagacatgagtcaccccacctggcctccatgtttattttttaaaataagctgtttatcttggaatatggcagataagaagccaccttacaagactgctcacaaaattcctgtgaaacaacccctcattactgctcttgagacattttatagctttatgcactcaggcactgtgagattaaatggcttgccgagaactggataatgaagagatgagagagtccagagaggattgtttctgtttcctgtttgtagacacccactcattaacccaacaggaatttatcagtgtttttattttttacaggagcgtacaggaagggtatttgtttctgttcccacagcattttgtagaaatctcttgatgtacttaacactttttacaggaatttcttgtctgaatcttcttgtctgtctccctcaatggccaacgctgtattctgtttatccttgttttttaaggatccaaacactcaagaaatatatattgaataaataaatgagaacttaaaaatctgaggtttgctaaagcataaaaatagtatctagggttttttttgcgtttctagtttaaattaattctgtcttcagtagtgacttttaccacagtattaggagttacatgctaacattctgagagtaaagagaacgaattgggcttgtttgtgtttgccatgggaatctatcttttagtttttttgtttgtttttgagacagggtctcactgtcttgtccaggctggagtgcagtgtcatgatcatagctcacttgcagcctcagtagctgggatcacaggcacatgccaccatgcctggctaatttttaaatttttgtagagatggagtctcactgtgttgcccaggccagtctcaaactcctggcctcagatgatcctcctgccttggcctcccaaaatggtgggattacaggcatgagccactgtacctggccttgttttttgtttcaatattgaaaatgtttttctttaataacttagatatttgtcttagaacatagatttcttagatatgatttgataatagtgccttctgtttattgtcaatgcattatttaatgcttctgtttcctgtacgtgcatgtactagacttttctgcattgtctggaacacatgagaaataaaacctaactttgtaaagtcccgttgaaatgcgtaaacacgttttttgattgtagaatgattaagtagaaaaacatttgatgattttaggacttcacctgactttctgtctccatagaataactactgattttttacagggaaaagaaaaatacattttctgttaaatgagtgaagagttccatgtttggtgggagaaagaatataagaaaactttttgttctaggaactagtaatcattcatttcagacaaattttgtgacataatttttttttcaggatacatgtatattacctgcatttagagaaatagttgctaatttgttatttgtgattactttttacaaagctgatctgaatgaagcttgtagtttgcttggagaattgttgactatagcctattagatgcctcttggaaaagcaattgtcatgacagtgacttcgactcatccccaaagaatttaacacattgtctgaagaggttgcatcatctttaactaatgtgctgtgtcctgctcacatgatgctggctggactgctgctctgaatggtgtggtgtgggaggaaggagaaaattgaggccgactttattttcttttgactcaactgcagtgagaccaattttatataggtgatgatttgtgtgttagtactaacgagtactaaaaggtcaaatgtgtcaagtctagaactagtactcttttttttgagacaaggtctcactctgtcacccaggctggagtacattggcacagtcttggctcactgcaacctctgcctccttggttcaagcaactcttgtgcctcagccacttgagtagctgggattataggcatgtgccactgcatccagctaatttttgtatctttagtagagatggagtttcaccatgttggccaagctggtctcgaactcctggcctcaagtgatccgcctgccttggcctcccaaagtgttggaattacagacctgagccaccgcacccagcctaggaaggataattttaatagttgtgaagaaacagagagcctcactgtggaaaatagcaagagtcaattattattttttgaaacagtttcttgttctattgcccaggctgtagtgcagtggtgtgatcatggctcactgcagccttggggactccagcgatcctcccacctcagcctcccaaagtgctgggattataggtgtgaacttccacactgggccaattattttttgaagtacttttttttttttttgagacagagtctctccctgtcgcctaggctggagtgcagtggtgtgatcttggatcattgcaacctccgcttcccgggtgcaagttattcttgtgcctcagcctcccaagtagctgggactacaggcgtgagccaccacacccagctgatttttgtatttttagtagagacaggtttttaccatgttggccaggctgctctcaaactcccaacctcaggtgatccacccaccttggcctcccaaagtgctgggaggcgtgagccatcgtgcctggcctatttacttttttatttttttgaggtggagtctcactctgtcacccaggctggagtgcagtggtacaactgtggctcactgcagcctcaaacccttgggctcaagcaatcctcccacctcagcttcctgaggagtgggaccacaggcgcacaccactatgcccggctaattttttttattatttgtacagacagggtcttccttatgttgtccagcctggtctcgaactcctgggctcgagcagttctcctgcctgggcctcccaaagtgctgagattacaggcatgaaccactgtgcccagccacaagtttgttttgaagcaggagcagttctttcttttttttttttttttaaatagcccagaggtcctttattttattttattttttaacatctattatgccatgaattcatagggaataggttccagcagctcaggctccttcccattggttctcacaaagtgtgcttctctgggtggagcaggctggcgcttgagttgaacccaggtcccttgctctttggcttctttctttttctgatcattttccttcacgcgtttcaggaagctatcttggctcttagagtgcttaatgtgctccatacgcacattatttctcttggcaagaatcttgcccttgtttgtttacaacaatgccaacagcatgctgggtaacattgtagacttccacttttgccatggtaacacttgtggggcattcctttttgaacagtacgcattcctttgatgtctacaatatcacctttcttttttttatttttattttattattattatactttaagttttagggtacatgtgcacattgtgcaggttagttacatatgtatacatgtgccatgctggtgtgctgcacccattaactcgtcatttagcattaggtatatctcctaatgctatccctctcctctccccccaccccacaacagtccccagagtgtgatgttccccttactgtgtccatgtgttctcattgttcaattcccacctatgagtgagaacatgcggtgtttggttttttgtccttgcgatagtttactgagaatgatgattcccaatttcatccatgtccctacaaaggacatgaactcatcattttttatggctgcaatatcacctttcttatagatttgcatatatgtggccaaaggagcaactccattttttctaaaaggcctagagaacatatatcgggtgcctctcctctttcgctttgtgttcgtcattttggcgaattactggaagatggcggttccggccgaaaggcgaagcaggaacatttctgttagaaaaataaagtgaggtccaagagtggtggctcacgcctgtaatcccaacactttgggaagctgaggtgggcagatcacttgagcccaggagttcaagaccagcctgggcaacatggcaaaaccctgtctccacaaaaaatacaaaaaaaaatagcctgtttggtggtgtgcacctgtagtttcagctacccaggaggttgaggtgggaagatcccctagcccgggaggtcaaggttgcagtgagccatgatggtgccactgcactctagcctggatgacagagtgagaccctgtctcaaaaaaaaaaaaaaaagtattttctaagaaaagcaataatgaacttggtgaacagccttaatgactgcatattagattggctgtctcattattgcaacatattaggcatcaaatcactctggtaatataagtcagccaggtaagtttctttgccagacttccttcaagagaactcttagagtcaaagagaagctaaagcaaagaagttgctggtggaaatgatggaatgtagtacctagttactagtagggaccacaaacgattaagctatagagtgatgttcatctctttattttaaccttctcttcttccaggttggtggcactaaggctggtgtagtccggtttcttggggagaccgactttgccaagggggagtggtgtggcgtggagttagatgagccacttgggaagaatgatggcgctgttgctggaacaaggtttgtttggcgttgtgcaacatcttgtgtcactcttgtacgtgacgatgctcaggccagtctcaccaagcgtgtatcataacatggaaagttgtgtttggaagagtggcacttttatttcctaagacccatctgctaattttttttccccacactaaaattggggctgttctttttgactgtctccttagtaatacatgtagtatgtctgagtagattctgaacaagcattctgtttatttttcaaaataggaaataccatgttatctgtctggcttctctcccttttgataggagttgacttctgaaagaatacctgggcgtctggggagggggcgggggcagaaggtagccacctttattagggaaaagaactgcaaaatgtgtcttcatatttgatgagaattccatcctgcggcaggagaacagaccgccaagcggacctcttccatcgtaaggataaccccattcttttttttttttttttgagacagggcctctgtctgttggccgggctggagtgcagtggcgccatctcggctcagtgcatgcaacctcccccttctggattcaagcaattctcctgcctcagcctcccaagtagctgaaattacaggcgcacgccacaatgcctggctaatttttgtatttttagtagagacggggtgttgcccaggctggtctcaaactcctgggcacaagtgatccacctgtcttggtctcccaaagtgctggtattacaggtgtgagccaccgcgtccagcctggataaccccgttcttgcctcccagacacaggatgggagtacagtaatgcacacagatgcagaaggaatttcccacttttcttttcaaaatgttttgaaggcacaggtgttgtctatgatgcattattagtagtatacagtacattaatgcatcacttgattattaaaatgtggtagttaacattttacttataaaacagacaaattggttataagcaaattaattatagagaaaagggctttatctaccagatacagtaattatgactcatagagataaagctctcttggaactgcaatgattatgaagccatcttttcttcatattaaaacactgtaatcctttagagtcatggcattgcccatgtcagtctgaaaatagacattaatagttaatatttctccatgtttactttttttttttccctccaatgccgttttgttttttctgggtcttctcaatgctatacttgcagagtactttatctttttttttttttatcatatttttattgaaacagacattaaaaattttcaatgaactttttttttttttttttttttttttttttgagatggagtcttgctctgttgccaggctgaagtgcagtggcacaatcttggctcaccgcaacctctgactctcaggttcaagcgattctcctgcttcagcctcccgagtagctgggattacagacacacaccaccacgcccagataatttttgtatttttagtagagactgggtttcaccatgttggacagnnnnnnnnnnnnnnnnnnnntaatcccagcactttgggaggccaaggtgggcagatcacgagatcaggagttcgagaccatcctggccaacatattgaaaccctgtctctactaaaaatacaaaaatcagccaggcagggtggcgtgtgcctgtagtcccagctactcgggaggctgaggcaggagaatcgcttgaacctgggaggcggaggttgtggtgagctgagattgcgccactgcactccagcctgggcaacagactgagactttgtctcaaaaaaaaaaaaattatacattttacttatttcaataggtttttggggaacagatggtgtttggttatatgaataacttcttttgtagtgatatctgagattttggtgcgcccatcacttgagttttttatttgtttgttttgagacagagtccaccccgtcacccaggctggactacagtggtgcaatctcgggttacttcagccttgacctcttgggctcaagagagcctcctgcaccaccatgcctggctagtttttgtattttttgtagagacggggtctgtccatattgccctggctggtcttgaactcctgggctcaagtgatctgccgcctcggcctcccacagtgctgggattacaggcgtgagccaccacgtccaactcttcatgtttactttaatggatctgccaaagttaggtgcctgtttgatttcctttccctttgtttggcacggttttattaaatgggcttgttctattgctaaactcctctgctgtacatttatcaggttgtgaaaatatttatttcctttatgcagaatctcagcaacaggtgagcaattctgactctgtgtatcatattgtcaccagtgtgtgttctaaaccatcactgaggttgttagcctacatacatgtgactgctacgtgctggtgtgtaaccccagcttagctgtagaatttccaggaatccaaccgtaagttaggagttgggagaaccttttggttatagttattatttcttgtgattaagttgttttttgttattgttcttattgttctctaaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactagtaaggcccctttctcactacctgcctccacttcccaggcaggattaaggcccgtggtcagtgcccctgctttgctgctttgctgctttgcttgtccttgtgctgaatgttgctcacagcttttgctgtgaaagtctttgcaagtaagttttgaaaaatgtaactccagcaagaatgcgttttttgaaatcagaaagtgcttttaatagtccctttcagattcttaaaagcttaaaaatgcatgtgttcttggtgaatctgtataactactgcctagtctaacacaggggtcaaattattttctatgaaattattttaggacaaaatgataggaacattggagagatccttttcttcaagtccatagatctgtctctccctctctctcttttttttattttttcttttgagtcagggtctcactttgtcacccagcctcaacgtcccaggctcaagcagtcctgctgcctcagcctccccagtagttgggactactggtgcacaccaccacgcctggttaatttaatttttttttttttttttttttgtagagagagggacccactgtgttgcccaggctggtctcgaattcttaggctcaagtgatcctcttgccctggacttccaaagtgttgggatttacaggcgtgagccactgctcccagcctctctttctctttgacttcaaataattttaggaagtgaagtgttttgagaaaaggtgtgttaataggattttaatgttaatacaacctgacctactggaagcagttagtgtgtgaagtgtccctgacttgagccagaggacactaaagggaactcttggagctggaagaggatactaggaaagcctgttttgattactctcttctttcctcttcttctcctggtccctttccctctctccctctttttcctgtttagagcagtaaaaatagaatcactagcattaaaataggcaacacctcattctgtttattaaggtgttattttattagggtcaaagccctgcccataagtttattacctagaagtggggcaaatactgtttaagttagaaatggcggcatcagactttcctcagactgagttcaggtctccgctgggtggtggggaaccgcagaccaggagctaggatgttgcgttgtgctgcggggaggaggtggttagcccaggatctcacggtgcctgctcttccattgtcgtcgggcagagaagggacaggtgctgaaatcttcacgtggggctgtgctcctctgccagccatctaggcttccttcctctatgttcaggtagaataagtactgctcagagcatttccatttgcgcataaagaggaagcctgcatcttcaacagaaaaattacttttatgagaaaagcatgacaagaacaatgaaatggagaagagccccaaacccctgtgttcagacagagctttgtttaatgtgggtcagaaactctgatagggacagcttgcctcctttgctgttctaggaacaattccatgggagggtctattctggattaggaattctttcttgagtaatttttattaccttttaattgtgtccatttctttgggaaatagcaagctctccctgctcccgccaatctctcctcttactttttggaccagttcttgtacctcttagctcacctcattcagtgaaaattgacaaaagagacgtgagtttctgtacctgtgagacagcttatttttgtgtctttatggtttctaagccaaaaatcaccataaaatagtatgacaaagatagagaaattgaaagtgtcatttcagttactttgctcagaaatgtatttctgttttagaaaaacaaaaattgaaaaaaatttaattcattctttatttgtttttatttttattttttatttttttgagatggagtcttgctgttgcccaggttagagtgcagtggcacgatctcagcgcactgcaacctcttgtctcccgggttcaagcgattttcctgcctcagcctcccaagtagctgggattataggcacacgccaccatgcccggctaatttttgtatttttagcagagacgaggtttcaccatgttggccaggccagtctcgaacacctgacctcaggtgatctgcccgcctctgcttcccaaagtgctgggattacaggcatgaggcgtgagccaccacacctggccaattcattcttttttttttttttttaaagtcaactatttattgaggaaataccatgtgccagacaatgtaataagcattttacaaagttatttcattttatcttacattttatcaaacaatcctatgaaatatatacccaatttacagatgagaaaactgaggctcaactgaagtcaggtagctcactgaaggtaaaatagctaagaagtgatggagctaagacttgtatacagaaactggaccttaagtcattatgccatactgcccccttccatatctaactcaatatttcaacaagtggtttttttttttcttttttctttttttttttttaattgttcattcttgggtgtttctcgcagagggggatttggcagggtcataggacaatagtggagggaaggtcagcagataaacaagtaaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagagcaaaatgaaaagtctcccatgtctacctctttctacacagacatggcaaccattcgatttctcaatcttttccccacctttcccccctttctattccacaaaaccgccattgtcatcatggcccgttctcaatgagctgttgggtacacctcccagacggggtggtggccgggcagaggggctcctcacttcccagtaggggcggccgagcagaggcgcccctcacctcccaagcggggcggctggccgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgttttaacattgttctttatcactttcatcatctatcttccaggaaagctgttgagaataacctattaaaatagagaaagctttttaacataaggttttagagtaacgcccacccaccatggtgacccacagctctttggagaagtatcactgggtctgtatctgggtcagaaatagtccatttaccgacattcttgccttccccagcatgtcctggaattggaagccaaaatggaccagctgcgaacaatggtggaagctgctgacagggagaaggtggagcttctcaaccagcttgaagaggagaaaaggtgaccccagactgtttcctggtgcaagtgtggcctttccccctttttttttgtttttgagacagagtctagctctgttgcccaggctgcagtgcagtggtgcaatctcagctcactacaacctctgcctcccaggttcaagcaattctcctgcctcagcctcccaagtagctgggaccacaggaatgtgccaccacgcctggctaattttttgtattttagtagagatggagtttcaccatgttgcctaggctggtctcgaactcctgagctcaggagatccatctgcctcagcctcccaaagtgctgggattacaggtgtgagccactcgcgcccagcagccttttcattttcaatgacctcagaagaaaatttcctattaataatcatgttggtatcaacccttagaaccaaaggaatgactatgtgtccagcagaaggtgaactctgccatactgtgtgaagagcgtctgctttgatttgacttttttcaataagtttggagtcatttagacatggcctgattgggcgcagtgactcacgcctgtaatcccagcactttgggaggctgaggcgggtggatcacttgaggtcagaagttcgagaccaacgtgaccaacatggtgaaaccccgtctctactaaaaatacaaaaattagccaggcctgttggcgggcgcctgtaatcccagctacttgggaggctgaggcaggagaattgcttgaacccgggtggcagaggtggcagtgagccgagatcgcgccactgcactccagtctgggtgacagagcaagactccgtctcaaaaaaaaaaaagaaaacattatttattatcttttgagacagggtctcactctgtcactcaggctggagtgcactggtgtgatcatggctcactgcagctgtgacatccctggctcaagtgatcctcctaccccagcttcccaagtagctaggacacaggcacatgccaacatgcctggctaatttttgtagagatggggttttgccatattgaccaggctggtctcaaactgaactcaagcagtctgtccaccttagcttcacaaaatgctaggattacaggtggcttattttattttttctttttgagacaaggtctcactcagttgtgcagcctggagtgcagtcatacgatcataactcactgcagccttgactacctgggctcaagcaatcctcccacctcagctgcccaagtagttgacacgggtgcatgctgccacacctggctaatttcttaattttttggtggagatgaggtctcgtcatgttgctcaggccgctcttaaactcctggctttaagccattctcccaccttgccctcccaaagtgcaaagatgcatttttaaacttgctatgtctctaaggcatttctggtggctgtctgcttgaattcaccagggtagtgattatagatttttttttttttttttaaatataaggactgggtctcactatgttgccccagctggtctcaaactcctggcctcaagcgatcctcctgcctccacctcccaaattgctgggattataggagtggcctaccatgcccaacgtgtttttttgtttgtttgttttgtttttttaaaggctgtgtgttacttagtttcttaagtgttttgtttgggttttattccacaggaaggttgaggaccttcagttccgggttgaagaagaatcaattaccaaaggtgatcttgaggtaaaacccctccagctctcttacagcttttatgggtatcagtattcagaacacgggcgaaataatgcaccaattgaaatgagcggccagaacagccagctgaggaagtggcgggggaaggttctgggggtggctttgtggtgacggtgccggtacttgagcctgtgagtgtgtggcccacttcctagcagagtggaacttgcactacttctttctcatgcttcaaaatgcaaaaccatgaattggatctcatcaagtcataaatctggcagtgtgtcctcaatttaaagcagtcctaagtgagacttaatggtgttcgtctgatgattagaaaaggcattttaaattttgtcatagtagtccataacaggccgggtgcggtggttcacgcctgtaatcccagcactttgggaggccgaggtaggtggatcacccgaggtcaggagttcgaaaccagcctggctaacgtggtgagaccccgtctctactaaaaatacaaaattagccgggcgtggtggcgggtgcctgtaatcccagctacttgggaggctgaggcaggagaatcgcttgaacccaggaggtggaggttgcagtgagccgagatcgtgccactgcactccagcttgggggatgggtcgagactttgtctccaaaaaaaaaaaaaaaaagtccacaacaaagttttttgctttatctcggctttgctttccagttgagcaggataaatccttttataaccctataaaaggaatatgttgtaattgttaatttttttaaaaaagtaattagcagagcaaaaactaagaacactttatatttcaacttcttttactttcatggcatttgtagaattcatggattttcctttagtgtcaggtttctcatccctttttaacaatttattcattagtttttaaattagacaccagaattaaatggttttgatggtttcaagccattgctagatatatgacaaatgtaaatcattcagtttttcaaattttccagatttgtagttctttaatctacaatattttagtaaaaattgcacttaactgtgcgtttcccaaatatgcagttttgctacaattttagagtctgctggctgcccacaccatgcttaaatttgaggggcccttccaaacagcaactctgatttctttgaaaataaatgtatctttacagttaacaaagagcaaggggggcattttctgggttctagttttatggggcccagaatttaatggttcattaacaatttaatagatatcttcttcactcatttcatatacagccacattcctttagtcaatttttgtgttgttctcatccatttaaaaacaccccaaagtctcattagaagtttcatgtcatcatctaattcatgtgaaatatagcccatggtgtcttcaggagggtccagttaaaataatttacatcagcactgggttgtatagtctgtctgataaacttacttgaaattaatcaaataaagttatcttgaaaccctaacacatattgaagctttattggaatctcttttttgttgttgtttaattttttttatttttttactgatagcaaaagagccagatttctgaagatcctgagaatgtaagagggcacttaactgtgtggatatttcccttgttaacaaagattgatcacagattaaaatgcttattgatatactcaaacactaactgcataatctgaccttgggacattgaccttaatgtttctgtgcatgtggctttcaaagcaattacatttatatcctgaagaaattgtatgtaatgactaagctccacacattcatgtgtttaatgaataggccaacgtttgctttataaagaattttgccagaaaggggggaaaaatgttttttgtctggagacctggccttcttcacctaattcataatgtcttctaattttagtggaattattccaaaagagatgatatctggctggagcataaggcattctagatgtggagttgtgggaattctggggaagtttccaagttgtctaattttgcttcccatgagaggaaaggggattgtgaggctggctgctgtcccggagctgactggctgccttttcagtgtgcccccgccactgg

SEQ ID NO: 119 - DNA, 1380 bp, Homo sapiens
gccccgattctacagacaccatgagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactagtaaggcccctttctcactacctgcctccacttcccaggcaggattaaggcccgtggtcagtgcccctgctttgctgctttgctgctttgcttgtccttgtgctgaatgttgctcacagcttttgctgtgaaagtctttgcaagtaagttttgaaaaatgtaactccagcaagaatgcgttttttgaaatcagaaagtgcttttaatagtccctttcagattcttaaaagcttaaaaatgcatg

SEQ ID NO: 120 - protein, 354 aa, Homo sapiens
HTKKMSMLKPSGLKAPTKILKPGSTALKTPTAVVAPVEKTISSEKASSTPSSETQEEFVDDFRVGERVWVNGNKPGFIQFLGETQFAPGQWAGIVLDEPIGKNDGSVAGVRYFQCEPLKGIFTRPSKLTRKVQAEDEANGLQTTPASRATSPLCTSTASMVSSSPSTPSNIPQKPSQPAAKEPSATPPISNLTKTASESISNLSEAGSIKKGERELKIGDRVLVGGTKAGVVRFLGETDFAKGEWCGVELDEPLGKNDGAVAGTRYFQCQPKYGLFAPVHKVTKIGFPSTTPAKAKANAVRRVMATTSASLKRSPSASSLSSMSSVASSVSSRPSRTGLVRPLSHYLPPLPRQD

SEQ ID NO: 121 - DNA, 28729 bp, Mus musculus
  misc_feature (1)...(28729): n = A,T,C or G
gtctacagagtgagttccaggacagccagggctacacagagaaaccctgtctcaaaaaacctaaaaaaaaaaaaaaaaaaaaaaaaccttacctggcttagccaacagactgtgcgaccttcagtttgaaacacagcaggagatggctcgagataagatcttgactagtagtgtaaatcagacccaccttggacggagcagcctgccaggttcggcctccagagctctgctggtgaccctgatctggcccaaatatttgcactccacatcttttagaggtgccgctgctgctccagccaggcaaccctttgagatagttttgttaggcagcacaggctggcttggacctcactaaatgtatatagcctaggctgggttccagcttgggcttgcgatcgcatggcacatccagctttctcgtggactattttgagccagcctgctcccttcggtctgctttatggaatagctaagagtgggtgatggttgttagcaagcacaagaggaaaagatgatctcagattttcaaggaggtccctggtggccgtgtcaggttatctttgagcatctggaacgctttcctcctaaagtctagcttatacagtttaaacagagggtggcacgttgaaagcgctaagcaaagagacacttgtgctcagccgtggttgaacaacctgcctcttggatcctggttccacagttcacaaaaccttcccagccttgtgaaaacacttcttctggaggctatgaaaggcaccatttacttggtgatttcaagtttctgttttcctaggggggaatggtaggtcagccgtgactacccagtaggtggagctccctctggttctagtggggtcctgctggagttctctggccatccctggctttccagctttacctagagagcttccctggcactacagctagcctgcttcctagataggcttgtgggactctcggtctgcacactggtcatcctgggtagtcttggctcccttgagcccctcaccagccttgttccctaagctagcagccagctcagctgggcgctcctcagctaagagcagtgtgttaagtgggcacagagcctcctctgttccagtaacaatggccccttgatggctagctcgggtcccctcactcctattggactttggagagaagaaaggatgacggccctgcccccaccccaggcagtcaatgctgggtgtgaggttaatgcagaggctttagtctctgtctgcccacaagaccactttcttctttattctcggtctctgacacacacacccctccctttccatcccagggacccctttcgggggttccaggaatggttcagttcactcaccccaacaagtatccattgaacagacccctgggccccgaaggttgctgctaaataggtgtaggataatagctaccccttggatttagtgcttttacaattagcctgctttggtagccccacaggctccagagagttaatgccaacacttcttcacagtggaccttcagagcactgatagttttaggtgttatcagctgagattcccacccccactccaccggagacagggtttctctgtgtagccctggccgtcctggcactcactctgtagaccaggctggcctcgaactcagaaatctgcctgcctcttcaactgggatccttattctcagtttggattaaacatccctgggcctcctgactgacataacattaaccgagtcaccatggtaccccacttaaagagccgtgtgtttgtagaagacaaaatatgaaatcctcaacctcacagatttatgtcctctgtggatgtgttatcttacatggtaggaaaagttttattgatgtctttaaggaattaggggtgacagagtgccctgaattagctgcgtgaccccagttagaatcgcaagggtccttataaaagggagacagaaggagacttagctgcacaaggcactcagagctacacaccaaactcaggtattttgagtgctaagcaagcactgtcagctctgctcatgtggagctccggagttggttctgaatgaatactacacctacagtattaggagtttcccaaacacttggtcctaggtaacacagggaacacacacctattctttctagcttccgtatttggtgaactggagacatcatggtgcttgcttataatcccagcgtgggagaagctgtggcagaaagacttctgggagttcagctctggacttaatagtaagaccctgaatcaaaagggaaagattagtgtggccttgctagtaagctggtgtgtagcaggcaggagccggcagcttttgtcatctcctggatatcctgtgctagtggggtttgatgcacctagatagcatctaatggcacgttggcagtcctgatgtccaagtatcattctgatgcccctaaatagtcggaatctcaggaggtggaacttggccatcaggagttcctttaagcttccaagatgctgttagggttgaaacccagaactccagagcaggctctgtgcatttgtacgtgatgcttctcctctacctgtgcagacatcaccaatcaattgcaatttccttcatccccgtgcgatgtacccgttccaaattcagcactgcaggaaacctttcccaaccagtcagcctcagagaggagttgaaattaacttgtcctcctaactgagaagatttaaactgtctagctggggccatgtgtatgtttagctgtatctgaaccaaataatggtagaaataatgatatcaagccgaccagaaatagagactgccacggttatataaggattgtttggactggttaagaatagccagcgtgagtcagctagcatccctgtcctgcagtaaattgccgcccagctgagaaaactacacggaagaatgcaagccagtggtgccacaggacagacagaccttggctgacgtttgtctagaccagcaataacaaccagctggacacaggctgctctgcatgggcaaccttgtgcaccctttgctggaattcagggtcaccacttttttttttttcctgcttgtctcactcagtgcagagacaaaatatctgacagaagcaacctaaggaagcgggaggttgtcagtacttacaactccagcgacagtctgtcctagcagggaaggcgctgcggcagcaggagcaggagatggtcggtcacattgtacctgcagtcaagaagcagaaagcagagaatgtacttaactctctctctctctctctctctctctctctctctctctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccttgtctccccttccccccttttaattaagactaggtcttactatgtagccccagctctctcagaagtcattatgtagaccaggctagcttcaaattcacagagctccttcagtctctgcctcctcctgagtatctggggttgaagctgtgagccaccatgcctgggtgctttctccttgttatttagtcaggatccccacggaatggttctaccagtgcccagggtaggacttcccacctcagttggcacaatctaaaaatcctgtactgatgcggtgactcgaaatcccatccagttgtcaatcagaattaacctcaaaatccgataacggagctgtgcctatggaggtgaagaacaggaaaaaggagggcggtgtccacaggaagaacagcctatgccatcctccttccatgagtctcccaagcctgtgcatcacccatatagccattgtataagcacatttctggttgaaaggttctaatgaagaaaactgtgaaaagttccaagaccaacaaagtgtgacattagagagggcagtgaggtatctgtgagattttcacagtcgccagctgcttccaaccatatacatcctctccctgccccctccttgagacaggctgtctctgtgtagctctggttgtcctcaaacttactccacagatcagtagaccaggctggccttgaacccagcgatctctctgcctttgtctcctgcgtgctgggatgtgccgctaccaccactgggccacatgtatccttattgtcacccatatgagagtggttgcaagctgactcttagacttggaattgctgtgccagagagtatcttagtctgttggagcagctaacatagtgccattgcctgggagatttactaataacagaaagctgtcaaacacggttctggaggtaggaaaatttaaaaccaacgttctagcacattcggtgtgtaatagatggcttgttctctacacccaagatggaaccttcatgccatgtccttacacggtggaaggaatgactaagttccctcacacctcatttacaaggacactaattctattcacgaggactctaccctcttgacctaccgctccagtcacttgctgaaggtgtcacctctaacaccagcactttaatgtaaattcaactttaacgtaagcactttggaggggtgccagcatttaagcagaagcaaagactgtgtacattggaacctgtggcagtcaagagcagcctgaactgtacagtaacacactgtctcaagaagtaatagggttggggatgtagctcagttgtagaatgcttgcctagcatgcgtggagccctggaatcaacacccggtgtgggggtttcaatgagtatggcccttcataggctcttctatttggatgccttctctacagttggtgaaactatttaggaagggttaggaggtgtggccttgttggagggggtgtgtcattcccaggtagactcttcctctctggctctaacttttagatgaagtataagcacatgaactgataaaatcaggtatggtgcctcatacctggaatcccagaacttaggagatggaggccagagggccagaagttcaaggtcatccttagctccatttctggttttaagccagcctgggatacatgtatgaaatactgaataaacaacaacaaccttaatgtaaattatgacgttttgaccaaataatcctgcaaaaaggattattatctcagcattgtgagaggattcttcatttttctttttcttttcttttttttttttttttttcaagatgggctttctctgtgtagccctggctgtcctggaacttactttgtagaacgggttatcctaaatctcacagagacctgcctgcctctgtctctgcagtgcggagatgaaaggtgtttgtcaccacacccatctgagacgatcctttgtgttacccaggagagggacaggctctgctgctgaaacaatcagaccccaaatctgagtcccttttcacagcaaaagttggttttgtttgtttgtttgtttgtttgtttgttttttgagacagagtttctctgtgtagccctggctgtcctgaactcactttgtagaccaggctggcctcaaactcagaaatttacctgcctctgcctcccgagtgttgggattaaaggagtgcaccaccatgtccggcaaaagttgttttttttctcacatgtcccatttggttctcccatagccgcacaaatccagatgcttccatcttgagctaagcccatcagaaccgcagctgcccattcggcacagcccctggggaatgtgtggaaactttttaaggaccaggccttgaagtggttcatcactttctcccacatcccacagaccagaactggtcacatggttatcatttcattgccaacaaggcagggccgtggggagtggcacacgggcactcggggaacactgtagctgtgttccctggaacttccatcccagaacaaattccaggatgtcttgttctttgctgaccttgtgaagaaatgtcatggagagttgtgatggccgtccttggttgtcaacttcaccacatctggaataattaactaaaacccaagcaagtgggtactcctgtgagagatttgtcttaaatcatttgaagtgggtagaccaactttaatctggatcttttgaggtggggaaaatccgccatactatctggcgggaacctatgtaaaggacatggaaaaaagacggtttttgtttgtttgtttgtttgtttgttttgtttttaatttgcctgcttgctctcattctcaccaacaaggctgtgtcttcactgtcattagagcccacttcttcaggattctggtgtgtactagacatccagccttgtggactgaacaactactgggttctaggagttttcctcggtaggtagctattgttgggctagctggaccacagcctgactaatacaaatgaggcgccaattcaccctcctgcgctttctcaagcagctgcaagccctgttctctgccataacatccagagcagatcatgttcacttaccccagtggctttgcccacagatgtccccaaacccaaatatccattcgtgggaaagcctcaagactttttaaaaaatgttggctgctattcataaaagcatacaaaggcatgtgagcagcaatataaaattagacgtgtcaagatcttcgccagctgcactgtggccggacttggcagcagtcgtccctgatgttccgtgtcactgtctccttccaccgcctctctccttcagggacacataggccaagtgaggagaagaggcagaggatgataaggggcgggaagaaaagggaacctctccccccgccccccgtgttctgtctcaactttggcaaacatctgggcttgaagcattcttaacctcgaggttcgtctgactgtgaagaccttatgggtttgaaggcttggggctggtgtgctggctgtatgctcttgcatggcaactttgcactcaggagccagaggacagttgggatttggtctgctgtcacagcatggtgtctcccggcaaggtgccaaactaaaggatgggaaacatttgtgtgcacaccagaaggagtcatctgaggccgggagagcaggtgggttcagccttccaggtcacctttagtggactagctctctgcacccagatgacagcatccaagagcaagaagctcaactcgtacatagcaccactactctccctctgtgtctctatctgtgggatcaatgatacaccatgtttgctttaatataccatctcaccacgtggctagcccaagttggccttaaatgatcagaaatcttcctgcctcagactctcaggtgctgggacttgagatgacattcgctatgactctttagtaaaacaaaacaacagcaacaacaacaacaaaaaaaaaccctgtaattgtggccacttgtgtgccctcgggtctttttggttcagtgccctaacctgagcatcttccattgagctttatgttgatagtctctttttaggagagtataaatcaagccttttaaaaacaaaacaaaaataaataaataaataacaccaaaacctgggggtttgggggacgacccatcaccccatgcagcccagaccggatgactttgagtttctagtcctcctgtctccacttcccaagtgctggaattgcagctgtgtatggccacatctggttttatgagatgccaggggtagaacccaggccttgatgcacactaggcaccatgccaactgagctacagtcccaggtccaaggcaggcatctatgggcgcccgatcctcagacagtgctggggaggacagatggaaaccaggagccagagctggctttctgtacagaatggaagtccgttcatatattccacagagatttattgagcccagccacttgccaggagccgtgcttgctgctgtgggactccagaggacacggccaccatctgagaaggaccaggggtcctcccgggctcctgtgtttttcttatccttttgcccataggagtttatagtaaaacacaaaatagtgtgacctaaagctcagcacctggggggcatgcgcagaagagatggctcagtagttaagcaccggctgttcttgagaggatgtgggttcagtcttattacccacacagcaactccagtccagggaatcagacactctcttcctacctccgcagctatcaggcatgtacccagtgcacatacatacacatggaagcaaagtgtgcaagcaaaacattcatacacataaatgaaataaaatagatacatcttttagtacgagtaaccaccacttcaaatggccagtttcctggcattaaatacagtcaccgccgtctgtcttcagaatcgcttttatctttccaggctaatgctctgtacatagacgcgtgatcctcctgtctcagcctcttgggtagcaaatactacaaatgtcactactgcaccttgcaactgtttcctttgtttggttaggttttttttcttagtttgttttttttttaataaagtcttcggtgtcccaggacagcatcaaattcactgcgtagcctgaggacagtcttaagcctttcgtcctcttaccggccttctccttctgagcattacaatagcaggtgtgtgctatgatgcccagtcatacagggtgctctgggtggaaccagggcttcatgcctgtcagacaagcactacccactgagctacacttccaacccaatctctgcatttctcttagcactcctaggatcccaggcaggcatgtggttgtccaaatactcgctccacagaaaggtatgtgaactgtcacagcgtttctgtagctgcctcagcgttttttgagccccgtgggtgggggtggggtcagttccctctagtgggacatttcattgctttgcctggccagtgtccaggtcagttttgaatggagcagattgttctccaggctgcctgctctgtgtggctgaaggcagccaggacaccagtcaccatatggtgctggctagctaatcagaggctaactagggtactaggcctagtggggcctggcaggggacttgcatttcaagtaactgtccactggaggtagataaagagtgctccccatgtctgtgtgcaggcatgaaaggctgagaggtgccttgggctggttttgccagggttatcctatagctccatcagggtagctctcagctccatagtccaccacggcttgggcccatattccttataagtacatgcgaccgtttgccttggactgcttctgtgttggctgtagctggacacacacaagaagttgtagatgggctcattcattttgtttgtcgtgtgtatgcacgtacatgtgtgtgtgtgtgcatgtgtacatgtgtgtgcatgtgcgtgagtgtgcacgtgaatgtgcgcgtgtgtgtgcgtgcctgtgtgtgtgtgtgtgtgtgtgtgtgtgtgtcggggcacgtacttggcctcctggtcatcttgcctttacttcccaagttctggaattacaggcatgatgcactgtgcctcgggaaatgtgtttattttagagaagaaagctggagccccaggatgctaggttgctgaggtgctgggatgtcggtttaccgcacgcacggaatgctggatgctgggatgcttcagtaccgtgataatgaccggtaatagccagacctgccctgttcctcttctcctttcactttgctgtcagcatcctctgagcataagctgtcctgtcagaactccatgataatggggnnnnnnnnnnnnnnnnnnnncccccggccatctctagacgcttccatgtgaaatagggtctagcctgaacaggtcagggcatggacaaacccaacttaacagaaacaaagaacttcagtgtttctttttctcatcctgattgaaagaagtggcagagtctcagccaacacccctcccctctactctctagggattcaggaaccccggctccctgcttcctactgggtgacacagagggatcagccctctggcctcacaactttcccacagcagccagatcttccctctgcctgtggagccccgtggagccgcgttttttctacttggaaagctgtatatacaggtatgtaacagctgaggctgtttcctgctatgctctgggtcccagcgagaggggagtggaggcttggtgcctgatgcaatgcctggcaaggccccgccccttatcggagcttccctcccgtccttgcagggacccctccagaaggacggaggcggggctggactgcaatccctcaggggcctcagtggaagagcccagctggaggctatccaaacgtgaaaccaattctccagtgaggcagtttgccaagtcagggggagaggcctgtgctgaggaaagacccctgggcagggaggagggaaggggagctggtgccctgcttggcaaggctcatccacctcggcttcctccctccctctctgaaccaccagttgcctgggggctttcccacgcctccccctcctgagcacacagctgttaggagcttgagctgaaagtccccaagaattgagaattcattttgcccgtagtccatctatcccgcatcctagcccacgcccactgcaggtgcccagggcgtctctccctgatggctcactcatgcaccagtgaatattctcctctcccctgacactgcctagcaacctagaatgcctaagcatcttgctctgggttaggtattctgggaagggcatccatccatccatccatccatccatctatctgtccgtctgtccatccgttcatacatcctttattcaaggtcaccacttcagcaacatccactaggttaaaactgggatgttgattgcaccccagaaaaatcgtttcagaataggtctgtgtggaacagaactaggcttattatgagagaaaccacgggagcacacacgggagtctaagcaaggacagtcagagagagagagactaggttcagtgtcttatcagaaacatatgatttcatgactttatgctatagtatccaaaggatgtaattttcttttccttccttccttccttccttcctctcttcttcttcttcttcttcttcttcttcttcttcttcttcttcttcttcttcttcttcttctctctctctctctctctctctctctctctctctctctctctctctctttttctttctttcttggctttttgaaacagggtttctctgtgtagtcctgactattctggcattagctcagtagatcaggctgaccatgaactcagagatccacctgtttctctgcttcctgaatgctgggattaaaaatatgtgccaccatgcctggctttttttttttaagatttacttatttatttgtttgtttgtttatttaatgtgagtacactgttgctctcttcagacacaccaaaagaggttatcagaccccattacagatggttgtgagctaccatgtggttgctgagaattgaactcaggactgctggaagaacagtcagtgctcttaactatagagccatctctccagtctgcttggcttttttttttttaattttaaacaattttaatttgtttaatgaaatgaattgtaaggtgttctgtggtggtcaggagtgtggataagttacaaaggtctacagccgtgttctttagcaagcatggctcatttgttgtttataacacctttgagatatcttagaaaaatgggtcttgcccctggagcaatctgtactgattttatcagttgggtgaatgaagaacctaaattagatcgcgtgggggaggggccttttccacttctcacatccccttgactttcctgtctctctatccagtctcacctgttacacaaaatcattgacccagtggaaaagaacgtttgcatccaggaaaataagcatatgaaaaagagaaagtgatggaggggctcagggaaggacttggagctctggatgctaagtcagcacaggaggaatagggatttttttggcttctctgggctctattgaaagaagaagaatggtcttgggcacatgttaaatagaacgaactccagtgctgagaccagaaaggatgcgcccccgggtggggaatagtgggaagggctggggtcagatggtgcccataaaggctgggaatgaggtgtggctcccatccccagggccttggagggcttgtgttctgctctgagttgtgcacgaagggttttcagcagctagagtcacccggagtactgggctgggtgtctaagacgctctcgacatcaggaccgcgttcgcgtatctgagttaaggtgctcgtaggcgcccccgtgtgttggagacggggagagtttgggagaggaatgtggacggaatgcgaaccagaagactcagctgtgctgatggaccagaagagaggagtgagatgcgtgaaaaggaggccaccatcgcctaagaagagtgagggaagagcgcacccccagggaatcccagaggaagctttagtagagaacggccagagcgcaggagaggaagagggaggggcacaccatgcagtccccaggttgaaatgtagcaagggccaccctctcacagaaggtgactgaggactcccccagggtgtttttaagggaaaaaaggatattgcagaacgagaggactgagacacaaaggccagagagaaatatgaggcaggaggatgatcctcttgagaactgtgcggctgattactatgagtggcttatgagaatgtttcccagcttatacccactgccacctcccagacggcaaggctggatgctgctccctcttgtggctcccaacatcgctagggccagacgcacagtggccctcaccaaatagaagtgtccatggagaacctcagcccggccgacatcttcttttactgctcctggtgtttgtacccagcaggctgtgcccaggcagagctgggttgggcatgaggtcctggcatctttcagcactgacaaggacatgttagcaggctggcctttagtggcaccttggcagtggggctggggagttgagagccatggagtagaggatgctgggaaggccatcaagggaagaggcagcagggatttccagccaggcaaggatctcaggaccagcatgtgcttgccaaccctggaagagaagtagcatgaagtttcaaccatgttatagcccacttcttacacagggcgtcctgcagggcaagctctgccacagtctctgcccagtgagtcccattccggggccctcttcgcctttcttggccctgtgaactcctggctttggggtcctcacgcattcctccctctcctggatagtcacctggccttgggcctctcaaggctgcagaggggacatccaaccagggatgggtgacagagctgccagtctgctcacgccataccagtattcagtcttccttcttcctggcagtgcttgggaaccctgcatttctgtgagggagaggaggctgggttaatgacttcaaaatataaagccactggaagaggtggggaagggaagatgggaaagcttgtcatcagaggagcccaactcccaaacctgactgtgtgcctgggatcgagcttggggctccagatgctaggtattcactgtgataccgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccccaccctacccccgctgcccctgctctactcaaggttccccctctccccttactcctctccctcccatcttcttcataatgaatgcttaccaagttccagatgctaggcacgtgctctgccactaagccatgattgccaaccccctttgatgtctttgtataacctagagattctggaaatacaagaccaataagcttgcccagcacagcatactgtgtcttgtgtagctaagggtaggtagccatgaacttctgagccacagtctcagccctgttatgcttttgtatggcgggtcgcccagcaggctactttacactagtatcattgcaacatgtgacactggtagctgtgatgtcattatcgaaccaggattctgcagctccatggcaccatcttaacagcagggaccagtgatgacgtacactttccattatctaaatactatgtgtgatgtgtgatggtgcatgcctttaacctgtgaggtcaacagagaaactccaggaaatgagagtagataaaagggcattcattcatttactcattcatgcatcaggtctcagtctagcccagcagaactctgtagctcaaactagcattgaatttaaaaatagattcccgcctcattttttttttttttttttttttttttttttttttttttggggctagggttacaggtctgtaatgtcatgtcctggctccttgctagcatttgggtgttttattgctgtttgtcgagtacagtttttgctaccctgctttacctgagcaggttcttccagatgcatgcatgaaacacacacacacacacacacacaccacacacacactaatttattttcaacctgccttattgactcaattgctaggctcttctaatctcccatagctagtgtgcccttcccaatactcttagctcagcatctcttaatctgcccttaatttagctgcatttttaatcttctgcctggggaagtggcctatggccactccgcccgagatctcacatggctggtcaccttttctccctctgaagcatggcgagatctcttttcctctttctgcatctcttagcctgcctgtggggacctgaaagtcctgctttttttccttctgcccagcaattggcccctggcatctttatttatcaatcaagaaccaattggggaacatgaccttagcagcagcaccactccctgcagctgtttattttgtttatttgtttgtttgtttttaagggaaagcaagaaaagtttattggatagagtaacagctactggaagtaatacttgtttatcataggacttttaaaaaatatttatttcatgcgtgtgaccattctgcctgcttgtatgtctgtgggcatcacatgcatgcagtagctgtagagacaaagaaggcaccggattccttagaaatggagttatcgatggctgtgaactgctgttcgggtgctgggaactaaacctgggtcttctgcaagagcattgagttttgttttgttttgtttgtttgtttttcgagacagggtttctctgtgtagccctggctgtcctggaactcactctgtagaccaggctggcctcgaactcagaaatccgcctgcctctccctcccgagtgctgggattaaaggtgtgcgccaccacgcccggctacattgagtattcttagccactgaaccatctctccagcctctgttttggggtgtttgtttgagacagaatcaaaaggctggtctaaagtacatattgtagctaaagatggcttccaactcctgccttgcctccagagtgttagggtgtgacctttaaatgacctattaaagaaaccccaacaggtgtagagtacacctgtgatcccagctcttaggaggttggacagatggataaagaggtccaggtgtcccggactacatagagagaccctatctcaaaagagaggcgaagacttaggttttgagagtgggcctgaggtctctcttcaaaagttttatagaaagatgtctctgttccctgtctatgaacacggatggcctgagcacctgtctcttcacaggatcagagtgtcccccacctgaagagggctgattgggtcccaagctatgctcctgagctgagtgcctgcagccagtctgaggaactccatggcgccccctctccccatggagaaaggactcgctttgcctcaggatttccgggaccttgtacacagcctaaagattcgaggcagatacgtcttgttcctggcatttgtggtcatagtttttatcttcattgaaaaggaaaataaaatcatatccaggtaaggaactcaaccacaggtcccctttatccaaggtgaggtcagaggtgacactagggtttttgggggaatcaagaagtgcatcccttctacaagcggccgtcagacagcccctgtgtcttaggctgaggtcatgtgcacagggtgcagactttggcagcccaggctggcacccccatactggcccttctcaactgcaagcgcttaggcaaaacacatccctttgttgaggtgggcctttctaaccagtgactagcagtgggcctgtcttgaggaaaaggttaatgtggggggctggagagatggctcagtggttaagagcactgactgctcttccaaaggtcctgagttcaattcccagcaaccacacggtggctcacaaccatctgtaatgggatctgatgccctcttttggtgtgtctgaagacagctacagtgtactcgtatagataaaataaataaataaataaatctttttttaaaagagagagagaaggtaaatgcggaaatgtaaaccacattttgcccatggcctgccacatggctgaagcttggtacttgctggcatgactatttcaccttctgtcctagcgccccttagcagtacttcccctttgcaagtcttgatgtcatgagtggaggtgagcccatgggaagcaaggttctggtatggccactctggtgggtgggaccatcatgggtaggtacccagatggtttatctttcaactctaagggagtgagcctcaggtaggctacatactccttgagttggcagggtactgctgtgtggggtggacctgctagacacagaaccatttttcaactcagatctcccagatgcatagccccacataacatcctcagccaaagagggtaggttaaggactgccaacgaatcagctcatgcctgcttcacaccatgtaactctcctgaaagttgctactgacttgctccaaaccagccagaagtgtcagagggtaaagtgcccgagttctttagtgaaggtgagcctctgtgtagccatcactagtcacttagcttctcaccctgaatcactcctgggttcttgccaaagaaaccacactcgaaccttagcctctagacccagctaagactgcttatcctagtacaggagatggcctcccaaatcagtcaccgaccttgtcctttgtaaatcccctcccagggtctccgacaagctgaagcagatccctcattttgtggcagatgccaacagcactgacccagccctgctcttatcggagaatgcatctctcttgtccctgagcgagttggattccaccttttcccatctgcggagccgcctgcacaacctgagcctgcagctgggcgtggagccagcaatggagagccaggaggctggggcagagaagccatcccagcaggctggagcagggacccggcgccacgtgcttctcatggccaccacccgcacgggttcctcgttcgtgggcgagttcttcaaccagcagggcaatatcttctacctcttcgagccactgtggcacatcgagcgcaccgtgttcttccagcagcgaggcgccagcgcggctggttcagccttggtctaccgtgatgtcctcaagcagttgttgctatgcgacctgtatgtgctggagcccttcatcagccctccgcccgaggaccacttgactcagttcctgttccgccggggatccagccgttcactctgcgaggatccggtgtgcacacccttcgtcaagaaggtctttgagaagtaccactgcaggaaccgtcgctgcgggccactcaacgtgaccttggcgggcgaggcctgccgccgcaaggaccacgtggccctcaaggctgtgcgcatccgtcagctggagttcctgcagccgctagttgaggacccgaggttggatctacgagtcattcagctggtgcgcgacccccgggccgtgctggcttcacgcatagtggcctttgcgggcaagtatgagaactggaagaagtggctgtccgaggggcaggaccagctgagcgaggatgaggtgcagcgattgcggggcaactgtgagagcatccgcctgtctgcagagctgggcttgcggcagccagcctggctgcgcggtcgttacatgctggtgcgctatgaggatgtggcacgcaggccactgcagaaggcccgagagatgtacagctttgcgggcatccccttgaccccgcaggtggaggactggatccagaagaacacgcaggcgacacgcgacagcagcgatgtctactccactcagaaaaactcttctgagcagtttgagaagtggcgcttcagcatgcctttcaagctggcacaggtggtacaggctgcctgtggcccgaccatgcacctctttggctacaagttggccagggatgccgcctcactcaccaaccgctccatcagcctgctggaggagcggggcaccttctgggtcacgtagtgggggatgtctgggacccttggaactccttcttgtgaaaggctggccctgcttccctcacacccagcctggcagtgagacatagccctggcagaaagtcaaaatggggagcgatgatgggaacatagcccctggctgtagcggtagggccccctgccagctagactccccagagcagctacagctagggccttgggctcctctgaggacaccctgtctccttagtggtactggtcataaggtgtcctcaccctatgacctgcagtgtcccgagcaggtcaaggtaggttcctgtgtgtggacacacctccctagctctttctcacacagtctacacgaagcctgtaaaggcctgtaggttgtgtgggctggagtccaagtatttaacaaccagaaggggtgtagaccctctgcagcctctcagacctcctactgtattaagtgttaacctcttccgctctgagtcagagaagctgggatctggctgagtcctgggaaggaggaggacagcctagggtgaggaaggggacctttgaagctcctcagggaacagtggctgtgtaccagctcatagaaaatggtttgatcagctgttctagtcactcatgagtatcaatcagcctgtgtagagcaagacacacaaagtgcattgaaaacagacaaggccaggggtgtggctcagcggtaaagcccttgcctctctcatgcccagggccctaggtgtgattcttagcactataaatataagggaaaataagccatacatacgtgtgcagtacagagagagacagaaaagcgtaataaacattcccccctctcataagcacacgctctgcctctgtctctgtctctgtctctctctgtctctgtctctctctgtctctctctctcactctctctctctctctctctctctcacacacacacacacacacacacacacaaacacacacacacacactggtacagaaaagcttcccttctccactctttatgctcaccatgtttttaggatttttgtttgtttgttttgttttgggtttctatatatctaaacaaggagccttaaattacatctttttgggattacgtggcgagggggagcagcagggagcatttgcttctggtaaaaggatagaccagaaaggacttccccttggatgatcggagtcatgcagagcccccagggtcccacatgttctgtgtgaacttcatgtggaatgactcacagaagtgactaccttaggcgctcgctctgtagctcaatgtgcgtagagtttgtctattgtataggaagccctgggttctgtgccctgccccacaccatataggtatgatggcgtgtacccatatcccagcattcaggaaatcaaaggttggcggtcaaaagttcaaggtgcagctatgtatcttttgagatgtccgagtctataagctccctctactgagagctgctagtattccttctcaagaacaggttatttgaaaatctcttcttgtaagccccaacatttgggggaggggaggatgggggaactcttgactgagcagctaggtttccccaagcagaagttcttctctcccagtgcaagctgaggtttagtgccccggctagcctcggaactggctcagtgggggttggcacgctgacttcctggacaattgctgcatctgacactgtgagcgcccaggacaccggatgtgtagcatggatgtgggcctagcacaggtgtggaagaggacagtcaggacactcactgttggtgtttgttatccacctgttcagccgccgggtcccacacataggtcatctttcgtcactcaagccggcctctgtttttgattttaacaatccaagagcaagtgtgtaggggacaaagagacaccagctcttcatacttgatggagaccgggacaggatgctgcaggcaggctcgggagtgcattatcgtttcttctgagctcttcatccaggccatattcccttttctgcatcgcatctggggtgggaggggctgagctgggagtttccgtccttcttccctgtgggggtgggagatggggctcaaggtctccatctctcggctccctgaggacagaacccccacagtggacctttgggccttctcaggacattgacaatgttgtgtgcactgcaagttgactttatttattttgtaggaaaaagagatggtattctttagcaggatctgaaactgtaccctagtcaagaagtacaattaataacattattattaataacaattgggatgattcaaaggtcacacacacaccagaccacccaagaaccatgtaggagatgaggcggagccaggtcatggaagcccagaatgctacagagattctgtgggtctattattgatcagaaaatacaacatgggggggccttttctatggcataactcaggtgtctgcaaagacagagcagctcaggtgggtggataggcaggcagatggagccttgaatcacatcccctgaggctcagccagccagtgcgaatcctcaaggttcggaaagggacagtgtagcggcaaactactgggcatcttctctgatgcttagaggctcttaccaaggagcttgatggagaaagtggccatgttggtggcatgggacaactgctcacccaacttcaaagatcaaagggcacccaggtggcctatgacagtgacactctttcctaccattaggggtgtctgcccccactgaaagccatgaaatttctggccctaagggggtaggaaggacttaggagtagcagatggtttgatcccatcccccccacacacacacacacatccctcagctgtcttccacattagagccacttcagttgtccatggacttgtccctttgagacatcctggattttgaaggatagaaacatccccaagatggtctcgtgttaatcccacaacagaggcagaagggtcatactgagagagagagagagagagagagagagagagagaggagtgggggccagaccctcaagaagccaagtgggtctggtcaacctgtgcacatgagaaggagggaacatcactaaaatcagggcctgggctggtgtgttgttggtgagatcccgtggagtggctggctagatatggatgagttttctgagcatgctcacacacccccaacttcacattcttagaaatagcacaaccataatgccttacctcaaaaggatgaggcaaagcttgcaattaattcccagtgtctgaagacctccgggatcctttgagctgtgtgtccttgtcagtacatggggacaggctccttaggtattcctgacatagaggtaaggtgctgcccttgctgccttgcataagctgtgacaagcttcttactgggcacatagaacggctctgtcatctgcttccactaaatttgggcttggactttgcctcctgccaaatctccatctctgctggatagtctagtccctagggtctaaccaccaccctccacttcctggtgggtcctacaagcgctgtctttgtgccagtacccggatggtgtcctgcctcatggctaaatggtacaggacatcttcccagactgagtggtcatggcatgtgcatgtatgttcatgagtacatgcatggtgtgtgggggtggatgggtgcattctgttctgcttctggtgcagctacacagccacaacctctttctgtcattgaccttcttggtcttcttgtagccacagataatcttccaatgcccgattctgctgttctcatctgagagctgacaacccagcgctcagagtagagttcatgacctaggaaacccttctcctggtagcttactgaacttatttaattaaaaacgaacatataggggttggagagatggttcattggttaagagcaccggctgcttttgcaaaggacctgagttcaaatcccagcaaccatatggtggcttacaaccatctgtaatgagttctggtgccctcttctggcatgcaggtgtacatgcagatagagcactcctatgcataaaataaataaatcttttaaataaataaataaatgaacatgccataaagtctgtagtggttatttttcttttgttcttaacatcaatctagtcatgaaaatgaacaggagaaaatgcacttacagcaacgagaaagacgtgactttcaccatgacactttccctgcccaagaggagtatgggtgagaataggtgtcagggcccaaaggatgttatttatggtcccaggatggttggtctggtgaccctgcttggaggcgccaaatgcactcagatattatgggatggggacagaagtatcaacccactatcagaggacctggtgacacaagtcccagttctgtcacagtctgaccttggacaagtcacttctctggggatcacaaaacaaaaggtgtagtgacccataggcattgtcgccaaaagccttgatgtggatttaaaggtcagttaaaggactgattgtccctttcccatgccaacatacttcttgaggctcctttctgccgtcagcaaaagctcgccaagcagatgagaaggtggctgaaaccctttcagctgaggagtgtaatggggtcccttcaaggtgcagctgtgcttctctgccggaataacctttatatgagttagatttcagcctgatagtagtcagtttcctgttactagaacacatgctgtcttagctaggattttactgctgtgaacagacaccatggtcaaggcaactcctatgaggacaacatgtaattggggctggcttacaggttcagaggttcagttcattctcatcaaggcaggagcatggcagcatccaggcaggcatggtgcaggagaagctgagagttctacaccttcatctgaaggcttccagaagactggcatgttcaggcacctaggatgaagctctctcaaagcccacatccacagtgacacatttccttcaatgaggtcacatccactccaacaaggccccagctcctaatagtgccactccctgtaccaggcatattgaaattaccacatttacctaaggtaatagcttatcaaatggaaaggtctattttagttcatagcttgggacattttagtctatgggccaaatgtcatggccagagcatgaaaatgaaagaagaggaagggactgggggcccactgtccccttcaagtgcactctcaatgacctaaagacctcccactaggccccgccttttaaaggtcccacctcttcccagtaccacattccaagttataactcttcaacttatgggcatctgagggcattctggatgcaatgaatggcaagccctcttgtctcctaagaggtatctcttatcctaagatgctttgggatagatgttttcccagggagaagggaaagctcgtgttgggacacagggagatgaatctggggtggtttggggatctaggagcttggggcacagatgtgaatagatagaagaaagctgaaccctgcctgagggcagtggctccagagaaagaccaacagaggtgaggtacaacataaatgggcggtacctctctgcctctcaatctccagtctccgaatctgccccagtccagaccttagcaaattaaaccatttccattttaatccttcttagaagggggaacaaaacacccgtagaaggagttacagagacaaagtttggtgcagagactgaaggaatgaccatccagagactgccccacctggggatccatcccataaacaaccaccaaatccagacactattgctgatgccaacaagagcttgctgacaggagcctgataaagctgtctcttgagaggctctgccagtgtctgacaaatacagaagtagatgttcacagccaaccattaaacagagcacagggtccccaatgaaggagctagagaaagtacccaaggatctgaagaggtttgcagccccatacgaggaacaacaatatgaactaaccagtaccaccagagctccctgggactaaaccaccaatcaaagaaaacacatggtgggactcatggctctaactgcatatgtaacagtggatggcctagtcagtcattaatgggaggagaggcccttggtcttatgaaggttctataccccagtataggggaatgccagggccaggaagcaggagtgggtgggttggggagcagggaaggggggcataggagattttcagaggggaaactaggaaaggggataacatttgaaatgtaaataaagaaaatgaaaaaaaaatttccaccctagccttcaacattccagcttacacaataactgatggttcctcctccaatacgactgtcactgtcccatctgtgctggggactggatataattagcataacttctgggctgggcttcagtggtctgccacaaatgatccttacagaagcaaattaacctaatcacaaagaggtctggacacccaccaagcctctttctgccttcctctcccttcctctcaccctgactcttcttgtcctacatcccaacccatcaatgatgggaggacttgagtaccatgaggttctgagatagttacctagaaacattgaggaagcaactggatcatctcggacctctctcccctgaagcctacagcacagtgtccccaaggtacgtttagaagagattgtggttccagccactcttgagaaattactgtgtgcattagtttacctgaggtgatgagaaggcctgccttcctttggccaacattaaagacctccacagaatcacacacccccctcccatctcttttggactttttgaggtagcatctcacagagccagggctggctttacatttgttatatagattttgtagatgaccttgaacttccaatctccctgcctccacctctgagtgctgggtgggaccacaggcatgcactatctatcatacctagtttatgtggtgctacagttcaaacccagagcttcatgcatactgggcaagcactctataagccgagctacagcccccataaagaacttggggctgaggggaggtgtctcactgtgtatctctggttggcttagaatttactacatagaccaagctagccttgggttcacagagatctctctctagtgttgggatgaaagacatgcatcaccgtgtatggcctcttattctagcttaaagaatcatttttaagagtagaattctcacttaaattttcttgccaatggttaagagcacttgctgctcttgcaggacctgggtttggttcccagcacccacatcaaaagacttacagctttctgttactcaagttccaagggatccagtgctgccttctggctcctgcagacatctctcctcctgtgagaaggtacctgtgtctttctttcatcatgataaaatgtgtgcaatctgagatttattcatcaccatacccaggccattcataatggaatgtgtacaacataggccattcataatagactgtgtacaatacaagccattcataatggaccattctcagcaatggttctaaaatatagtcaccatttccttcctaccaaaataggaagcagcaggcacagttcagtcccacaaatcctaaccgggagccttcagaatgcagggcccacaccagcctcaggaacacagggaaccccagtgtgtccatggagacaaatgtcctgtatcagattgcccaatgaagggagtccaccaacaatgtcataggaccttcatttgtaatcatctatacaatatggtcccaaacagagcaacacacctcaacttttctatcagtccctcccttgtatacccgaggctatcccatgtgaagtgggtggtggggtcaaggacagctcaccccctctgcccgttctatacactgtaccactcagaccctgcccaaaggagctctaacaggttacagaaggtcacaactgtgtgcttatctcaggcaccaaagccatgggagcagctggcatagccaagtgaggccacacgtgacctctagagagcaagtggaagcaaaactaaaggaaaggtggtcatttttcctcacagaaccataggaccactgtcattgaaaattcaggatatgaatggggaatctttaaccacctgcaggctgagacattaagcaaagctctcagcctgacttgtggcatcctcttcatctgtaggaaggggccaagaatggcctctgcttcaaatattcaaggtaagatttagacacaactgtcatgtgcaagttctcaggaataccttagtgattattacactaggagccttagttattatactaggaacctcagttattacactaggaaccttagttattatactaagaaccttagttattacactaggaacctcagttactacactgggagcctccgttattacactagaaatcttggttactacagtaagaaccctagttattatagtatgaaccttagttattacactaggaaccttagttatcacagtaggaaccttgtgttattattacactattaacccagccaggtggagaaggaagagggttagaaccactcatgatttttcttctcacaaatgacaggatcaactgtgtatccatgaacatttcaatgtttgaaatattagttcctaactggacgtgttggcaaacacctttaatcccagaacttgggaggcagaggcagacagatccctatgagttcaaggccagcctggtctacagagtaagttctaggacagccagggctatacagagaaaccctgacttggaaaagcaaaaaccaaaacaaaacaagaagaaaggaaggaaggaaggaaggaagaaaggaaggaaggaaggaaggaaaaggaaggagggagggaggaaggaaggaaggaaggaaggaaggaaggaaaagaaagagagagagagaaagaaaggaaggaaggaaggaaggaaggaaggaaaaggaaggagggagggaggaaggaaggaaggaaaagaaagagagagagagagaaaggaaggaaggaaggaaggaaggaaggaaggaaggaaggaaggaagattacttcctattcagcatgcatctctcaaagctctctgggatctcatatctgatccacatccttgtgcccagggcctcaaggccagactctcatgttctatatgagatgtatggggtagtagacccatgttgtatataggatagcagactaacctatttaacatttataacccatttacatgtcagcactagagtttgttaggagagagttgatgtggtaccagctgcaaactcgagtcttcctgtcccggagcttgccctcagaaaaactgtgctgtatcttggagggaacacgcatgtgtcagccctgatagcttgtccctctccccagtgatgagacatttgttcatcgtcctgactgctgtgtggcttccctgtggacatctgcatctgtgaacagtgctctttggattctggccaacccataaagagattgggagccatgggaggtcatgttttgaaattggctttgatgttaggcatccagagccagagcacatatggtgattcctagatgcagttcctcctgtccccgtcagatacaagcaggaaacaatcctaggaacatagccaaccaaacacagataaagaaaggcaaagccaggtgtggaaggtggttctgatgctctgaccacaaatctgcttgtgaaccctgaaggtcctgctccccaattggttcttgtttgatcaataaagatgctataggctaatgagctggatgaaagaggcaggacttccagtttcccacaggcaagctagcagacacaggagaagaaaagagcatgctttggagagagagagagagagagagagagagagacatcagccaagagagatctccggaagagtggccttcggctgcttccccaactgggcttcgggtagcaggcgggatattagaaacataattaggctgaggtgtagcctccctcagccttgaa

SEQ ID NO: 122 - DNA, 1654 bp, Mus musculus
aggaaccccggctccctgcttcctactgggtgacacagagggatcagccctctggcctcacaactttcccacagcagccagatcttccctctgcctgtggagccccgtggagccgcgttttttctacttggaaagctgtatatacaggatcagagtgtcccccacctgaagagggctgattgggtcccaagctatgctcctgagctgagtgcctgcagccagtctgaggaactccatggagaaaggactcgctttgcctcaggatttccgggaccttgtacacagcctaaagattcgaggcagatacgtcttgttcctggcatttgtggtcatagtttttatcttcattgaaaaggaaaataaaatcatatccagggtctccgacaagctgaagcagatccctcattttgtggcagatgccaacagcactgacccagccctgctcttatcggagaatgcatctctcttgtccctgagcgagttggattccaccttttcccatctgcggagccgcctgcacaacctgagcctgcagctgggcgtggagccagcaatggagagccaggaggctggggcagagaagccatcccagcaggctggagcagggacccggcgccacgtgcttctcatggccaccacccgcacgggttcctcgttcgtgggcgagttcttcaaccagcagggcaatatcttctacctcttcgagccactgtggcacatcgagcgcaccgtgttcttccagcagcgaggcgccagcgcggctggttcagccttggtctaccgtgatgtcctcaagcagttgttgctatgcgacctgtatgtgctggagcccttcatcagccctccgcccgaggaccacttgactcagttcctgttccgccggggatccagccgttcactctgcgaggatccggtgtgcacacccttcgtcaagaaggtctttgagaagtaccactgcaggaaccgtcgctgcgggccactcaacgtgaccttggcgggcgaggcctgccgccgcaaggaccacgtggccctcaaggctgtgcgcatccgtcagctggagttcctgcagccgctagttgaggacccgaggttggatctacgagtcattcagctggtgcgcgacccccgggccgtgctggcttcacgcatagtggcctttgcgggcaagtatgagaactggaagaagtggctgtccgaggggcaggaccagctgagcgaggatgaggtgcagcgattgcggggcaactgtgagagcatccgcctgtctgcagagctgggcttgcggcagccagcctggctgcgcggtcgttacatgctggtgcgctatgaggatgtggcacgcaggccactgcagaaggcccgagagatgtacagctttgcgggcatccccttgaccccgcaggtggaggactggatccagaagaacacgcaggcgacacgcgacagcagcgatgtctactccactcagaaaaactcttctgagcagtttgagaagtggcgcttcagcatgcctttcaagctggcacaggtggtacaggctgcctgtggcccgaccatgcacctctttggctacaagttggccagggatgccgcctcactcaccaaccgctccatcagcctgctggaggagcggggcaccttctgggtcacgtag

SEQ ID NO: 123 - protein, 481 aa, Mus musculus
VPAASLRNSMEKGLALPQDFRDLVHSLKIRGRYVLFLAFVVIVFIFIEKENKIISRVSDKLKQIPHFVADANSTDPALLLSENASLLSLSELDSTFSHLRSRLHNLSLQLGVEPAMESQEAGAEKPSQQAGAGTRRHVLLMATTRTGSSFVGEFFNQQGNIFYLFEPLWHIERTVFFQQRGASAAGSALVYRDVLKQLLLCDLYVLEPFISPPPEDHLTQFLFRRGSSRSLCEDPVCTPFVKKVFEKYHCRNRRCGPLNVTLAGEACRRKDHVALKAVRIRQLEFLQPLVEDPRLDLRVIQLVRDPRAVLASRIVAFAGKYENWKKWLSEGQDQLSEDEVQRLRGNCESIRLSAELGLRQPAWLRGRYMLVRYEDVARRPLQKAREMYSFAGIPLTPQVEDWIQKNTQATRDSSDVYSTQKNSSEQFEKWRFSMPFKLAQVVQAACGPTMHLFGYKLARDAASLTNRSISLLEERGTFWVT

SEQ ID NO: 124 - DNA, 69168 bp, Homo sapiens
  misc_feature (1)...(69168): n = A,T,C or G
cgagttggtatgagccatcagattttttttttcttttgagacaaagtcttgctctgtcacccaggctggagtgcagtgatgtgatcttggctcactgcaacctccacctccccggttaaagcaattctcctgcctcagcctcctgagtagctgggattacaggtgcatgccaccatgcctggctaatttttttctatttttagtagagacggggtttcaccatgttggccagactggtctcgaactcctgtcctcaggcaatccacctgccttggcctcccaaagtgctgggattacaggcgtgagccactgcgcctggcccagagccatcatattttttaacagggaggatgggggtgttatatggagagtgtgtcggtctaagaagagtgcataagcagagcttgtttatgatgggttgtaggcctttttggtgagttaggcagattgggtattggcgaacattgagaaatttggaggggtcttttaactggattttgatggggtcatggtgagcagctatggaagggatggtggtgtcccacactactgggttaaagagagaggcgggaagtggtactggggagagggatcagaggctggactagtggagaggagcaggagggactctgcttgaggggagcaggaaaaggtgatagaagctttgaatttggctaaaaggtcttggcctagaatgggggtggggcaacgaggcatgataaggaaagagtgtgagaaaacggtatcaaacagggaacaagtaggaggtctgctggtgcatggacgtcagatgagtccatcaacccccacaactaagacttgatgttggtagagttgctgaggcaggactggcttgtctgtcataatataaaagagtattggaagatgtccggggtccgggtctaaaaccccttgtggcctttggaacaccaagctctgtgccaaagggtggaaggctgccctgccgcaccacaaatttaagcccagggcataaaactcctcatgacttggatggaatccagggctcagggcatacaacccctcgtagcctctggaatgtgcacagacttgttggttgctctcccaggctcataaacatgttctccattatctcaagcagcagagcatattcatatgtgtcaaagaaaatgctaaagtgtcacagctacgcttgatgcaccgctacctttctacccccatatccgcatgtcctcaccacctgcttctttgtttgatcaccaataaatagtgtgggttcccagagctcgggtgcttcacagcctccataccagcattggccccctggacccaccttatgcactcttaacttgtcttttctcattcatttgactctgccagacttcgtagcccccatggcctagtgttgggtctgatcaccctaacatttctggcgcccaacatggggctatgaagaccctggtgaaggaacactagagcatgtggaagcagaggacacattgtcagaggacacccgaggatgactgaaagaagctcggcaggtaagctgggcactcgtaagaaccagggtaacaatgggacagaatgaaagtaaacattctgcttatttacatttcttttttttgtgtgtgggtggcaagccacccaggcgccaaggcaagagactgaaggcacaagcttgttacagtataataaagaaaatacttaaaataagaatagttatattagacgtagaatatagacacgattatatatgaatattatcaatcattagtttgtagcattactctttattccaatattataataatctctgttttacaattataacctaggaaaaaccaggccatacagagataggagctgaagggacatggtgagaagtgaccagaagacaagaatgcgagccctctgtcacgcccagacagggccactagagggctccttggtctagcggtagtaccagtgcctgggaaggcacccgttacttagcagacggggaaagggagtctccccttccctgggggagttagagaagactctgctccaccacctcttgtgaaaggcctgacatcagttaagcccacccacagccatccagaggcctaaacgtctccctgtgatgctgtgcttcagcggtcacgctccttgtccactttcatgttcagccctgtacacctggctctgccttctagatagcagtagcagaattagtgagaatattaaagtctttgatctctccaagaaattcatagaagaaataatggcataagctgtcccctctctctctctctgcctcagctgccaaacagggaagggctccctgtctggtggacatgtgactcacatgaccttacctatcattggaaatgactcacattccttaccctgcccccttgccttgtatacaataaataacagcacagccaggcattcggggccactaccggtctccacattttggtggtagtggtcacccgggcccagctgtcttttcttctatctctttgtcttgtgtctttatttctatgatctctcgtctccgcacacaaggagaaaaacctacaggccctgtagggctgatccctacattttttgagacagagccttgctctgtcacccaggctgcagtactgtggcacgatctcggctcagtgcaatctctgcctcccgagttcacgccattctcccacctcagcctcccgagtagctgggactacaggcatgtgccaccatgcccagctaattttttgtatttttaatagagacagggtttcaccgtgttagccaggaatgtctcgatctcctgaccttgtgatatgcctgccttggcctcccaaagtgctgggattacaggcgtgagccaccactcccggccttagttatttaaatttcttaaggcatttattatggaaagggggagtgaaagttagtactcagaatttattaacactctttagtacagtagagcagtttgcccatggttcccagaacaagggacaatgggggttggatgaatgggaaagaattggcagagattttaaaaaggtgcataaagaaggagccaaaattccagtttctgtttggtcagtgtgagcattgataaaggcagctcttgagccatttcaaacaatgacaagacagattcagatgaggaagaggcagacaagtgtaaaaaattaacttcagattctgaatgtgaggaacaggaaccagaggaaattaaataaaagagagggaaactgaaaaaggtacatttcactagcctgtcggttccacctgctgaattaagtgaatggccacctcctccctctccccttaatggacaagaacatgaactagctaaaaaactaaaaaactgctcctgtagttgcaacattaaaacctggagctattggtggcgctatacaaaattctattcaaaaggctagagccgagggagaccttgaagtatggcaatttccagttactataacccagcaaggagggcagaatatagctaattgggccacttttccttttaagttgttaaaggaattcaagcggaagccattagtcaatatgggccaaattctccttttgtacaaactttactaaaaaatgtggctcttgataatagattaataccatatgactgggatactttaacaaaacctgttctcactccgtcccagtacatgcagtttaaaacttggtgggccgatgaagctcaaactcaagcaagagaaaacacacaagcacagccgcctgtgcctgtttcctttgaacagttaatggggttgggccctaattggggccgactagacaatcaagcagtaatgaaaaacgttgccattgttcagttacacactgtgtgtttatgggcatggaaaaaaaataaatgttatggggaaaaaatatccttctttcagttctgtctgacaaggacctaaagaatcatatactgactttattgctcggctccaagaggctgtgcgtaaagccataactgatgaaatagctcaagatgtggtaatacaactccttgcatatgataatgccaatacagagtgtcaaaatgctattagacctatgagagggaaggctcatttggctgaatatattaaggcttctgatggcattggaggtaacttaaataaggctactcttttagcccaagctatggctggactaaaggtgggaaaaaatatgccccgtttctcaggctcttgttttaattgtgggcaatttggacacacaaaaaaggaatgtagaaaagaaaatcaaaaggcaaaaactattaccatcaatcaacagaaaagtcctggcgtatgcccctgatgtaagaagggcaatcactgggcaaatcggtgtcattctaaatttagcaaagatgggcaacctttttttgggaaacaggaaagaggggcccacctcgggcccctcaacaaaccaaggtatatctggcacattcagtgcccttacaaatgtacaacagttgtcccctgccacagcaggcagtgttgctgtagatctttgcagcacagttcccatttccctacttcctggggagccaccaaagaaggtccccatgggagtcaggggccctttaccctcagaacagttggtctattgctaggaaggtctagtttaaattttagaggtgtcactatacatgtaggaataattgattctgattataccagagagattcaattagttgctagttcctcaattccatggtctgcttcctcaggagaaagaatcgctcagttgttactgttaccttatgcaaaactgggacgcagcatagtaaaaagaatgggaggctttggtagtatgaatccagcaggaaaagctgtatattgggttaatcaagtgtctgataagagacctatttgtacagtaaccattcaaggaaagaactttgaagggctagtagataactggagctgatgtttctatattggtttgaatcaatggccccagcattggcctaagcaaaaggcatccattggtattgttggagtaggggctgcctcagaagtttttcaaagttctttaattttgccatgccaagggccagatggccaagaagggacaattcaacctattacacctattcctgtcgatctatggggtagagacttattacaacaatggggtgctgaaatacctattcctattgatcagtatagtattaacggtaaacaaatgatgagaaaaatgggatatctcccagggaagggactaggaaaaaatgaaaatggccaaccagaacatttagaactaaaaggacaaacagatcaaactggattagggtatcatttttaggaacggccattgctgagcctccggctcccattcctcttgtttggttaactgctaaaccagtttgggtggagcaatggccactgaaacaggaaaaactggaggctttaaaataattggtacagaaacaattacaaaagggacacacagagcctactctctctccttggaattctcctgtgtttgttattaagaaaaaatcccagaaatggagaatgttaacagatttgagggccgttaatgctgtcattctacccatgggtgcactgcaaccagagctgccctccccaactatgattcctaaatcctggcctctaatagtgataaatttaaaagattgcttctttaccattcctttagctacccaagattaggaaaaatttgcttttactgttcccgctataaataacaaagaaccagcagacaaataccattggaaagtattactatttgtcaaacttatgtcagaaaaggtattaagccagctagagaacaattcaataaatgttatattatccattacatggatgatattttatgtgcagctgaaactagggaggaaaaggctgtaacagcagcaaggttaatcatagcccctgataaaatccaaacttctactccctttcagtatttaggaatgaaagtagaacaaagtactattaagcctcaaaacattcaaattagaagagataatttaaaacctctaatgattttcaaaaattattaggagacattaattggattcatcccactttaggcagtcctacttatgttatgtctcacctcttttctaccttacgaggtgattctaacttaaacagtaaacactccctgtccaaggaggcattagagaaacttcaattaattgaagaaaaatttccacaggcacaagtgactcgagttgacccattgcagtcattacagtttttagtttttcctactaaacattcacgtacaggaattattgttcaacagaatgatctggttgagcggctttttgtacctcacaatacaaccaaaacgcttactctgtacttagatcaagttgctgtattaatgtagtgtgcaaggctgtgcacaacaaagttaatgggatatgatccaaatcaaattatacttccattaaacaaacaacaaattcagcaagcttatattaattcccaggaatggcaaattaatttggcaggttttattggcattcttggtaatcattatcctaaatccaaaatattccaatttcttaaattaatatcatggatattgccttccattactcaaaaagcccctattgaaggggccattactgtttttactgatggatctagtaatggaaaggcctcatttgtgggacctcaacaacaagtttttcaaactgactttgcttctgctcaaaatgctgaacttatggctgtgataacagtgttaaaaacttttaaacagccaataaacactgtttctgattcagcctatgtagtgcaagccacacaaaatattgaatgtgccttaattcaaaatgtgactaatgaccaacttaatcttttatttcattctttacagcaagcagtacaacaaaggcattcccctttctatgtcactcatatgagagtgacatagccctttaaatttaatcaaagggtggataattatatggggaataggatttgcttgtgtctctcaggtaacaatcaggtgcctgtatgagtgcccaccaaacatctgaaaatctatcatgagctacagcaggaagagaggactctgggaagagtcctctgaagagtccagagacgtggtttcacggtgttagccaggatggtctcgatttcctgacctcgtgatccgcccacctcgacctcccaaagttttgggattacaggtgtgagccatagcgcctggccattacccggcagctttgttaaggcctgcaatgaggcaagtaatcatatagttacagacgcccagctggggtctgtgggttggtactcccaggaaggctcttcctggggaacagcagtggctcctatgggcttagcaggatcttgcccatgaagatcgtcagtgtgtgcctgtgctacaagccacactctttccttctcttctggaaggagagtatagaagagaggataatgtagagatcatgccaagtgagttcataagattgggtaagatatttaaattctttgatataagtatcaggatcggaggagaaggacctgagacgtttttcaatctgtgagagattggagagggagaaagggaaatggacacggatgatccccttgctcctgctacttcccagagaggaagcaagggaactggttgctgagtatgttgggcccaagagcgggtgaggggtggagatggagaggactcagagtcagaagcggggtggttggagagagggggacagatgggtagagccagagcagggacataccgtgaagaatcatgatgctctggtggaggatcaagatgctgtcagggaggggcaaaattggcggggtcaaagaaagaggagttgtcggctggggctgttgcgggggtggtgggagacggaagtctggtgagtaggatttggaaagtggagcagtactggcagagggaagggcggttatggagagtgaagaaagcctgaacataaggaatctcagaccatttcccactgcgatggcaaaagtcgtctaagtctctaagtatattgaaatcaaaagtgccattttcaggccattgggagccattgtccaattggtattgaggccaagtggtattgcagtaaaagataagtctcttagaacggacctctgaatggaggctgagagccttgagattgcagaggagacagccaaggcgggtggtcttgggatgggtagactgagaggctcccatagtgaatggagggtggggggtagaggaagaagagactgcagatgacaaggatggcgagagagggtgtcccctgtcctgcaggccttgtctggaatagaggcagccaccgagtcaggtgtccttcaggtctcctctattctggacaaggcccttgggtgaggggtgataggagagagagaggggaggggggagagggagagagagagagacacctctaaggacacgcagccagagcctgtccccttcctgggtttcggcaccaaaatgtaacgttagctgagagaaaggacaagagagagacccaaagttaggcgagtaagtttatcctgccgggctgctccaccacagtcagaggaggcagccctggagcttataaaatgaggggttcatatgggggagagagaccctggggttgtcggttaactttaccacatatcatctcgtgaccgcttacaatataggaatttagaagagggtgtaacttaagtttatccacatttctcgtgaccttccccatgctgcctgttgggctgtaagcaagtctggtgaccttgctgtagcacctagataagggtccaggaatgcagcttcggagtattcagggtaagggtcagctgcattgtgtgtggggcggggggttcctggggcaacttgtccctaacagggtcaggattagttctatctggttctctatttgctgtccatctgtaaatgctgagaatggcagagggaggccaagtgtagataatcaggttttagcttttttggattttcctacttctcctgtacaggaaataacttattgtctaaaccccatactatcccattaaatgtcaggagtgctgtcttaggcctgaattagctcatgacgttacgtactggaagtcccaggaggaatgcccagcaagtggaatccaagacgttctcgccttctcggggacagggccatcaccaggattcggaaaggaacagggaggttcggtttgtgttccagttctgagccctttacctcatccctcgagaagctggcctttgcaccccgcagccggtgctgcccagccgaccacgccatgcatgggaggcgactgggaccccacttgcctggcagcccggccggagacccagctgcctgggagggtccgaagataatgccaggcagccctggcgggccgggaagaccctctgtccctcccgtttcccagttcttgaattaggggagccttggactggctggcggcgcaggaaagtgcaggagggcggatgtgggacctgctgccgcccagggagacggtgctctgttctttggaaccagggaaaccgtcctccagcccacttgccccaggcgggagcaggaagatcctctccgggcagagatgatggggaacccgtgcagccagagggtctccctggcaaaggtcgggggagggggcggccgtaacggccccgggcgctccggcacggagaagccaagggggttctccaagcagcctccacccaccagcctcgccaggagagcgtggatacccgagcggccccaagcgagtccccggggactggagggccgaggggcagcgcccggaacaaaggcccgcagaggggtcctggagacagcggctccccgggggcggctcccctctctcccctctctcccctcctctcctctcccgccagctcctccttctcctccccttcctcccccagaggcccggccggctcgcggcccgagcagcgccaacttcgccaacggttcccaagttgccgggcgcgcaggggtgggagctgggtggggtgaggaagaggaggaggaggaggagaagggctccgggacgccttggacgcggtgcaggaatccgccgccgctagccggctcgggcctgagcggggagggcgccaggcaggacctctcgcaggctcgctgcgcaggacggcgcccgcctggcgccgcttcccttccagcgtgccgaccggccccgcagcgcctccatccctccggcccgccccggagaagacgcacagctcgggccgcgcgggcgccggggccgcggaaccgcttctgccgggatcttccaggaggaaagcgaagttgcgagcggatgctgcccgcgccggaccccagccgcggagggtcggggccgccggtggagtctcggcggccggggtaagtggggcgccggcgtcctggaaccgccgcccagcccgggggaggccgcccagccgggagcccccgccttccgcgtccaggcgcgcgcgccaaactttggagggagaagggggcgaagcggacggtgggaggtggagttcccagctcggggaaaagcccaggcaggcacccacaacccgctgcaaccggatcacacctgccaggtacacacagctcatcgccactcataccccgcacacggcgcaggctgatctgcgcacacccacaccggccaggcacatgccacacaccgaaatgcacattcctgggagcgcgggggatttggcctctacagcaggcacgtcctcacacccctccgtcacatccacggcctttgtctgctgcccccgcagcccccaaggagagggagcccccaaagcgcagcgggcaggagagaggctgcctgggttttgaaaacttgtggccagaaccccgagaccaaggggagcagatgttgcagtcggttctcggagttctgcaggagcgaatttggtgtggaaactcggtgtctgggtgatgtgtgagtgtgcgaagcccttccggaggcgaggcccggagagaggagggagtgattcataaactcagagccggcgtgccagggtctgtgagcagcgtggaagaggctggcaggccgttgctgcgctagacagaagggtagtggccgtgacagtcttccagggaagcagggacccttccccccagcggatgtgcttcctccagggacttccaagggaaccgggtgagcagattccagtcctgggtgtggacggggtaaggggaggtggggggatttaagcctaaaaggttagggagaaaccaaggcaggcctgacgccttcattattttccttgcacctgaagttgtgtttggtttctgatgcgtggtgttgctgggccccaggatgtacgggggattgtcctgggcctagcatagtgcctggcacagtgggcactcagtcagtacttgcttgatgaataatgacaccggtaattatcattcattatggactcactgtgcggcaaggccagtgggcctctgctgggttgaaattgattttccagcagagaagggggcctgagtagctcctaggagccctgcctgatctgcttgggccagtggcccaggcactgtgtgttccactgtgtcccgtgggctggccttgggagactggagctcatcattggcctctgcccctctaagagggcagcaggaaaagcttcatttctgtatctggctaagatggggttgatgtgggttttggtagatggcaggctgtttggcagattctgtggggtctcaattgaagaataactttagatctgcagcagagagaggggttggttccatcaaccctcccatctcctggctgctggagaagaggggtgggtaagtggagaaagagatgggccgtgctgctgggcatgtgctgggggtaggaggaacatgggaacatgtagaatttgggggcagccgtttttcttcctggctcctgatggcctggctggagatgggtctcatgaagggtctaggagctgtgttctgcagcagtggcttggctctgtggtggcagcaggtagagcagtggtcacagtccctgtactgagtattgctgtgggttctcctgtgccagcttgcatgagtttcccagaggagcagaaacattcgtgttcctggaactggattgccagtagtcttgggattgagagtgcacaaagatgtgggggtggcctgggcatgtcatccaaaagaaatgtgtcattccccacccctgcccccttgtgaagagctctgactaggttcagtgtgcatttcaaacttctaaatgctgaaattagcaaggcatgtgggcggcaccaaggactggcctcagatgaaagaggaggtgatctgggcttgggcacccccaatttcaggtggaaccctgcagccagttccttccctatatcacctttccaccttcattatgccctctgtgaatcgagagttctgtatacattttctaattaaatcattatatccctatgaggttagcatttcatctccattttgcagattaggaaactgaggaccagaaaagttaagtaactttttcaatgtcacacaggtagtgagagacaaagccagtgtttgtgtatttggtttttttaaactttatgttaggttcagaggtacgtatacaggtttgttacataggtaaattgtatgccatgggggtttggtgtacagattatttcatcatccaggtagtaagcatagtacccaataggtagttgttgggtttgtttgagacagggtctctattgctcaggcaggagtgcagtggcacgatcactgccactcaccatagcctcgacctcctggactcaggtgatcctcctgccccagcctcccgagtagctggcaccaccatgcctgactaatttttttgtattttttgtagagacagggttttaccatgttgcccaggctggtctcaaactctggagctctagcgatctgcctgcctccacctcccaaagtgctgggattacaggtctgacacactgcacaggcccgagatgggtggtttttgatcctcaccctccccactgtctccaccctcaagtaggtcctggtgtctgttgttcccttctttgcgttcagatgtacccaatgtttagctcccacttctaagtgagagcatggggcacttgattttctgttcctgtgttagtttgcttaggataatagccgctaactccatccatgttgctgcaaaggacatgatctcattctcttttatggctacatagtatttcatggtatatatgtaccacatttctttatctggtctaccgttgatgggcatttaggttgatttcatgtttttgctattgtgactagtgctatgataaacatacgtgtgcatgtatctttatggtagaacaatttatattattttgggtatgtacccaataatgggattgcttggtagaatggtaatcctactttgagttctttgagaactctccaaactgctttccacaatggctgaactaatttacatacccatcagcagtgtataagcactctgttttttgttttttgtttttggtgggagtggtgggatggagtcttgctctgtcaccaggctggagtacagtggtgcgatcttggctcactgcaacttccacctcccaggttcaagcaattcccctgcctcagccccctgataggcgtgcaccaccatgcgtggctaatttttttttttttttgtattttagtagagacgaggtttcaccatgttggccagaatggtctcgatctcctgacctcgtgatctgctcacctcagccccgcaaaatgctgggattacaggcatgagccgcctcgcttggccagcactcccttttctccacaacctggccagcatctgttaatgtttgactttttaataatagctattctgactggtatgagatggtatctcattgtggttttgatttgcatttttctaatgattagtgatgttgaccgttttttcatatgtttgttggacacatgtatgtcttcttttgaaaagtatctgtttgtgtcctttgcccactttttaatggggttgttttttgcttgttaacttgttcaagttccttatagattctggatattagacttttgtcggatgcatagtttgcaaatattttctcctgttctgtaggttgtctgtttactctgttgatagtttcttttgctgtgcagaggctctttagtttaattaggtcccatttgtcaatttttgtttttgctgcaattgcaaagccagtatttgaacccagattgtctaactccagaacccaccctgtctccaccatgccaggctgtctgcaaggcccttattggttctccatggcaacagggaaacagccctgatgcttcttactaacgtggtcccagggcctctgcttgcattcttctttttccatacactctgccgagcctggatataccttaggctgtgggaatcaaaggctgggtggtaccaggctgctggagccttctgtgtggctctggagtcagaaaactgtggagattttgggggggcacacagggagatgttgcagtaattccagtgagacatgactcactgcttatctgagaagttgggacaaagctgcctcttgtgaccataccgtgaatagggaagaaattgccaggtagaccaaacatcctcaaatgggttactgtatttttttcccctttttggtcctctccagggtaatctattacctggggaaatcagccttcacctgacacctcctattgtcatttacctggtgaacataaggggccatgtcacagctgtccttcccacccctgccacgtgttctggagagctggactcctcagcagcacctggtccacaggagagaagaatggggcagagccggagcagccaggggaggtgataaccacacgctcatctggtccccagctcttgcttttacatccacgccccacagggagacagcaattatctgttggccccactttacagatgaggacatgaggctcagagaggtgcagtggatgcccaaggtcacgaagccaggcatctgcaaaggcctgggacagccacgttttcagtcggggtggtattttctatccccggccccaagggctgagagtggttatccctgctggggcagggtcctcactgctccacccaccctcatctctgccctgagagcccccagtacagatgtccatagaacgggaaaggctggcgcccttcaaaggacgcaaagagcattggatgagcactgcccagctggtccctgcccaccttccacaggaagcccacctgggtgagttcttagagccttcctagtgctgagctgcaaagaaactggagccctctccccctccactgcagaggggacacactgaccaggacggaagttgggggactgggtgtggggagaagccaccccactgcaggggccggggctgtccatctttgtacctctggttccatcccagtgcctgaggcatgggaagttcttggaaatgtagtcagatgctgggtgaagccccaggaggggccgtgaatgcttctgctgggaactcctagagtggcggcacagagagggtctttgctgcgaaggaacactcagagcgtctctggctttcgtgaggttatgcctcaggagaggagacacttctccttttcattcgttaaacagaaatgatatttgccaccttttcttctctaaggcctaaagagatgacagaatgctgctggtcctaccctgagcgcgtggactccacagcggggtgtggggtggcccctggcaggcctggacggtttgttctgtgcttgccggtggacacgcttcagccctctgtctctattgccccaaatctggcctgtggctgctgggccgccaccagcttggagggcagggtgggccccgggagcccctgaccaccagtgacttcttgtctccagctgccctccgtcctcttgatccccctcaccccccaccacctcctcacaaagatggctgtgtgctgagggactgtggcttccctgggccctgggaaatttatcactgaggtttcagaggactctatgaaaaggatttggagaaaaagtgtggaaaataaacaagccagttcccagttcagcctctcctgaatgccgcaagtaaacaaccacctcggaggccagcccgggatgttcttatttggcctctgtggttacacctgccccctccccgcccagtccctcctccttaactttaagagcctcaaaagtcagggaacacaccctccgctggccagtccttgtgctgcagggacgctggtggctgggcacaggaggaacatgtatatgggagagaagacggccgggggtcccagctcagccctgctccctctgagtcagtcccaagcctggaccctccccagcaggcagacggtgacgtcttggttggttggtgagtttaactttgatggtgcagaatgatgagacttttctccattttgtggcatctgagaagctttgcttcttaaacattgctttagggtggatagaccaaagctaattttcccgttatgtctctccaagacggggcctacctgtgagcaaaccctcatagattcatttactttgtaggctacctggacaaaaatgtcaggtttctttgctttgggctggagtcctatcagctcaggggtggtggtgtaaggtcacaccaatgatttccagaaactcaagcactattctgagtgactaagtctgtgggataggaagcacattttccatctcttaataacttcaatttacttagtgaccaactttaaaaccaggcacccggttagaagggggagagccagggcttggcagcggagggtcctcaccttgcatccagggagtggctgagggcccttctcgttctctgtggctgtgctgagctgagtcagcgagccctgaagcctctgggatttggggagtggggcactgctggaaggttctggttcctgctttgttctgctgctgccaggcttctggagagggtggttgtggggtgagtcctgcgctccgcacgtccacatgttcgtattctacatattgggcttctgaaaaaagttctggttcataagacggcttcacagcttagccgtctgcagaccagtctgcaggttgatcagctttctgtcatgtgtgtgctgttcctgttcacacatgctgcgccgatgcccgcctgtgcctgtgccagccccagcccacacagctacctgagatttagccctgggcatctcccctaccctttcccgcttccccctcctctcctcccttcctctccagctgcctcgccatctgcaagattctggaaagtgctaatgtgtctgagccaaacagtgctatctgaggaaatattttgaaaacacactgggccacccccgtccccgcactgtgactacactgattttcagcaaggaatttcactccagccacagggcagggccgcaggtgcctggctttcctctggagacttccaggggcttgttagagacacggagagaagctgagggcctgtcctgcaggtttgatgtgtctgaagaggccccgagaatagaaatctagaacctgccagtcacgaagcagtgtcacccaccagaggatgaagaactgactgtgacctcgcaggtcacccacttgctttctttttaccgagacatgctatttctctttcacttttcttccttctcttgcatctggtgtaggtgcctgggggtagcgtgcccaggaaacaataatagtaagagcagctggtgtgcctaatactgccctgagcacctacaaggcgtcctcaccgagttctcaccagaagctctagaggtggctccggttattcccaccattttacagatgggaagacagaggcagacagctggataagttgctgacatgccacagccggtgaggggcaaagccgggcctgagccccacagctgactccagagtctgtgctctcagtaccacctgtgcgtgcgtctgtcccgttgtggctgcaccgagaggagaaacagcacacaggcattcattttcaaaccgtggccagtgcatgtcattgcgttctgactgggaagctctggcaatgttggcgttgcatggcctattgtgggcactaccagtgagcctcggccttctccaggtctgactccagtacctgccggctgccctgggcagggcattttggatcctgcctcagggtcttttgcccgctctgctgatgccactcccctgtgccctgacctggtcacaggaagggtgcagatggcagcgagtgtggtctcagttagcaagggggagctggcagatccagggacttctgcctccctagtggccattccagcaagacaggaaccccaccccgagtgatgtctggccctgtgacctttcagcaaatatttcttccccagcctcacctggactcggtatcccatgttccaaattgtcctaatttcccagacacacacaccctgctctctgtagccttcccagctgccaagaacattccctccttcccccttttccccttggcttggatgccaccttctcctggaagcctgggtggtggccctccccatggctgcccacaggtccccctcactgccctttgcccgtggtattatgattgctggttcagtgatctgtggtctgcaccaggcaatgggatgtgcaagggcaggacagctgtctgccttgtccatccttgtagcccccgacttagcagtgaatgctgctacctgattatggaaggaatgagtgactgatgtggcacagagccctcagtggggcaggcccagtccaggatgcttctgtgagggagcgcttcgagtctggggagggtggcaggagtcgtggtgagcgggaggggtggctaacgtgggccaaggaagggacagacaggaagagtgggaccccggcacatggcctcttgaggtcattaccccatgggtattgggctgggatactgaggatgagcctgaaacccttccagaagcccctccagtcctgccacttgtctgcctgcctgccctggatgcccgtttttgggctggtggctggctgcactctgggcccactgctcaaccccaccagcaagtggagagccattcaacagccccagggtccagttcccatctgcaagtaacgaggcctgccgtggctgagtcgtttccctgagcagagagaaggaagccctactggccggctgcctccccaggggtgggtagaactgttctgtggccccacctccagccctcaagctgtctgtccttgcaaaagtagtggggcacagagtgctgggttcttgggcatcacctgtccaggtcctgcgcgcctatgctcatgctgacactgcaagatggtgggataacaggagggactttcaagctggaagagaggagagctgggtgccccagtaaccacctttgagtcccactgtgatgagcccacagaggtggacatgagggaagacttggggaagccttcctagaggaggcaggcattccagtgcatgagggaagctgggcaaaggcacgaggatgggaaagttccgattgaagacagggactggtgaggagtctggctggactgaactgaaatgtataggatacacgaggagagacaggcaggatggagttgtggttacgcacacaggctctagagccgggctgccttcacgggaaccccaactccccacttactggctgtgtggccgtggccaagttgcttaccttctctgagctcagttttctcactactggtaccccccacatggggaagacatgggaataaaatgtatttctatacaagtgttgagagcagtgcctggcacactgagcatcaggaagggtgagctattattatataggtatatgttttaatgcagctagaaaaggaaatcgaggtcagatcatagaggcccttgaatgtcattctttccattcactaagcacctgccatgtgccagattcttcacagtcattctcaccaagccccctacaacctggcaaggttgttagcaatgtctccatttcacagatgaggaaactgaggctcagagaggttgagtaacctgcctaaagtcactcagtcagggagagtcagagccagtaataacacccaggtctgctgtcgcttgagtcttccctcaaagtgaagattggagagacatggcaggggcatcacagggatgagccctgggctggggccgcagccaggagcagagcaggaatgtggcaactgtgggtccctggggcagggtggagacggggagagatgccaggcgggcctggagggtagggaggactggaggctacagcatacagctcaccattcatagcccagggcaaaccattgagtcatttggggaaaacatgacatcactgagtctcactgtctgccgcccacctgctgtctgccctctatggttctcctgatgacctcagtgccccaagtcctgcaaggggacccgcacaccccatgtagcagggccaggtcagcactccagcttcctgcactgggttctcctccccagccactgtctcccaccttcccaccactcccttccctgcctgggtcccctgccccagccctactcatacacactgctgaggcagaagcttctggaagtggtgatgggcatgaagagcttccagaagggcttccatgccaagcccttgattggaattctgggtggggaggggacagctcagaagcctgtgtcgagcttttagagttgcttttccttgagaatggtgcctgctgtttgggtgggatcacttttaaaaagtaaagcctggtagagctatgtgaccagcactatgccatgacctagaggagattcagactgacgggcaggccctgccttcctgcagaatacagttgagtgtctgagagttctttctgtactaagcatctttgaactgagtgctttattttcgtccatctgattgcgcgaggtagtcttattttacagatgccatccccgaggcccagagaggttaggcaacttgtccaaggccacacagccaggattcacacccataactgtccaactccagatgtgctcttagccactctgccatccggccacaaataaagccaccagagaaccacagaaggtggaacatatccaacatttgcccgataaattgtatagtgcagacaggaagtacagggagttttcatctcaaagtgtaggtcactccccagagtggcttgaagtctgtagatccatttaggagaacatccagcttcactggctgtgcaaatcccacccatgcggctgtttggggtgagaagtttctttaaatgtctgttgactctcttctctggaaggagcacgggggctcagggggcgcctgtcctggcattggtggccacacctagaaacggactatgaatcaagccaggggcccagtgccagcttccttggcctgtctgtgggcgcagatgccagcctttgcagctgctgctgcaactcacagctctctcccggtgccgccctcagtcaggccagctggagtggaggggccagtggccgtgccctgtgcagaatgacatcctctcaccttcacaagggaagcgtgattatccttgctttccaggtgaggacactgaggcctagagaagttttctggctgtctgagctcccttggcctgagctcccgcggtagaaccgagactcaagtcttctttctgcaggcagatggccagtttcttcctggaggagggaggagccagcttgccctctgacactgggtagcacagccctgttcgattctctgttcggggcttgcacttctgattcattctgcagtcactggctctttgtggttcgggaaaatgaccctctagggtaggagaaaagctcttggagcacttttgaagccatagaggccctttccaggctttggaaaatgttccttctccacccagatgccaacaccaccctggtcctggcagtacttgtccctggaagggcctcactgcggtgactcattacccagcatgcagcacattgccattgctctcagtgggcaggtgctgtggggacacgggtctgcgggcctgctgtcttcaggggtcccccatgccttttaacgcgtgtatcagtgtaccccaagcctcagttctgtgtagtttgtacaactctggcccctaccccaaggatttctgggaagcccccaggaatgctgataagttcacagtctgccctccccagccccagtctcatcaggcttcaggggtggccattcctcccctccaggagagagagaactcaaaccagtaactacccctcctcaggctcaggcccaatggttgctgtaataatttctggggagctgtctttgctcttgcagagaaggcaggccttgaattcagactggaggggccatttttcttccagttgccctcaaattttcctttctgtgataggatttgtcctttgtctctgcttaaattcaaagacttgttaaaatgacttttctcaaacaagaggctaccctcaaaagaactttgcctctacggatagaaaactggaacctacttttattttggttttagttttattaaattgtataaaatcaataatacatgtccatggtgcaaagttgaaaaggcacaaaacagtctatgtgtggtctctttcccatgccggactcagacactcagcattgttagttttgtgtgtgtgtgtaagctgtgtttaaattgtccagctttaaaacaaaacccttccctgtttcacaattaggttgaccgaggcacaacctgaaaaataacctggaaatagcatcgggccccctgcagcgtccagctcttcccgaggactgttattatgataacgatcattgctaaggctgtcccttcccaaaaagtgttgctgcccacagtcccagcccccagacctgagcagtcacccacacagcatgaatggggccagccccagcctgcccgctcagcttccaagcctagcagtctcaggctctgggctaaccctggcctcccagctgccccttcaacattgtcccctcttgtcttgcagggcagtagccacagctggggctgtcgggtcagggcatggcaagggtgatctgaccaaactatgctgcctcttagccagactgtatattcggagtcccctaagctcgatttttttttttttttttgagacagggtctcactctgtcacccaggctggagtgcattggtacagccatagctcactgcagccttgacctcccaacctcaagtgatcctcccacctcagcctcccaagtaggtgggactacaggtgtgctccacctaatttttaaatttttttttagagaaggggtctttctatgttgcccaggctggagcttgattgtttgtttgtttgtttgaagacagggtcttgctcagttgcccaggtttgagtgcagtggcgtgatctcagctcaccacaacctctgcctcccagattcaagtgattctcctgcctcagcctcctgagtagctgggattacaggtgtgcaccaccacacccagttaatttttgtgtttttagtagagacagggtttcatcatgttggccaggctgatttttttatttttttaaagaaggtctcccaccagctggatctgagccactggctgagaagtgaagtccatgaagcattcagcaatagtaacagcaccaccacctcctcatattgaacctgcctctgtgcttcttcctacgccttcctatgcctctatgctgacttctggagaagccagtcacttgcccggtcacactgtacaaagtggctcagggctggactcactggcttatgcctgtaatcccaacactttgggaggccaaggtgggcggatcacttgaggtcaggagtttgagaccagcctgaccaacaaggtgataccccatctctaattagctggacgtggtggcaggcggctgtaatccagctactcgggaggctgaggcaggagaatctcttgaaccagggagacggaggttgcggtgagccgagatcacaccattgcactccagcctaggcgatagaccgagcctccgtcttaaaaaaaaaaaaaaacaaagtggctcagctgggcttggatctccaacatgctgggccccagtcaccagattcctaaccccgtgctgccaggcttccccggacaatatcatgaactcaacaatccgctcccttcctctgcagggcaacctctcattccccagagctcatttaataacaagagtagtaatcatagttaaccttctttaccctttactatgtgcaaggcattgttctagaagcgcacacatcgatcatttagtcctcacagcgctcccatgtggtaggcgctgtccttatactctttttgcagataagcccaaggcacaggagcctgcctggtaagcagcccatgtctaaagggcagtgaagaaccggcctctagggaatgcagggctcctcttgtacccagaggggaggcgccctgcctcttctctgttgagcctttggaaatggcctccgaggggcccctgctcagcacagctctgtgggccaagagcaggagtgtttgaggcacagatagacgatgtctggacccctccccaggatgcctccccatgtctgaccttggggagtccagtgccaagggggaagttcaataacataccaggtttctccttggccctgggacaggttccttccctttccttccctcctccctgcatccttccttcctttcttccttctttccttacatatttattcagtgccatacagcgatagcgcacacgtgttacctctaatacaaggtgaaaagtgatatgaatggtgcaaggtagagagaggaatggtgctgggagaggaacgtgtggtaggaggccctcccttcacatcctggcctcaaacctccagccggtggccttgggcgggtcgctcagcgtgtctggacctctgtttctcatctggataatgaaggagagggtggaggtgaggacccaggttgcctgccaggctcttgtgagaattggaggtgtaaaagggctttcttttttgtttttttagacggagtctcgggaggggggttagatggcgggagaggggttagatggcaggagaggggttagactagtccccctgggggattggttatggctgtgggggaagtcggagggaggctctggggatgtgtagggtttgggctcggccttaagggatgggtggaatttggccaggcacagatgggggaggggtggtgcttgggcatcaccagccctaggctcatggttgccaccctccctaccggtaccgccttccttttctgcatttccaccnnnnnnnnnnnnnnnnnnnntgtttttattttttttctctatctaaggtagtcagaatattatttttgtgataatgctagatgcttagtatgtaaaattcaagtacaatgggtaaatacagagaagaatgcagcaaatcaccaccactcccaccacccagatggaactgtttagttatttggtccgtatgcgtatagacacctcagtaggcctacccggtgggtgggagtgggagcatgggggctggagggccagaaagttttataagcacagggaaaatgcacagtttaaatttaccttcaggccagagttggaaagattgtctcacctgaaacagtccttcccttctgtccgctgcctacatgactgtatcggatggggaaagagggaatggggaactttcaggccatggccttcaaaacctccccattcagacaaattacagaaaaggagccagtctcagtgagcatattccagctctagaacagtggctttccaacttttagactaaaacctcagacacagacacccccacataactgaaacaaaagccttatgaaacccatattttagctgggcacagtggctcatgtctgtaattccaaacactttgggaggccgaggtaggaagatcacttgagcccaggggatcaaggctgcagtgtttgcagcgttgtactccaacccgggcaacaaagtgaaaaaagaaactcatgcttatcaactcatgcttatcattatgatacagaggcattctgatattttctaatctacacaatgctgttgtgtttaaaaaagaaaaaaaaagcttatcttaacctaccaaattgttggcacagcctgcagtttgagaaatgtcactgttgaccagcgattttcaaacgttcgtgtgcatcagactcaactgcagagtgtgctaaaacaatctgctcccctctcctgaggttctgagtcattagttctggagtgggacctgaggattcgcatttccaccaagttcccaggaggggctgatactgccagtctggggaccccactttgagacccaccctcctggggtgtttttaaggcaacatgctcccttggcaaagaccatcaggggatttgctttattgaatggatgagaattgctgattgctaacatccgaacggtggatctctgagatacttgaggatgctggtcaggcattgtcattgggatctttaacaccaccctcctaaaatccagctcacactattaatataaagtgttgcatgtagaaaaggcctgctaagcaaagggacatttatgcctagccctagttgaattccctgcctctcaaatcccagacctgcagaacataaaaccctcccagcctttctgaaaacactgttcttctaaaggcaatgaaaggcgctatttagcatgtgggtttcacctttctgttttttcaaagggaagaaggtaggtcaagcgtgactgccccatggggaaggctgtccccgctggctctggtaggggtctggtgggtttcactggcggtccccagtttcccagctttaaccggaaattttcctggcattgtatcacgcggcagcacctcggccttgcagcctgccagctttggagactggcctgtatcccaaactgcttctgctctccaaccagggactgtcagcccccacccctaagcctcctcctctgtagccttggggcctccatgggcccctccccagcctcgcagccctccagaagccagccctcagctgggagcagctttgcgagggaggggaatgttcagtgggcacagagcacttctgttccagtaacaatggcccgttgatgactagattctgcccaggtcagctccctcaactggactttgaggaggagaaaggactccagcccccccaggcagccatttctgggtgtgaggttgattcagaggcctgagcctctgtctgcccacagaacctcattcttcaggccctggtgcagcagggagaaacgcccatcccagggcagtgtaaggccccaggagtgattccgttctgtccaattcaacagtcagttattgaatagtcctggccactgaggtttggtgctaagtagctgtggggaataagaataactgctgacatgaattcaatgcttcttactgtcaaccccgcccctggctgcccagtagtctctagggaacttataaaaattcccaggcacagattcctcccacctcagaatcttcaggggtgaacccttggcactgatattttttaaaagctctcagagtgattctcatgcccagcggggatgcagcatcactggcctccagtctgtcagatgctgtgctaagcatttaacttggagtaccccatttaaggaagcaggtgcttatgggatgctgaaatgtggcccccacagatgtccacgtatgagccaccagcacctgtggatatgtgagcttgcatggtaaggactgtccagatgggattaagttaaggattttgagttgagagattatcctggattatccaggagagccctaaatataatcacaagtgtccttataagagggaggcagaagatttgactacagaagaggagtgtcagaataatgcatggtgaaaaaaactatcagccattgctggtttgcagatggaggaagggggcatgagccatggaaagcagatagcctccagaagctgggaaaggcaaggctgcagactctccagaaggaacccaggccttttggcaccttcatgttaagtcagtgaaactgacctcacacttctgacattcagaactgtacgataatcagtgtgttgttccagctgggcacggtggcttatgcctataattacagcactttgggaggctgcaacgggaggatctcttgaggccaggagtttgagaccagcctgggcaacctgatgaaacccctgtctctacaaaaataaaaaaattagctgagtgtggttgcacgcatctgccccggctattcagaagctgaggtgggagaatctcttgaacccgagagattgaggctgcagtgggccatgatcatgccactgcactcagcctgggcaacagagcatgaccctgtctcaaaaaaaaaggaaagaaagtaagtgttatttgaaggtactaagtttgtggcaatgtgttacaacagcagtaggaaacagatacggggctgtcattaaccctgctttacagatgaagtacgggggccaggcagtcacctgggctcacccagctagtgggctaccgagctggaagaaccaggttgtccgaccccttcttcactgcccaccacacctcaccacactgccccctcttggcagtcagacagacatgggttcaatctcagctctgtcatcttctgtctgtgtgtcctgtgctgctggtgaggcttgtttggccagggggaggccccaggaaggggaggggtggagaccagttggaaagatagggtgggccaggttgtccccaggtggaagagtttggacttgattttggaggaatggagcccacagggcactgtctggtctcctctgccatatttcttgatgatgcctcagacccgcaggcctgctcagtctttgagatctgacataatgcagcaacccagctcccattgagaacctcaggattgggaccagaatcatcattctactccttgtcacccacagccagtgacagccatttatctgggacggccagtgagctcctgtttcccaggaagccagcagtggcctggtgcctccaaaatgtttcttccaagattctcctagaaccatgcatttgggaccatgcctttttttttgaaaaggagtcttgttctgttgcccaggctagagtgcagtggctcaatcttggctcactgcaacctctgcctcccgggttcaaacagttctcttgcctcagcctcctgggtggctgggattataagcacatgccacgatgcctggctattttttgtattttcagtagagacggggtttcaccatgttgttcaggctggtctggaactcctgaactcaagtgattcacctgcctcggcctcccaaagtgctgggattacaggcgtgagccactgcgcctgcccaagaccatgcatattttttagagtaaaagtatgaaatacaaacaaatacagagagttttccagatgaggcaggaaaatagggtctagaggcagggaatgtaaggccaatcacacttcagctataacaggaaataccctctccatagctcgtgctctgtaaatgactttgtaactttacttcatcctctccatttacatagggcgtacccaaaataacaaatggaatcctctagagggtatttaaactccccaaaattctgtaacgggccttttgtttgtttgtttgttttgagacacagtctcactctgtcacccaggctggagcgcagtggcgcaatctcagctcactacagcctccgcctcccaggttcaagcaattctcctgcctcagcctctcgagtagctgggattacaggcatgcgccaccgcacccagctaattattgtatttttagtagagacggggtttcatcatgttgtccaggctgggttcgaactcctgacctcaagtgatctgcccgcctcagcctcccaaagtgctgagattacaggcgtgagccaccatgctcggctgacggccttttgagctcctgtgctcgggccgccccacactgtggagcgcactttctcagtaaatcccttcatcccttccttgctttgtgcgttttgtctaattctgtgttcaagacaccaagaacctggacaccctccacctttaacacaaagccacaccacaagttggtgacaggtcctgaaagatcagttcctgactaggactctgatctgtccactgctgtacagctgctcccttctggctaaatcagcttgctcagacacagagcatagtggttgaatttgtggactgtggagccaggcttcctgtgttccgatcccagctctgcctttaactcagggtaagttttctcatccccttgcctttgatggggatggtgactattatctataagcattatccagggttcttccaaagattaagtacatttatgtacatgaagtacttggaacaattccttgttcactgtgttaacttctgttactattcagctcctctagggcaggggctgtgtcttttccttcctgttcctagtgcctggttccatgcttggcccagagcaagtcctcagcaaatgaatatacttgtttcatgtgagcttttgtcactcagagattctttaggtactttcccaaaagcttgcactcttacaaatttccatcttagttcttcaaatctttcttctcctccttcctgccgcagaattgccatagagcagcctgaagcttgctctgccccttgcaaagtccagtgagccgttcaaagataacccagatgtcccaagcctcccagccagagtgcctgtgctgcgcagctggcgtggttgccccagtctccttcgccccaaggccatgcttggccgaccccctgacccgctgaggttgcgcagagctttttgggccctgtagcagcactgcttgggcaccaagccttgcatggtctcatgggactcactgcctgcagccgctagtcccagctcccctccttaccagaacccacaccatgttgtccagctgatgggggatcacatatcatgctattccctccaggatcctgtcccctgtttttctccccctgccatgaggagtagcatcctcatttagcctttccctcagaaagtccccacgcttatcactacacatgaatagatcccaggaaggtcactttctcatggttctgcaaaaagccaaactccagttgaggtccagtttgaacccaactagttcactcctctgccctagaaaggccatttctgctcaatcttactgccccacctctacttccaacttgcaaagatctcttgaaaccctgcctcctgttgtgggagctagttttcttttcttttttttccttttcattacacagtttcattttgacataacagtagattcacacgcaattttaataaattgtacagagaggtctcatgaatctgttacccacttccccctatggtaacattctgtgaaagcctagcctaatgtcacaatcagaatgttgacttcatacagaatcccctgtggtgcccttttataactacactcacttccctcctgcccccaccccttccttgacccttggcaatactagtctgttctccattcttacagttttgtcatttcaggaatgttctataaatggaattatgcagtgtgtaaccttttgtgattggctgttttcactcagcacagttccctggaaattcatccaagttattgtatgtgtatcagtgttgtttttttttactaagtaggtaaaacaagggacacagacctgttctcctggcatccctccctggttagcaagagattcagcaggccgctgccactctggccttgctgatagctagtgtgtgtgcaggcagcagctcccgctgtctgtaagagcgccagggtagtgaagttgggtgctctaaaagtagtggctctccatctttgctgattctaggttagaatcacctaaggagctttaagtaatcttgatgcccaggccacaccaatgcaatctgaatctggaggtggcacccaggcctcagtgatttgtaaacttctctggatgattcttatgctgtcagagttgaaaaccagtcctctaaaacagccgcagcagattcacaatagctgtgccatcctccacccatgatagatgtcacagagcaatcgcagcactcgtattttcaaatacggcgctccaggcagccccttcccatctgtcagctttggcccggggtggaaattgacttgccctcttagctgagaaaccgtttggccatggccatgtccaggtgtgcccaggcccgaggcctgacatgttaggtgagtgtccctgtaagtaatgctggaaaggtgggcccttgaccgataggaatagttgcagcaggcagagatcgcctgggctggttctataagataaacccgaagtggatcagccagtgtccctcccctgcagcccagcatggggagagatgtacccaagaaataccaaccaacagtgccattggcatagacgggctctggctgacatttgttcagaccagcaataatgcccagcctgtgtgcaatcttcccaattttcggagctcacacagcttccttgatgctcacaacaaccctgtggggccagcctaagctcagagaagttaaattcctcacccaacgtcagcagagagtaagtgggagagctgggacccactccaagtctgtccgagttcagggccatctgtccaacgctcagagcagttagacaattgacctctgtttccactggcagaccgagtgtagatgggctcctctgtggccatagatcagtcagaggatagcagcagacacatgcggaccaagcctcctgctgcccaagacccctgtggcccctctctccctaaccgctgcttctcctacagatctagtgcagagatgttggacagaacacaagaggttgaagtcagggcgggagcaggaaaaaaaaaaagaataagaagaaaagaggctggagttcctcctttcatcacaggaataaaaccccttcctgctgtcaatgggaccattaagtgggagtttgaggaagctccagaggattcaaattctgttgccactgtatagaaacagaggagaccgacgcagtgactcacatctgtaatcccagcactttgggaggctgaggcgggcagatcacttgaggtcaggagttcaagaccagcctggtccgcatggtgaaaccctgtctgtactaaaaatacaaaaaaattagctgggcgtggtggtgcctaactgtaatcccaactactcgggaggctgaggcaggagaatggcttgaacccgggaggcggaggttgcgttgagccaagattgtgccactgcactccaccctgggtaacaagagtgagactgtctcaaaaaaaaaaaaaaaaaaagacagaggaaatagaagtagggttggaagaaaacagggagcagaagaaattctcctctctgtcctgtcccttacttgatcattctccaggatcagaaagcctccttagaaggtcaggaaggaggatagagcaagaattagggatcctagacttatgcatggagagtttttctctacccggttatctcagaaatcctgtaatggagccgtctttccagaggtgcagaacaaaatgggaagctgtggccattgtgtagccattgaaggctagcccatggtcccctcacagcttccatgggcttctcccgagcatgtgcacgtatgatgcacccattgcatgtatacgtacatgcacacatttctggtcaaaaggttgatgattgataaaactgacaaaagctccaaaccccacaaatgagcacagcgttttgtaataatgagcatgaccaaaatgggaaaaaatagggcacatgagggatgagggaagaaaaaggactccagggcccagaagattcctaggcttccttagccacctcctcctaaagtaggggtaataagtacatggcacatgtgccagcccttcccctgtgatatagttgggatatttgtccgcacccaaatctcatgttgaattgtaatccccaatgctggaagtggggcctggtgggaggtgtttgagtcatgggggtggatccctcatggcttggtgctgtcttcctcatagtgagttcttgccagatcaggtcatttaaaagtgtgtggcacctccccattctctatctctcattcctgcttttgccatttgaagtgcctgctcctgctttgctttccgccatgattgaaagctccctgaggcttcaccagaagccaagcagatgccagcaccatgcttcttgtacatcctgcagaaccaagagccaattaaactgcttttctttataaattacccagtctcaggtatttctttatagcagtgcaaaaacagcctaatacaccctatctatacacacagcagacatcactactcaactgccatgttctttcccacagaaaacaagcctgatctcaggattcttctcatcaaagtgctccaggctgccaattaccaacctattagcttttactcatgagatgaaaatgatttgccaggccgggtgtggtggctcacacctgtaatcccagcactttgggagtccgaggcaggtggatcacttgaggtcaggaattcgagaccagcctgaccaaaatggtgaaaccccatctctacaaaaatgtaaaaattagccgggcatgctggcactcacctgtaatcccatctactcaggaggctgaggcaggagaatctcttgaacttaggaggtggaggttgcagtgagctgagattgcgccactgcattccagcctgggcgacagagcaaggctctgtctgacagaaagaaagaaagaaaaagaaaggaaggaaggaaggagaaaataatttgccagcctcagcttgagcccaggagttcgagacaagcctggacaacagggaaagaccctgactctccaaaaagctttttttaaaaatagcgaggtgtggtggcacatgcctgtgatcccagctatttgggaggctgaagcaggaggatcacttgagtccaggaggttgaggctgcagtgagccatgatcacaccaccgtattccagcctaggcagtggagcaagacccgtcctcaaaaagaaaaaaaaaagttggaaacctgatacagtcaccatttttgtcaggatccctcttgcttgttctgggttaggttcatcacaaagctgcttagatggacttggttattcaagtaaatattaagcgctaactgtgtgtaggatgatggattgggacacaactccatatgctttttatttccattatttttataactttctcttatattgatattttagtaacatggtaacaaatttaaacaatagaagaaagtagaagttaaaagtcagtgacagttcccacccattccccagttccctcaaccactcttgtcaatctcttctttccatctccaaagatatccagcatttgcatggatccagtccagtttgtaggcagttggtagcatgccacgcatactcttgcccttgcttttatcactcatgtcttgaacagcattttatgtcagccctccagaacttcctctttctttttaatcattacagagtattgcactgataaatgtacctaacattgagctaacaagttgctgttttttgttttggttttggttttgcctattaacatgcattaatgtcatggttagccttttgtaattataatcgatttattgttgtatatgtccttgttgtatccatgcaaatatatcagcaagattagttcctagaagtggaattcctgggtcgaagagtgttatagcagtcctttggggctgctataacaaataccatacactgagaaacttacaagtagcagaaatttattgctcatggttctggaggctgggaagtccaaaatcaaggagccagcagatttgatttggggagggctgctctctgcttccaagatggcacctacctgtggcgtccttacctggtggaaggagcagacaagctcccttagggctctaataatttttctttttttttttgacacggagttttgctcttgttgcccaggctggagtgcaatggtgtgatcttggctcaccgcaacctccacctcccacgttcaagcaattctcctgcctcagcctcctgagtagctgagattacaggcatacgcctccatgcccagctaattttgtatttttattagagatggggtttgtccatattggtcaggctggtctcaaactcccgccctcaggtgatccacctgcctcggcctcccaaagtgctggaattacaggcatgagccaccatgcccagcctctaaaaagaacactaatcccattcatgagggctccacaccggtgacctagtcacctcccaaaggccctacctgttaatgccagcacactgggattcgattacaacacaaaaattttagaggggcacaaacattcagcccatagctaagagtatgcatatttaaaacttgtgatggtttggccaaatcatccttcagaaaggacactcccatgaacattatgtattaggacgggacgggctatgctgtaggaacaattagtcccccaaatcttagtatttaacacagcaaaggcttgttttttctcttgcgtcacatctgatgcagatggggtggctctctaagcagcatcccagggatccaggctgcttccattgtgaactaagccagttggaacatgtggcctccactgttgccacagccaggggagagaggcctggatgaatgtgtgggaaaattttaagcaaagtggcttacatcactttcacccacatcctacctgtcagaaccagtcatatggcctcagcctgactgcaaaagagtctgggcaatgtggaggagcccctggccactcgatgagcctcacgtctctgccagtcggttccccagaaattcacccacacagtatattccagggcgttttgttcttcgctaattaaatatatgaaaaatggcgtcatgtagactgtcgttctgccctgcacgtctgtgctttctttgggcggttgccctccgcctttttctgctgaaatattcataggggattatgttcactccagacacactccagtggccttccccaaattttcccaaaaccccaaaaccttttgtggggaagccctaagacattctatattttggctgttacaggcatacctcagaggtattgcaggttcagttccagaccactgcaacaaaattaatatcacaataaagcaaatcacacaaatttttttgtttcccagtgcatataaaatttacatttacacggccgggtgcagtggctcgcacctgtaataccagcactttgggaggccaagtcaggcggatcacctgaggtcaggagttcgagaccaccctggccaacatggtgaaaccccgtcactactaaatatacaaaaaattagccaggcatggtggcaggcacctgtaatcccagctactcgggaggctgaggcaggagaatcgctggaacccgggcggcagaggttgcagtgagccgagatacatgccattgcactccagcctgggcaacaagagcaaaactctgtctgaaaaaaaaaaaagttacttttatactatactgtagtctattaagtgtacagtagtatgtctaaaaaaagtacataacttaaaaatactttatttgctgaaaaaaatgctaacaatcatctgagactttagcaagcgacttgtagtctttttgctggagagggtcttgcctcagtgttgatggctgctgactaactgctgaagagtagggtggctatggcaatttctttctttctttttattttttttgtttttgttttttgtgttttgagacagggtcttgctctgttgcccaggctggagtgcaatgccacgatcatggcttgcagcagccctgatcaccttggcaatgccccgacctcagccttccgagtagttggaaccacaagtgcatgtcaccacacccagcctatgtttttattatttgcagagacacagtctcactatgtttcccaggctggtctcgaactcctgggctcaaggagttcctgggcccgcttgggcctcccaaagtgatgggattacaggtgtgagccactgcacccagccacaatttcttaaaataacacaacaataaagtttgctgcatcaattgactcttcttttcatgacggatttctctgtagcatgcaatgctgtttgattcacagtagcacttctttcaaaattagagtcaattctttctaactctgctgctgctttatcaactaagtttatggaatattctttttttttttttttttttgagatggagtttcacttttgttgcccaggctggagtgcagtggcacgatctcggctcactgcaacctccacctcccagattcaagcaattctactgcctcagcctccagagtaggtgggattacaggcgtccgccaccacgcttagctaatttttttgtatttttagtagaggcagggtttcaccatgttggccaggctggtcttgaactcctgatctcaggtgatccacctgccccggccccccaaagtgtggggattacaggtgtgagccaccactcccagacaatttatagaatattctaaatcaagcttgtccaacccgcaggccacgtgcagctcaggacggctttgaatgtggcccaacacaaatttgtaaattttcttaaaatattatgagattttctttgcgttttttgtttgtttgttttctcatcacatatcgttagttgttagtgtattttatgtgtagaacaaggcaattcttcttccagtgtggcccaggaaagctaaaagactggacaccctgctccaaatcctttgttgtcattcacagcatcttcaccaggagtagcttccatctcaaaaaccactttcttgactcatacataagaagcaactcattcattcaagttttatcatgagattgcagcaattcgctcatatctgcaggcttcatgtctaattctagttttctcttattacttccaccacatctgcagttcatttctccactgaagtcttaaacccctcaaaatcatccacatggatccacttcctccatccacttcttagcatccacttcttctaaattagcatccacttcttccacattcctattcatgttgatattttcacctcctctcctgagtcacaaatgttcttactggcatctacaatggaaggttttcagtttactttgcccagatccaacagaggaatcactgtctattgcagctatagccttacaaaatgtatttcttaaataatgtaacttgagggtcagatatggtggttcacgtctgtaatctcagcactttgggaggccaagggaggaggattgtttgaggccaggagttcaagaccagcctgggcaacatagtgagacatctctacaaattaaaatttaaaaattagccaggaggccgggtgcagtggctcacatctgtaatcccaacactttgggaggctgaggtgggtggatcacctgaggtcaggagttcaagaccagcctggccaacatgatgaaaccctgtctctgctaaaaatacaaaaattagccaagcgtggtggcgggcacctgtaatcccagctacttgggaggctgaggcaggagaatcgcttgaactcgggaggcggaggttgcagtgagccgagatcacgccactatactccagcctgggtgacaaagcgagactccattcaaaaacaacaacgaaaattagccaggtgaaataccatgcacctgtagtcccagctacttgggaggctgagacaggaggatcacttgagcccaggagtttgaggctacagtaagccataatcatgctactgcattccagcctgggtgacagagtaagaaaaccctgtctcaaaaaaaaaaaaaattaattaattaaaaaacagacttgaaagtcaaaattactccttgatccatgggctgcagaattaatgttgtgttaacaggcatgaaaacattactctcctcttacctgtccatcagagctcttgggagaccaggtgcattgtcaatgagcagtagtattttaagcagtaggtgtcaacagtgggcttaaaatattgaataaatcatactgtaaacagatatgctgtcatccaggcctgttccatttacaagcacaggcagagtacatcttgcttaattgttaaggtccctaggagttttagaagggtcaacgagcattggcttcagcttaaagtcaccagctaccttagcccctaacaagagaatcagtctgtcctttgaagctttgaagccaagcattgacttctcctctctagctatggaagtcctagatggtatcttctttcaatagaaggctgtttggtctacatcgaaaacctgttgattattgtagccaccttcgtcagtgatcttagctagatccttgggataacttgctgccaattctccatcagcacttcctgctttaccttgcacttttatgttatggagatgtcttctttccttaaacctcatgaaccaaccaacgctagcagcttccaaattttctgcagcttccttgtctctctcagctttcctagaattgaagagagttagggacatgctctggtttaggttttggcttaagggaatgttgtggttggtttgattttctatccagaccactcaaactttctccatatcagcaacaagtctttttcacattattataatttgtgtgttcactagagtagcccttttcatttccttcaagaacttttccagccgggtgcggtgactcacacctgtaatcccagcactttgggaggctgaggtgggcagatcacttaaggtcaggagttcgagaccagcctggccaacctgatgaaaccccctctctactaaaaatacaaaaattagcctggtgtggtggcaggcacccgtaatcccagttacttgggaggttgaggcacaagaatcacctgaacccaggaggtggaggttgcagtgagccgagatcacgccactgcgctccagcctgggcagagcgagagtctgtctcaaaaaaaaaaaaaaaaagaatttgtctttcgcactcacagcttggctaactgtttggtgcaagaggcctcacttttagcctttctggctttcagcattcctgcctcactaagctccatcatttctagcttttgattttaagcaacaaaagcgtgactctttctttcacttgaacacttagaggccatggcagggttattaattggcctaatttcaatattgttgcatttcaaggaacaaggagaggcctggagagagggaaagagaccagggaatggctggttggtggggcagtcagaacacagacatttatcgattaaatccattgtcttctatgggtgtggtttgtggcaccccaaaacacttacaatagtaacatcaacaatcactgatcacagatcaccataacagatataataataatgaaaaaatctgcactattgcgaaaattaccaaaatgtgacacagagacacacagagagctcatgcttttggagaaatggcactgataagacttgctcaagacagggttgccacaacctttgatttgtagaaaacacagtatctgtgaagcataataaagcaaagcacaataaaatctgtcctgtttgtattcacaaaaacatataaaggcatgtgagtaataatataaaattagctgggtcaagatcgttgccagctgtggtgtggaatggattggcagcagttctgtgccatttcccaggctctctgtgcctccacctcctccctcattcatgaaagacaagccaagcaagggacaaaggtatacaatagttgctgtaaatgtccctatttcacctatgagaaaactgtactcaaagaggtttaaattccttgcctaaggtcataggacctcaaagacaataagcaaaagcaaggaaactgaacgcactcatagctacacagagattcattgctaactttgtcagacgttgtgccaagactctctctctttctctttctctccctctctctgtctctctaccaacccccccccaacgtatgtgtctctgcgtgtgtgtgtgtgtgtgtgtgcatatgcatgtatacacccacttttttttttataaaatagactgcaactggagatactggtgtgtcctattttttggtgcagcgtcataacataagcatctttctaggcaataaattaactttatgctggccttcttttttcagtggagtattaattaagcatcttgtatgtgcccaatattctgctggttctgggggaagaaggccagcctacaggaaacaacagctaactctttaaggcagtgcataagtccattcatttgcttcacaaacattcattgagccctgccacgtgccaggcactgtgggtatcgtggagaacaagactactgtccgaggcaagagctgggctcctcctagcttcctctgtccccctaacctcctctcacccacaggcattgctgggggtattttcctgggttggttggtttgttttgttttttgttttgttttgttttgtttttttgagacagggtctcactatgttgctcaggatggtctcaaactcctgggctcgagcaatctcctgcctcggcctcaccgtgcctggccgttgtttatttatttattgtggtcaaatgtacatagcataaaattgaccgttttaactattttcaagtgtacagttcagtggcactaagtacattcacactgttgggtaaccctccccactcttccactgcagaacccctttcatcttgcagaaccgaaactgtccccattaaacatcaaccccccggcccttcatcccagcccctggcagacacccttctgtctgcctctatgattttggcgctctgggtacctcatagataagtgagattgtatagtatttctcctttggtgaccagcttatctcaccaagcgtgatgtcctctgggagcatccgtgtggaagaggtgctagcatcattttgacttctcaaacatctcgtgggtgtcacctccccctctacctctctgccactgcctcgctcagccacctgctctctcctggacccttgcagaagggactgactgggctcctggcctccagtcctgccctcttctaatgtatttttcataccacttccaaagtgataatacattcctcttttgaaattttagatttggttactaaagcaatacaggtgtatggttaccaaaaattcaaacagtgtaaaagagaataccagcctgggcaatgtagagagaccctgtctccataaattttttttttttttttttttgagacggagtcttgcagtggtgggatctcggcgcactgcaacctccacctcccgggtcctcattcaagcatttctcctgccttagcctcctgagtagctgagattacaggcatgcgccaccatgcccagctaatttttgtatttttagtagagacggggtttcaccatgttggccaggctggtcttgaactcctgacctcgtgatccacccaccttagcctcccaaagtgctgggattacaagcataagccaccacgcccagtctccataaatgatttaagaaaaaatgtagccaggcgtagtggcacatgcctgtgctcccagctccttgggaagctgaggtgggaggattgcctgagtgtgggatgtcgaggctgcagtgagccaagatcatgccactgtaccccagcctgggtgacagagtgcgaccctgtcccccccaaaaataaataaatcaaagggcataaggtgaaaagaatcgtaacattatgtttttgtagctctgcctctgtgatggtgccccctgcatggcttgctttcactgtgccaatgcaccacagttacccagcctgccggctctgataagatgctcgccatgcttctcccatgctggacttgggccacgtccttggccatgaatcttggtctatgtccaggtcggttctgaatgagccagcagactcctcccggggctgcccggctacatggttgagggcatcctggacaccagcttcagccacagctcctgaccaggcaggtgcagtgaagccgggaggtgtaggtcagttcctacctctccaacctgaggtcctgcacttcctgcagctgttggaagggatcgtatccaatgggagcaagaaagtgtgctcccccacagccccactcaggcataaagggccgaggggcagccaggcctgtcctggctagggctggctcagagtctgtggcagccccacccctgccaggctggcccttagccccaagatccacctatggcactcgcccctttacagctacgtggacatccactgacactcaggtgacacacctttgcctgcttctactcagtcttggcagcagttggacaaaaggaaatcaaagatcggttctttcttgggagaggaagagcaagctggagccctggggtgctcagatgctcttgggagtaacatagccccatagccccggggctatactgggtgcaggggggtggaggtggtgggggagctgcagccaggcattcattcacttcccgttctttcattcctgctcttcttttgctcactgactcattcagcagcctctgggctgggcgtttactctcctgtcaggcaacacactcctgattgggtggccttggccttcccaagctgtctctggctgtccccaagtgaaacggaatctgggctggacaggccaccggatggacaagctcttctcatctaaaaccaaggcagttgacattgtgggctaaatgataagaacaaaattaaaaaataaaaaccaggcaggctggcataggagctccatttccctgccctactgtgccagtggcctgggggctcccctgccgcctctctccactctgcagattctgagaaaactcacaaaagagcccactccaaggtgtttggcaacaaggtgggggcagcctcccagcacccagcacacatggagctttcccgcagtgggtttcagcgctcccactctgcctcggagctactctgtcaccagctcttgccctcccttggctcctctttcccatgcagctcctcctccagctcgtgggaaaggccgagaggccgggccagcaacagctgagcatcccctcaacctctccctaccccaccccaccccactgtgctcttggccccaggcaggcgaggggagtggagttttgctgcctgatgcaatgtctggcagggccgtcccttatcacagccgacttgctgggacccccaccttccccgggggaggccggaacaggccgcagtccattttgggcctcagtggaagggcctggttggaggccatccaagtagaaaactcgttctctgggaggcaccttgccaagtcacgagggaggcctgagcagaaagacccctgggggagagaagggagggaagccgaagcctcacttgctggggcttgcctggcctcagctcgcagccccctttttccacagcgttctctccctcacatttgtctgcagatggcttaggctgttttctgccctcccccttgttaccccacagctgtgagaggctggatggaaacaagaattcaagagactaaagttatgtgcggtcccaagtgtgaagttttgcccacagtcggtggccatggttcgcaccgtggtcccagcacacgccctcagcatgcacctgtggcccacacgctcatgctcacagccactcatgtatggagcaactgcctttttttcttcctcttcatatcttctgtcaacttagaacgattaagcatcttgcagtaggctcaatgctttgggaaggacattgattcgttcattcattcattcattcattcagcaagtatttatgaagcacccactctgtgccaggtacagttctgggcactggagatgcaagggtggagcagacagatgaagctctcctctcccggagtcaacgttctgggggatgagaggccatcagcaagtgcatttccatctatgaagggagtaaagcagggcgccgagagggaaagtgatgggggtggcccacattaggtcaggggtcagggaagtactccagagctgggggggcatttgagctgagtcctgattgcttagaaggagccagccagagcagagcagatctggcccgggcagaggtaccagctgatgcagaagcccccaggtggggagtggcaggaagggccagggtgggggtgttgggagaagaggtgggaagggtgagcagggtctggatcttgaaggcccttacagggcttttattttaccaagtagtgcatagagtgtttgaagcagaagctgccttattgtctgtgcctccgagaagtttccatgtggctgagaagctgggtggcagcacagttataatcagtgctcaggtgttcccctgtctgggtggctgcccacatgtgatcccatagaagaggctgggcctgaggaagccagggaagcaggagggggtgtggggaggccagcaggggtgtgggcctcagcggggagggaggaggtgatgcagcatggaagatgagaagcccacaccagccacactaggcccccaggagattgtggacgccgtcgggagcattattcggtggaggggtgcggggcagaagccagatgagacagctgggaggtggcaggcaggtgagaatgtgagacagagggaggacagtgatttgagaactgtatcgtaggtgggataggagtccacatcccagccagcacctagaaggttgggctggctctgcccagggcctggcacgtggtgtgcactcaccagatggtcgccgccctgaaagaactcagcactgtgcctcttttcctgcctctggtgtttgctgtcaatatgcagagtgctggacaaaactgggccaagggagctgtcccactgcctgctgccctcaagcagagctgacctggcacatgcctctggcatacttcctgttggccctggcaccctgcaaagaggcccccagtgggcccaagcaggggataccacccgttccttgggctgttatgtagttgctggggcattgaggggatgaaaggtttttttgttttttgggttgtttttttttttgagacagagttttactctgggtgcctaggctggggtacaatggcatgatctcggctcactgcaacctccacctctcaggttcaagcaattctcctgcctccgcctcccaaatagctgggattacaggcgaccaccaccacacctggctacttcttgtatttttagtagagacagggtttcaccatgttggccaggctggtctcaaactccagacctcaggtccacctgccttggcctcccaaagtgctgggattacaggcgtgaaccatcgtgcctggccggatgaaaggtattgagtactaggggctaggagggaccaagagaaggaggaagagatttttcggttctacccatgaactaagcaagggaggcaggcctagcccttgcaccatggaagtgggagagaagtgatacaaaggtgtatctgatgtcacaggtgtcacaggcctgcttcttgtaaagggcctcctgcatggtgagttctgcgtggggctttgctgagtaacccccatccgggctctatccccttccctcatggccctgtgacttcctggcaccatgaccctctccccgcttctggctctgggaagctccaaacctctctcacctgcctgcccacctgcctgctaggtttccaaagctaaacagaggggcagctgtctgggcagggcaagggagccaacagcctgcctgggtttcctgtccaagtgtccagctttgcttcttcctcttagggcagcgtcaagaaggatcttaggaaagctgtgttgctctggggatgaggaggctggaacagcaacttaaaaatagaaatagtccctggaagggagggaaggagaaggttcagaggcttgtcatttaggcaccccaacttctataccttaccaaggtgccaggcccagagggaagggggtagccagggcagctccccgacccgcacctgccttttcacccctctcctatttcacaagcatttaccatgcatcaacagatatgttcctcacagcacctttatcagcagggactgcccttttcatgctacaaacaggcccagagaggttgtcacttatacaaggttgcacagcatggtagagacacaggaaggactagagcccaggacttctaaccctagctccttctgcttccctcacatcatcagctccagacaacctgagattggagaggacagaaagtcaggatttcaacacctcgtactctgaaaactcagtggtggttctcaccctgtcagtggggcaggtggcctcacaccccaccacaggctaaacagggtgcatgggggacgtagccccactggccattctacacattcatgccaacagctaccaggcaccagcctcaccattgatttttggacagctggtctgtgccaagtgccattctagatgcgagtcctgactttggggcgcttgcattctgggaagggagatggtcagccagaaagccccaccataggagctaggttgggggtccccaaggtacaccaagaagctcaagtgacctggacctgggaggggtggccagaggcttctgctggaggaaccttaggtcagttacctaacctgtctcaacctcagtttcctcacctgtaaaatgggctagttgctgcctcacagggctttgctgaggatttgatgagtgcaagtgcttagcatggcacctggcacagagaaatatgcactcagtaaacttaagctgcccatatcattggttggccctcccaaccagagtgcaagccccgggagggcacagaccataccttcttgttcaccgccatattttcagtgcctaggccagaagccagcacaaggtaaatgctcagaaaatattaacttaataagttcatgagaaaaggcccaggaaaattaggaagaggcaggactattccagttaggaatagactctcctatgccaggcacagtggctcacacctgtaatcccagcactttgggaggccgaggcaagcagatcacctgaggtcaggagttcgagaccaacttggccaacatggtgaaaccccatctctaccaaaaaatacaaaaattagctgggagtggtggcacacgcctgtaatcccagctactcaggaggctgaggcacgagaattacttgaacccaggaggcggagattgcagtgagctgagattgcaccactgcactccagcctgggttgcagagcaagactctgtctcaaaaaaaaaaaaaaaaagggaatagactcttctttctgcagctgtatttgctctagctgtaaacaactttgtagccaagtgcagtggcacacctatagtcccagctactccggaggctgaggagggaggattgcttgagcctaggagttggaggccagcctgggcaatatagcaagaccctgttagatattatctatttagataataataatgacctgtaatcccagtactttgggagaccaaggcaggtggatcatctgaggtcaggagttcaagaccagcctgggcaacatagtgaaaccccgtctctactaaaaatacaaaaattagctgggcgcagtgatgcatgcctataatcccagctactcgggaggctgaggcaggagaattgcttgaggcagaggttgcagtgagccaagattacgccattgcactccagcctggacgacagagcgagactccatctcaaaataataataataataatgatacatactatttcagtcgagggtcattttttcctttatccatctgttgttcaccaactgtgtatctcttgcctggcccaggattgagagataatgaggggcccagatgaactccctgtcctgcctgaagggatgttcagtattgaacaattgttgctttatggctttatgacaaagtcccaggtgctcatgataatctttgtacagtggtggggctgtagggagccctaacatagcctgggggaggctgcctagaaagtggagacctgaaggctgaggccatgttaaggatttaggtagaatttatgcgctatgatatttttttctttcgttaattttttataatttacgtatacacatggtaaaatgtgtaacaaggcacagtgttacatagcaaacataagcctcactccaccttctctctccacctacctgtccaccttctagatgcagccattgttaccaggccttgcgttttcctgcagccagagtccatttgtatcccgcatctatattttcttcccggcatttgtttctgaatgggagcttgctacatcggagtttctccaccttggatgatttgtcaccccccaccttcccaccccaggagacacttagcaatgtctggagatatttgatggttacagatgagcagtgggggccaggcgtggtggctcgtgcctataatcccagcactttgggaggccgaggcaggtggattgcttgcactcaggagttcaagaccaggctgggcaacatggcaagaccccatctctacaaaaaattttaaaaattagctgggtgtggtggtgtgcacttgtggtgactaaggaggctgaggtgggaggatcaattgagcctgggaggttgaggctgcagtaaactatgatcgtgccactgcactccagcctgggcaacatagtgagaccctgtctcaaaaacaaacaaacaattattggcaattagtgggtagaggccaagactgctgtcaaacattctataattcacaggacagtccccacttacctggtggaaaatgtcaacagtgctgaggttgggaagccccgtcctgcataagcacagggtctgcacctttgtgtgtgtgtgtgtgtctgtgtgtgtgtgtgtgtgtgttctcatgtattttctggatcattcacatttatacatccacctcattattctttgtggccacataaaaatccattacctggatgctccaccattttcatttaggtgtttgcactctttttgctattataaacacttatgctacaaaggttattcttttccgtgcacaggcctttgatgtgtgaggtcaagggagaaactgatggaggtgggatggatgaacccgatggttcattagcattttaaatgacctattaaagagaccttcagtgtctctggggcacagtctgtctggagagtgggtctggggtcctggctgctaaccagggccgagatcctcaaaagtctggtggagagacatcctctgcattcctcgtgtacagacaagggtgttctgaccacctgtctctccgcaggacaagggtgtcccccacctgaagacggcaagctgggtcctgagtgatgcccctcagctgagtgtccaaggctggcccgaggagcccccacggccccacctttccccatggagaaaggactcactttgccccaggactgccgggactttgtgcacagcctgaagatgagaagcaaatacgcccttttcttggtttttgtggtgatagtttttgtcttcatcgaaaaggaaaataaaatcatatcaaggtgagggttgcaagcccaagtcttcatcttccgttcaaggtggggtgggtggggacagggaggtaactgcagggctctctgtggacctgcaaatgcattccttcaacgagccatccccaggccccttctatgtcccaggcagtggctcctgcacacgtcctcatgactgcacaggggtgagacttgggctctggactcaaacagcctgggttggagcccccccatgttggccctctacagctgtgaaaggttaggcaagatacttaacatttctgagtcttcggttcctcttttgtaaaacatggctaataatgggaccagcattgttgtaaagattaaatgagaaaatgtaaaagcatttagcccactgcctggcacatagttggtgtccagtatttgctggctgtgactattactgttaatttacctcctggccttgcattagcagcacatcccctatagaagtcttgatgtcactgagcccatggaaaggcaaggtcctagtatggatactctgatgggcaaggctgccaatgtgcagctgccaagttgtgtactgctcaactccaggggcatgtccctcaaataggctaatctgggaacgcccctttacccctttgaattggcagcatacagctatgtgcagtgggcctgttagatgtagaaagatttcttagcctgttctcctcccaggcacaagccctgcaagaaagcattagctaagatgggtgggtcagggattgggcaatatagtggacaccgtcaatccccccccttgggtcactgagcaaggaccgttctagcttgtgcctattgggttctactgcaagcccctacagctctgcacctgagagctttctctccactggcacactggcaagccggaagtactagggagtaactgtcccccccagatccccatcagactaagcctccgatgcccacacctgctcctagcagcacatccatcatgcacctctttcctcccctgcctcacttccccatccagtacttcctgtgatcatgtcccaaataaacttacttaaacacaaatccttgcctcaacgtctgcttttggggaaacccaactgagacaggttttggtgatctgcttggaggactgcttagggttgcccaggagacggggtccccagtcagccactgaccctgatcttctttgtcctcacagggtctcagacaagctgaagcagattccccaagctctagcagatgccaacagcaccgacccagccctgatcttagctgagaacgcatctctcttgtccctgagcgagctcgattcagccttctcccagcttcagagccgtctccgcaacctcagcttgcagctgggcgtggagccagccatggaggccgcaggggaggaagaggaagagcagagaaaggaggaggagccgcccagaccggccgtggcggggccccggcgccacgtgctgctcatggccaccacgcgcaccggctcctcgttcgtgggcgagttcttcaaccagcagggcaacatcttctacctcttcgagccgctgtggcacatcgagcgcacagtgtccttcgagccggggggcgccaacgccgcgggctcggccctggtgtaccgcgacgtgctcaagcagctcttcctgtgcgacctgtacgtgctggagcacttcatcacgccgctgcccgaggaccacctgactcagttcatgttccgccggggctccagccgctccctgtgcgaggaccccgtctgtacgcccttcgtcaagaaggtcttcgagaagtaccactgcaagaaccgccgctgcggccccctcaacgtgacgctggccgcagaggcctgccgccgcaaggagcacatggccctcaaggcggtgcgcatccggcagctggagttcctgcagccgctggccgaggacccccgcctggacctgcgcgtcatccagctggtgcgcgacccccgggccgtgctggcctcgcgcatggtggccttcgccggcaagtataagacctggaagaagtggctggacgacgagggccaggacggcctgagggaagaggaggtgcagcggctgcggggcaactgcgagagcatccgcctgtccgcggagctggggctgcggcagcccgcctggctgcggggccgctacatgctggtgcgctacgaggacgtggcacgcgggccgctgcagaaggcccgcgagatgtaccgcttcgccggcatccccctgaccccgcaggtggaagactggatccaaaagaacacgcaggcggcccacgacggcagcggcatctactccacgcagaagaactcctcggagcagttcgagaagtggcgcttcagcatgcccttcaagctggcccaggtggtgcaggccgcctgcggccctgccatgcgcctcttcggctacaaactggcgcgggacgccgccgccctcaccaaccgctcagtcagcctgctggaggagaggggcaccttctgggtcacgtaggggggccggggccccgtatgcccctcctcgtgaaaggcctgccccgtctttctgccgcagccctcgcagagggcgggtgcacagcgccatgagcgggcagcgcctcctgtagcagtagggcccccagccagcgctccagccaaagcggcggccccagggttaattgcggagaacaggacagtgcccggtccccttgagggccatcacacccagacccaacgggttgcagcctcctgagcaggcctaggcaggcccgggcctgttggcaagcttcgatctcacacacacagaaacatacattcgtgcctggagaccctgcaggccagagtccaaatatttaacaatcagaaggggcaaggctctgaccagtgacagtcagacctcctgctttatttggtgttaaccgtttcttgtctggatggtgaagtctggaatctgggtgggtccttggaggaggggctaggacagccgtgggtgtcaaaggtggcatttgaggctcgtttgaggtgacagtggctgtttaccaactagtacagagcgattcagcgttttcatgaatgggttggctgtgctggttactgatgaatatgggccccttatagagctgcaaaacacacacatgcgtatagacatacatacatgtacaccatacatagacaagcatcataaaggcacaagtgcacacacatctatgcagacaagcttcctcgctgcttatgcccacagggtttttctgtatgacacacctcagaggagcctgtgattaacatttgtaggattatttcgagggcagggcaggggaaagaaacgcgttaaagggccatgacatgacacagttccctggccgggtttggactgaacagtggattcagaactgcagcgttcaaagcccctgcccgccttagattctcatggctacctcctctgacccatccacatccttgcggctggcaggcaggatgttttgaaatggtgcagccaaaggccccgtctagcttggctggctcccgaacatgtccatatttgaaggctgcctcaggcctggcaggcagaagcagctgtggtccctggaggcaaaaggcagctcacggggccttccatttccagccaggcctcatctggggtagggccaagaggaaagtacagagtgcccgtgggggagaagtcccaccaggatgccccccctcccctgagaagcccgccttctccctcgtggacaggagtcagccagttggttgctgtggttacagccagtgcctggaattcctccttagggctctgggaagagtattgcttaacgcaggatgtgctgggtgttttgtttcgggcttttatttatggcttggtgtctttcttgttttatggctgtgtttttgcttttgtttctgtaggagcgcctcttccaagcagtggaggcctgagggcttgagggaggctggggaaaaccagcagggagcacttggctcctggcagagggagaggacaggaggaggagccttccccaggaggaacgaggagaggtggccacgtggcaggccacagtgccctatgggcttttctgtttgaaccccatgtgggatgaatctcaaagccaccagcgttcttgcctagtgtccagagcagcagagatttgcagccctcgcccctccctgagaagaagctggatttgaaaatccctcacaggccctaacatgtttcctgggtgggcaggggcctcatgacaagcgacaagtgtacccagagtagaaggccttccccactcccacctcaaacccaggagcagaactcagtatccagagcttacaaggagctgcaagggtttgccgagggctgcccagctctgtttctggtttcctggacaatttctctgtcagatacggcccattgcaaacccagagggctgcattttgggttgagtaatatggacaccatggaagtacaggatctgagtccaacattgccatgggggagggaagagtgtgtcctggcaggaagccaccattggagaaggtgaggccagtaaccatctcatgggattcgctataatcagcctatttgagctgctgggtctctgtcactgtggactccagtcattcaaggaggtctccactcttgggttttttttattttcttttcttttgctattttgcctgaacaccccaacactcttggttttagagtccaagagtaagttgtgcagagacatggttctaatttggagttcaaaggaacaccagctctgaaaacatgaccgtggggccaggatgtttctggcaggcccagaagtgctggccgttcttccccagcctccccactgctccctcctctgttccccatgtggaggtcgggggggctgggactggggagggggcagccacctccatccaaggctcttcctaggggccctgctaatgtggacagcagactttatccctccttcttactctgggccaagacctcccactccgccctctgaggatggtaccaagaatgggcctttgggacttctcaggacattgacaatgtgcacactgcaggttgacttaatttatttattttttgaaaagaagagacagaaaataccttattatctgcagggactcaaagctgtacccaaatcaagaaagacaaaataacaatagaaaccattcacacactccgttcatgcatggacaccagaagacgattcagaacacaagaggagaatgagctggagcgccagcaccacgatggccccaggacgttgtttaagatctgagatcccttggtttctctcttgttgatctgagatgctacatcagggcccttgctgctgtattacctctgcccgggtgtttgagacaggtcacaagcgcgtggatgtttcctggaagtgtattcccctggggctcagcgatgctctgggaacccttggggtttggggaaggacagtgtggtgtgactattggcttgaaacgttatggatatggttggagtcacccatgtggatatgattttcagcttggagctgggatggagaagatggaagcactggtggccgggcctctttttccagcgaggccagccctggcttctcctctgttccagcttgtctgccagaagccttcccctgcaaggtgcccacctgcccggagacagagggagcagctgaggcctctctccactggccgccagcctccctagcacaaggggaccattcagcaatgagtgtttactcatgttctttcttgttgatgagttctgcggcccagcatatagaaatggctcagaacgttccaggccttggtgagacacagcagcgtccaatgctcacaggctgtccccactctgcctgttcccatcttcccctcgggacctgtttataaattgaggaatggatgagggccctggagggtccttgggagtagttagtggagggcaggattctcaggtccccatagagagggaaagagaagaccagatgtgcatagaagccaatctctgtcacatacaccgcaggtggtcaccgagttattttccaaaagctgaggaacataaagcaaatttaggcttttgtccttctgcaatacatgcacttgaaaataaacagaaaagagatgtttaataacaagtttacttccggtctgctagcaccctcagcctgggagctactgccagaggctggcgtagtggggcagctgctgaccaaaccccacagaacagagggcaccaggcatcacacgacatctttccctcccatctctgccatctgtctgtctggcaatggaaggagcttcagcaggaggtccttcccagaaggttgattcttggcctgggtggtagaggagatatcctgaccctaaagtcttccagccccgggtcatcctctcctatactagggcctattgaccgtagaggccaggtgcggtggctcatacctgtaatcccagcatttggggaggccaaggtgggaggattgcttgagcccaagagttggagaccagcctgggcaacatggtgagaccaattgactgtagggcttgtcccttgctaagacaggagcagaagactggatggctgtgtcctcaaggcagtcccctcccatccccattcccaaagtcagaaagcgaagccagatctcaagggctgatacctgaggcaaggagagctaaggggagagaaattggggctgagtggaagcagatgcctgcacaagccaagtgtgtcttattgatctgtacaagctgatagaaggaccatctgctgaaatccagggctcctgagttggtgggtttgcttgtgaagcttctaggacaaggcgcagccagatggaagggagagggtccagggcttcctaaatgcagccgcatcacctgtcaactcgctgcagtttcagagacagtggaagctgctctttacctcaaaagcacaaagcagaattggcaacttcacatgtctcaagagctccaagatcctttggtctcgtgtcctttggcaccccgtaactggactggggacaaatttgttacgtgtttccaaggctacagacatggtgccatcctcacaggcctagctcatgtcatggatcaggtgctttgctggggggatacaatgacccatgtggtctgcgtcttctgccattggcttgaactgggcaccccctgaagtctccatctcagctgtatattctagtccaaattttcctggctcccctgctccctcccaggtcctgcacactgtctttttgccaacacctcagccctgtttgctatttcatgtctgcatggtacgagacaccccttcacagcatacactgccatggtatgtacatatgcatccacgtgtgtgtatgtgtagcatgtagctcattctgctcagcctctggcgccgttccacattgctcccagccccattgctgtcactgtcgtcccagatgtccttgccatggccacagacaatctgccgtctcctggaaacgctggggctgcccttcagagagctggcagccccagcagtcagggcctgctttgcagaatagaatgtgaacccaactcctgatggcctacttgacttatttaattaaagatgaaatcatgcaatgagcaaaacctgcagcgtgtctctgccttttcctttgcatttgttctcagcagcaattgggtcataatttttttttttttttaattaacagtggtagaaaggaggtgacttccagcatgaagcaggacagagaatccccctgcccattcccaagggaccaaaggcactaggggaatatggggcaggatgaatgtaccttgcgtcaccaggctggcagagctgatggggactgcgctgagcggagagagagaaaacccaggtatttgggggcagagacaggagtgttgggccagcggtcagggggcctggggatgagtcccagctttgccactgtctggctgtgtgaccttgcataagtcacttcccttacttggacaccagtttccttttagaatgaaggtgtaatcagttgttcacaaacattgttcccaaaaagccccattagggattcaaaagtcagctgaaagggcaggcggcaccctctcaacaagagtcactgtgcgttttgatctgcttcacgtgttcagatagcatttcagatttatttggccttcaactaaatctccaaaaacacataagaaggttgccaaggaccctttcagctaagaaattgaatggagtcctttcaaattgcagttacatccgtcataacaactttagttcttactacatttcagccctgcttgtctcccaagagctgcctgcagagcatgggtgtttccctggggagaagggagagagctcattttggaacacagaagccagagctggtggggctttgtgggtctcaggacacaggggtagcaggaccagcagctgcaggaagaggcagaggagggctgagcacggggacagtggctcctggagtgagggaatgaagactcagagaggctcaatgtgagggaacaggcccccctccccaaatcttaacctgtgtctctgccagttcacccagtccaggcttgggaagctcaagccagctccctcccacctcttaaagtatttgagccggtgcctgtcatcccaacctgaacagaagctgcccaccccagtcaggtgctattgctgtctcccctacgctgggggctggatatagttagtttaatttctgggctgtgtttcctaccacaaatgaccccctggggaaacaaattgcactaatcacagagcagagaagcctggacacctccccacccacccacccctcagctgccaggccggaaccgtctctcctcctcctcctttcccccacccccagaccccttcaggatcgtcagtcttccttcctacaccccaatttactcaaccctggggaggagtcaagcgccccgtgggctctctgggacagggagagttggctgggactctctggaaagcagtttgatcagcagggggctggggtcagggacctgtgccattgcccacagagccctgccaggcccagcactggcccagccctggagcctgcagcagcatcctcaagtgtgtttggagaaactgtggtcacaggattgctcttgggaagttacagtgcacatttgcgattacaggctccaggtaggccgctttcctttgactcacccagcattaaggattaccttctagaaagaaccatttttatggaattcgtttatcatgaaaaacttttttccaaacaacagtctttttcaagactctggccttctttattttttaagactctgtcacccaggtgggagtgcaatgacgcaatcacagctcactgcagcctggacctctcaggctcaagcagtcctcctgcctcagcctcccaagtagctgggactataggcatgcaccacacttgctagcttttttgtattttttgtagtaatgggatctcgccatgttgcctaggctggtcttgaactccgaactcaagcaatctgccggcctcagcctaccaaagtgttgggattataggcatgagacactatacctagccaagactctgtcattctgcaaaagagttagtagctaccagcagcctgcagctggaagtgtgtaggaccaaaagccaccctaagcagccattaggtggtgggtgagttggctgggagaaaaaatctagggttgggtttaaggcccatcccccttcacaccatcctccccgagctgccaggctaagaggatccctcagagattgcagcagcctcaggggcactgagagccagggttcggggcactgagggccagggttcaaggccctgagacttgctgtccccaaacctccctggttcttggcttcctcaactcaacccacgctgtggggcctctgtggcatgacccaaaagatgtggaacaccccacagagagtgggaactctggagaaccaggccaggtataaacaccacgggatactatttatctgagaaataggggtttgagattgctcttaaaggagccatttctgaaacagtgggacaaaggttaccagcagtaaataggtttcctggaggtgtaatcctctagtagctagtaaaaccttcgctgaaatctgcgggccgtttattggaagaagaagcaggtagtaagtgcccagcaggagaggcccgcccaagaaaattagaagggggaaaaagaaggaagggagggagggggaaggaaggagagggaagagaagaggaaagaaggaaaaaagggaggaagaggctgggcgcggtggctcacacctataattccagcactttgggaggctgagatgggaggattgcttgcggctaggagttcgagaacagcctggtcaacatggcaagatcccacctcttaaaaagaagaaaaagaaagaggaaggaagggtggggaaggttgggaaaggaagggagagaggaagggagggagggtgacagtgggatgcatttcatgccaatgcagaggaggaagacagccaagttgttgaaaagaacacccttggggatagccacagccacagtgcccaagagtttagagggtcaggccaagcccaggtacactcagtcctgtacacctttggccatggggctaatttgccccatggatatgtggttcacaccatgtttgtttctgtttttaacaatcggcaggccagcacggtggctcacacctataacccccagcaccctgggaggccaaggcaggtggatcacttgaatccaggagtgtgagaccatcctgggcaacacggtgaaaccctgtctctacagatacaaaacaaaatattcaccgagtgtggtggtgcgcacctgtagtcctagctactcgggaggctgaggtgggaggattgcctaagcccaggaggttgaggctgcagtgagctgtgatcacatcactgcactctagcctgggtgacaaagtgagactctgtctcaaaaacaaacagttggcattcaaggacaacactaaaaactgaaggggttttatataaaaggcagacttggctcctcttgaaaatcaggtgtcttggtttgggttacaccggcagctgacactgggacaagggcaaaatggtttctttaggagctgtggatggtccggcaagggaggagaggaggcaggcagccagcagaaccgtgccgctgagccagctgccactttggggaactggagccgaatccctctgggaaccacagtgcaaagcaggtgccttggactcactccaccccggggtgaggagagggagtctgaaggttcctacaccagtgcctgtcagcttctggctgagactgctcttggagggtattaatttcacagcacagccgctggccccagcagaacagcattcccaaactctggaacaaaccattagactcagaggtaaagatacaggtggctagaagtttccagagcacagtaaaaggttaggtgtaggggatagggcacggtctgacaacatctacgccctggggtgctctcattcccacaggaaaaataggctctggtgggagggggcagcagcctttttaaccggagaaggtcagggtccccacctgcccatcccccggtctccccaattactgaggcagcaatgccctttgccatgtatcatagcacttgcactgatgtttgacttccaacacaatatcttctctgtgaattcatgtctgtccaacatgagaaagtgtcaggccaagagggccacggctcccaagccattcactgtgacagctccccagccactacgggtatttgggtttgcagccctggcttaaagtcctggaatgctaagggctgggctggctttcctgacaacattcactctaggcttctttttttttttttttttttttgagacagagtcttgctctgtcgccaggctggagtgcagtggcgctatctcggctcactgcaagctccgcctcctgggttcatgccattctcctgcctcagcctccccagtagctgagtctctactaaaaaaaaacaaatacactctaggcttcttaatgcttagacctcaggaatgaggtggttgctctccctggtctgcacaccatggaactcaacaccccctggccatctctcacggcacctacctagacttctcccgcccacctaagcagatggccagaataaacactgaagaagaggacagctggttttgcccacctggaggtgaacagggctaggcctgcatccagtccacgccagagctgccccctggaatgttttcaactcatttctgcctcggtgcacacagtggggcatgctcctctgtggggcacacagaccccttgggcacgcgctcactgtgatcagcatggcagttcccagtgcctgggctcaaatgcttctccattctctcccacacaagaaagctcaacagagtgacagaggacactgtgtgtgcaaagacctggaggataaaggggacatgggaagtttggagaccaagaagcagtttgctctggccgagatggtgatgagacaggaagctggagaggaaaactggggcccgaatgtactaagaaaaagaggtttgacttgctcctaagagctatagagagccattgaaaggcagagtgaagcagagtggtttggtctgatcaactgtattctattttacagagagaagagtgaggcacggagagctgaaatgaccagcagcgtcagaacatgaacccacgccactcatccttggattccaagcctagatcctcctgtcctatcctttgcctcacacctcccacccaatgtattaagaccccatgggctgtgtgctatggtttgaatgtcccccaagattcatgtgttgaaacttcatcaccagtgtgatagtatcaagaagtgagatgtttagaaagtaaatcatgaggagacagccttcaagaatggaattagcagctgggtgcagtggctcacacctgtaatcccagcactttgggaggctgaggtgggcagatcatgaggtcaggagtttgagaccagcctggcccacatggtgaaaccccatctctactaaaaatacaaaaattagtcaggcatggtggtgggcccctgtaatcccagctgctcgggaggctgaggcaggagaatcgcttgagcctgagaggcggaggttgcagtgagccgagatcgcaccattgcacgtcagcctgggagacagagtgactctgtctcaaaaaaaaaaaaaaaaaaaagagtggaattagcaaccttatgaaagggctggaggaaactagtaatcactcctttttgccctctgccatgtgacagcacagcactcgtcgtttccagaagaatccagagtaagacaggaagcagagaacatccctcaccagacaccaaacctgcagcacctggatcttggacatccagcctccagaacttgagagataaatttctattgcttagaacttgcccagtctgtggtattttagtatattaagttggtgcaaaagtcatgggttttttgccattactttaacgtaaaaaactgcaatttttttgcaccaacctaatagcaacacaattggatgaagacactgtgtacatgctatgaaacccaagccagaatcacaggcttctctctggagtcatacagggcaagccccagctctctcttgggtgctaactttccaaagtctgcccctgagtctgctcttctccacgcttgaatagcaacaatgtgtcctagctgtgggaccttggaccagtgacttgccctctctgagcctcagctagctcatgtgtagaatgggggataatatcgacgggaagggtagggtgctgtatggcgcatgcctgatttgcagtgagcctgaatcaacaaatactttgaagtctggaatggaggcccaagtggagcttatcatgcaacctagggccacatagaatgagtccctcggcatctgccccaggcaggcaggctgtaaacctggacaaatactgaaaggacaaatactgcaggacaatactgaaaaccagaattgaggttccagggaccaactctgagacaccccatggagcaattcccagagtttgaacaagtgagcaggggagagttttctcgttccttttgggagtgttcattcattccacttctgtatttttttaacattctctttcccctgacttgaggttgatttatttaagcagtttcccttccaagaaaaaatgccctctgcctctgtctctatcagtggagagaccgacacttagaaccaagaagaccctggtttaaatcagttcactcaagacattggctgatgggcagtgcttctccctccagccctggctcttgaggggtctggccagcccaaatagtggcatgttcacacttggcctgacccaccacttcctgacacatgtcctattcggctggggagcagggaaacagttgagaagacatgtatcaagacttgctcatggaagcaggaatccaagatgcccattacaggggaatgctcctgacatcttacttctagacgccagtgcctttctctttctctttgaggggtgtttaagcctcggtccctgacctcagcattcacatagcctgccactgtgcctgacccagcaagatcagtggttgaatgaattaattaattaatggtgataaagttctagaagcatttggaataagaacttttttttttggagacagggtctcactctgttgcccaggctggagtacagtggcatgatcatggctcactgcagcctcagcctcccaggctcaagcccacatcagcctcctgggtagctgagactacaggtgcacaccaccacagccagctaatttttttgtattttttgtagagaaagggttttgccatgttgcccaggctggtctcaaactcctgggcttaagtgatcctcctgccttgggttcccaaagttctgggattacagccatgagccaccacacccagccatgtctttttaaatacacagtggtgcactgtctttgcaaatgtcagtgtttgtatgacatggaagacaagagtgtggaatctggagccaatctgcctggtctcaagtcctggctctgcccatttcatggctgtgtggcctagggcaaagtacccagcctgtctttgctgcagtttcctcatctgtgaaatggggataaagctggtatctacctcatgaggttgttgtaagtattaagttaatgcatgaaaattggcgcatagtaagcgctcagaaatgattactgctatgctaagagcctggccggaggtagaagagggtaaaacaggaagttctaatggtttttctttcaagaaattgttactgaaaccacaggggttcgggctaggtcctgctgcttacaacacagaaagccaatcactaagacaatgaggattgccggggaagaaggcttcaactgggtaccgcatccaaggagatcagtcccaactctgtctccctgaccaattaaacttaggggtttatatagcaaggaagaaatgtaactacatctaggaaaacaggaattagggaggggtaaggaagaggagttggtcaacaacaggcaggcgttggcttaggaaatcatgaagggtgagaggtctggcatctcattgtccagatccagtgagtttcaatcagggaggcctgatggttggtttcctgagaaatgaactcagataagacaaatgtaactttgccaagtttcaagactgggaggtttcatttcaatatttattccaaagtagccataaatgtcagttctatgggataattgggtctgtttcaaaaatgacaagattgcagctggacacagtggctcacgcctgtaatctcggctctttgggaggccaaagcagacagatcacctgaggtcagtagttcaagaccagcccggccaacatggcgaaaccccttctctactaaaaatcacaaaaattagctgggcatggtggcaggtgcctgtaatcccagctacttgggaggctgaggcagggagaattgcttgaacccaggagacggaggttgcagtgagccgagatggcaccactgcactccagcctgggggacagagtgagactctgtctcaaaataaaaaaaaaataaaataaaataaaagaacttggcttttgatgccagtgatgctgtgcaaaggcagggaaacaccacatgaagagctcctagacaaagtctcctgttccattctagatgcaagcccaaaataaacacaggaataaagctcagacccagtggagatcaaagaaaggcaaacccaaataacagtgacctcttacactggcaatatttttttttaaaaaatagcaaaacctggctgggcgaagtggctcacgtctgtaatcccagcactttgggagccaagatcatgccactgcactccagcctgagcaacagagtgagactccgtctcaaaaacaaacaaaaaaaaagcaaaacccagtgctggtgaaggtgtggggaaacattcattcttttgatgggagacttctgaagggcagtttggtgacgtatatcaaacatcttaacatgtttcctaccatttcatccagcaaatccagttacaggaatttattttattttatttttgagacagggtctcgctgtgtcacccaggctggagtccagtggggcgatctcagctcactgcaccctctgcttcctgggttcaagctattctcctgcctcagcctcccgaataggtgggactacaggcacatgccaccacgccctgctaatttttgtattttgtttgtttgtttgtttgtttgtttgttttggtagagacagagttttactgtgttggccaggctggtctctaactcctggcctcaagtgatccacccacctcggcctcccaaagtgctgggattacaggcgtgagccaccgcacctggcccagttacaggaacttatcctaaggaattaactgtggctgaatgctaatatttaatgttattaaacattaaatgttgtttataatagtaaaaaactggaaaaccactcaattgctgaatgacagggggctggttacatcagtatggttacacatatgatggattctctgcagccattaaaatgatcatgcaggttttttcatgacaaaaatgtttaggatacattagatgacaaaagtgggctgtaaaacaacaagcgccatatgacctcatttttgtgaaatgaagtattatctctaatatgaatatatctgcacagataaatgattggaaagatagaaaccaaagtgttgacggccgggcgcagtggctcacgcctgtaatcccagcactttgggaggccgaggcggtcggatcacgaggtcaggagatcgagaccatcccggctaacactgtgaaaccccgtctctactaaaaataaaaataaataaaaataaataaaaatttgccaggcatggtggcgggcacctgtagtcccagctactcgggagactgaggcaggagaatggggtgaacctgggaggctgagcttgcagtgagccaagatggcgccactgcactccagcctgggggacagagcgagactccgtctcaaaaaaaaaaaaatgtagattaaacacaactaaaa

SEQ ID NO: 125 - DNA, 6964 bp, Homo sapiens
gccttggacgcggtgcaggaatccgccgccgctagccggctcgggcctgagcggggagggcgccaggcaggacctctcgcaggctcgctgcgcaggacggcgcccgcctggcgccgcttcccttccagcgtgccgaccggccccgcagcgcctccatccctccggcccgccccggagaagacgcacagctcgggccgcgcgggcgccggggccgcggaaccgcttctgccgggatcttccaggaggaaagcgaagttgcgagcggatgctgcccgcgccggaccccagccgcggagggtcggggccgccggtggagtctcggcggccggggacaagggtgtcccccacctgaagacggcaagctgggtcctgagtgatgcccctcagctgagtgtccaaggctggcccgaggagcccccacggccccacctttccccatggagaaaggactcactttgccccaggactgccgggactttgtgcacagcctgaagatgagaagcaaatacgcccttttcttggtttttgtggtgatagtttttgtcttcatcgaaaaggaaaataaaatcatatcaagggtctcagacaagctgaagcagattccccaagctctagcagatgccaacagcaccgacccagccctgatcttagctgagaacgcatctctcttgtccctgagcgagctcgattcagccttctcccagcttcagagccgtctccgcaacctcagcttgcagctgggcgtggagccagccatggaggccgcaggggaggaagaggaagagcagagaaaggaggaggagccgcccagaccggccgtggcggggccccggcgccacgtgctgctcatggccaccacgcgcaccggctcctcgttcgtgggcgagttcttcaaccagcagggcaacatcttctacctcttcgagccgctgtggcacatcgagcgcacagtgtccttcgagccggggggcgccaacgccgcgggctcggccctggtgtaccgcgacgtgctcaagcagctcttcctgtgcgacctgtacgtgctggagcacttcatcacgccgctgcccgaggaccacctgactcagttcatgttccgccggggctccagccgctccctgtgcgaggaccccgtctgtacgcccttcgtcaagaaggtcttcgagaagtaccactgcaagaaccgccgctgcggccccctcaacgtgacgctggccgcagaggcctgccgccgcaaggagcacatggccctcaaggcggtgcgcatccggcagctggagttcctgcagccgctggccgaggacccccgcctggacctgcgcgtcatccagctggtgcgcgacccccgggccgtgctggcctcgcgcatggtggccttcgccggcaagtataagacctggaagaagtggctggacgacgagggccaggacggcctgagggaagaggaggtgcagcggctgcggggcaactgcgagagcatccgcctgtccgcggagctggggctgcggcagcccgcctggctgcggggccgctacatgctggtgcgctacgaggacgtggcacgcgggccgctgcagaaggcccgcgagatgtaccgcttcgccggcatccccctgaccccgcaggtggaagactggatccaaaagaacacgcaggcggcccacgacggcagcggcatctactccacgcagaagaactcctcggagcagttcgagaagtggcgcttcagcatgcccttcaagctggcccaggtggtgcaggccgcctgcggccctgccatgcgcctcttcggctacaaactggcgcgggacgccgccgccctcaccaaccgctcagtcagcctgctggaggagaggggcaccttctgggtcacgtaggggggccggggccccgtatgcccctcctcgtgaaaggcctgccccgtctttctgccgcagccctcgcagagggcgggtgcacagcgccatgagcgggcagcgcctcctgtagcagtagggcccccagccagcgctccagccaaagcggcggccccagggttaattgcggagaacaggacagtgcccggtccccttgagggccatcacacccagacccaacgggttgcagcctcctgagcaggcctaggcaggcccgggcctgttggcaagcttcgatctcacacacacagaaacatacattcgtgcctggagaccctgcaggccagagtccaaatatttaacaatcagaaggggcaaggctctgaccagtgacagtcagacctcctgctttatttggtgttaaccgtttcttgtctggatggtgaagtctggaatctgggtgggtccttggaggaggggctaggacagccgtgggtgtcaaaggtggcatttgaggctcgtttgaggtgacagtggctgtttaccaactagtacagagcgattcagcgttttcatgaatgggttggctgtgctggttactgatgaatatgggccccttatagagctgcaaaacacacacatgcgtatagacatacatacatgtacaccatacatagacaagcatcataaaggcacaagtgcacacacatctatgcagacaagcttcctcgctgcttatgcccacagggtttttctgtatgacacacctcagaggagcctgtgattaacatttgtaggattatttcgagggcagggcaggggaaagaaacgcgttaaagggccatgacatgacacagttccctggccgggtttggactgaacagtggattcagaactgcagcgttcaaagcccctgcccgccttagattctcatggctacctcctctgacccatccacatccttgcggctggcaggcaggatgttttgaaatggtgcagccaaaggccccgtctagcttggctggctcccgaacatgtccatatttgaaggctgcctcaggcctggcaggcagaagcagctgtggtccctggaggcaaaaggcagctcacggggccttccatttccagccaggcctcatctggggtagggccaagaggaaagtacagagtgcccgtgggggagaagtcccaccaggatgccccccctcccctgagaagcccgccttctccctcgtggacaggagtcagccagttggttgctgtggttacagccagtgcctggaattcctccttagggctctgggaagagtattgcttaacgcaggatgtgctgggtgttttgtttcgggcttttatttatggcttggtgtctttcttgttttatggctgtgtttttgcttttgtttctgtaggagcgcctcttccaagcagtggaggcctgagggcttgagggaggctggggaaaaccagcagggagcacttggctcctggcagagggagaggacaggaggaggagccttccccaggaggaacgaggagaggtggccacgtggcaggccacagtgccctatgggcttttctgtttgaaccccatgtgggatgaatctcaaagccaccagcgttcttgcctagtgtccagagcagcagagatttgcagccctcgcccctccctgagaagaagctggatttgaaaatccctcacaggccctaacatgtttcctgggtgggcaggggcctcatgacaagcgacaagtgtacccagagtagaaggccttccccactcccacctcaaacccaggagcagaactcagtatccagagcttacaaggagctgcaagggtttgccgagggctgcccagctctgtttctggtttcctggacaatttctctgtcagatacggcccattgcaaacccagagggctgcattttgggttgagtaatatggacaccatggaagtacaggatctgagtccaacattgccatgggggagggaagagtgtgtcctggcaggaagccaccattggagaaggtgaggccagtaaccatctcatgggattcgctataatcagcctatttgagctgctgggtctctgtcactgtggactccagtcattcaaggaggtctccactcttgggttttttttattttcttttcttttgctattttgcctgaacaccccaacactcttggttttagagtccaagagtaagttgtgcagagacatggttctaatttggagttcaaaggaacaccagctctgaaaacatgaccgtggggccaggatgtttctggcaggcccagaagtgctggccgttcttccccagcctccccactgctccctcctctgttccccatgtggaggtcgggggggctgggactggggagggggcagccacctccatccaaggctcttcctaggggccctgctaatgtggacagcagactttatccctccttcttactctgggccaagacctcccactccgccctctgaggatggtaccaagaatgggcctttgggacttctcaggacattgacaatgtgcacactgcaggttgacttaatttatttattttttgaaaagaagagacagaaaataccttattatctgcagggactcaaagctgtacccaaatcaagaaagacaaaataacaatagaaaccattcacacactccgttcatgcatggacaccagaagacgattcagaacacaagaggagaatgagctggagcgccagcaccacgatggccccaggacgttgtttaagatctgagatcccttggtttctctcttgttgatctgagatgctacatcagggcccttgctgctgtattacctctgcccgggtgtttgagacaggtcacaagcgcgtggatgtttcctggaagtgtattcccctggggctcagcgatgctctgggaacccttggggtttggggaaggacagtgtggtgtgactattggcttgaaacgttatggatatggttggagtcacccatgtggatatgattttcagcttggagctgggatggagaagatggaagcactggtggccgggcctctttttccagcgaggccagccctggcttctcctctgttccagcttgtctgccagaagccttcccctgcaaggtgcccacctgcccggagacagagggagcagctgaggcctctctccactggccgccagcctccctagcacaaggggaccattcagcaatgagtgtttactcatgttctttcttgttgatgagttctgcggcccagcatatagaaatggctcagaacgttccaggccttggtgagacacagcagcgtccaatgctcacaggctgtccccactctgcctgttcccatcttcccctcgggacctgtttataaattgaggaatggatgagggccctggagggtccttgggagtagttagtggagggcaggattctcaggtccccatagagagggaaagagaagaccagatgtgcatagaagccaatctctgtcacatacaccgcaggtggtcaccgagttattttccaaaagctgaggaacataaagcaaatttaggcttttgtccttctgcaatacatgcacttgaaaataaacagaaaagagatgtttaataacaagtttacttccggtctgctagcaccctcagcctgggagctactgccagaggctggcgtagtggggcagctgctgaccaaaccccacagaacagagggcaccaggcatcacacgacatctttccctcccatctctgccatctgtctgtctggcaatggaaggagcttcagcaggaggtccttcccagaaggttgattcttggcctgggtggtagaggagatatcctgaccctaaagtcttccagccccgggtcatcctctcctatactagggcctattgaccgtagaggccaggtgcggtggctcatacctgtaatcccagcatttggggaggccaaggtgggaggattgcttgagcccaagagttggagaccagcctgggcaacatggtgagaccaattgactgtagggcttgtcccttgctaagacaggagcagaagactggatggctgtgtcctcaaggcagtcccctcccatccccattcccaaagtcagaaagcgaagccagatctcaagggctgatacctgaggcaaggagagctaaggggagagaaattggggctgagtggaagcagatgcctgcacaagccaagtgtgtcttattgatctgtacaagctgatagaaggaccatctgctgaaatccagggctcctgagttggtgggtttgcttgtgaagcttctaggacaaggcgcagccagatggaagggagagggtccagggcttcctaaatgcagccgcatcacctgtcaactcgctgcagtttcagagacagtggaagctgctctttacctcaaaagcacaaagcagaattggcaacttcacatgtctcaagagctccaagatcctttggtctcgtgtcctttggcaccccgtaactggactggggacaaatttgttacgtgtttccaaggctacagacatggtgccatcctcacaggcctagctcatgtcatggatcaggtgctttgctggggggatacaatgacccatgtggtctgcgtcttctgccattggcttgaactgggcaccccctgaagtctccatctcagctgtatattctagtccaaattttcctggctcccctgctccctcccaggtcctgcacactgtctttttgccaacacctcagccctgtttgctatttcatgtctgcatggtacgagacaccccttcacagcatacactgccatggtatgtacatatgcatccacgtgtgtgtatgtgtagcatgtagctcattctgctcagcctctggcgccgttccacattgctcccagccccattgctgtcactgtcgtcccagatgtccttgccatggccacagacaatctgccgtctcctggaaacgctggggctgcccttcagagagctggcagccccagcagtcagggcctgctttgcagaatagaatgtgaacccaactcctgatggcctacttgacttatttaattaaagatgaaatcatgcaatgagcaaaa

SEQ ID NO: 126 - protein, 479 aa, Homo sapiens
MEKGLTLPQDCRDFVHSLKMRSKYALFLVFVVIVFVFIEKENKIISRVSDKLKQIPQALADANSTDPALILAENASLLSLSELDSAFSQLQSRLRNLSLQLGVEPAMEAAGEEEEEQRKEEEPPRPAVAGPRRHVLLMATTRTGSSFVGEFFNQQGNIFYLFEPLWHIERTVSFEPGGANAAGSALVYRDVLKQLFLCDLYVLEHFITPLPEDHLTQFMFRRGSSRSLCEDPVCTPFVKKVFEKYHCKNRRCGPLNVTLAAEACRRKEHMALKAVRIRQLEFLQPLAEDPRLDLRVIQLVRDPRAVLASRMVAFAGKYKTWKKWLDDEGQDGLREEEVQRLRGNCESIRLSAELGLRQPAWLRGRYMLVRYEDVARGPLQKAREMYRFAGIPLTPQVEDWIQKNTQAAHDGSGIYSTQKNSSEQFEKWRFSMPFKLAQVVQAACGPAMRLFGYKLARDAAALTNRSVSLLEERGTFWVT

SEQ ID NO: 127 - DNA, 52764 bp, Mus musculus
  misc_feature (1)...(52764): n = A,T,C or G
tcacaacaccttgtgtgttttccagatcatttcccaaacttcagctggctgagtcacgaacacaattagttagctctctgcatctctggacctcaaatcccttgagttaaccaatcctagacaggagataatcgagagaaatattgggtgtgttctaaacgtgagcagatgccgcttgccattgcttcctgcagagcacagtggagcaagtactgacgtagcatctacacagtattgggagttgggagtgatctacaggtggtttaaacatggagaagaggggtgtgcattctgtatgaataatctgtcacttcgtatccagaacttgggcatctgtggatctgggtcagttcaccacagatcctgggggaggggttattgtagtgaatctcagacagctttggaagaaggagaaacaaaatgacatgggatctggaggacagggacagaactgaatataacagagatcacataggaaggacacgtactgatacggcagaggtcgggatggattggaccgtaacttttcttcagccatgaagccagctacttagtagttgaagctggaaatactggacagagaagaggtcatgttcatgcttcagacactaaatggagcaatcccagaaattaccaattgagaaagaaaaaggaaagtcaacagcccacagtcagcagcagaccctgctgggccaaggaatgtaaccattgtttttccaggctcgtatccaaccaggaaatccttcttactgcttccaacagttcatccctttccacagagctgaggcctcagtcgtggctgattttctcttagagatttagttcatgccccccatgagaacaggaagtcaggagttcacaggctggagagccagagaagacattcgctgcagctggagtctgagggcagctggaggctttcctcaatctgctttcctcaaggattgctgccctacatgttaatcttagcttaacatgaccatcacagcaacacatagactgatgttggtccaagtatgccccagacaaactgacaggtgatattaaccatcacacatactacctatcttagctttgttcctacggctgtgagaaaattcacacaaaaagcaacttagggaggagagggtttatttgactcacaaatccagactgcagtccatcattttagtcaagttagatacacaagcagcttgtcctgtcacacccgaagtcacgagcagagagaagagacactctgtatctatttttttatgtatctatatatatgtatctatctatgtatctatctatctatgtatctatctatcttgcctgctagctttttcactcttacacagttcagggcccagactaggaaatggtgctacccacagtgggctggatcctcctacatcaatgaacaacctagacagctacccccaagacatgcctacagatcaacctgaactagagagttcctcattaaccctctcttcccaagtgattctactagctggcacaccaccctaggaaaacaatatcacagtctaacttaaatcttatctgttattaacagatacctaacccaggatgctggggattaagtttgtttcctaatacagccctcactggatggccaacctagcaccaagttctagtcattatcttcctacccatttctaacccatccccaatccactaaccctggtccagagatgggcaagggttctgtctgggagcagtcacttccaggggactttgtagagagctggggaacgggggtatggagggtggtactggtcacatgatgggctgagtgctacaagtatttgatgagcagaggccaaggatgctggaccactccatcatctaactactgtcttctatgatatgtctatggatagatctttgaaggtgaattccctgtttggacttaagcttaaaacctatttttgtttggcatttaactatgtaatttttggtactggactacatttctcaacactgaatgaaattttccctaaaacgacctcgattctgaagttcacatcccaacactggccttatttccattcctaattccaacactatctgatagcagatctccccctcccccaaccccgcctccgcctctaatcatctatctcattggtttggccatgactccccgcccaccccaccccccatgttgtttccacagcagatccaccctagccattcttaaaccatcttaaacccctctccacaaagccagacttcttattgatccccatccccagtgggaagttcttcttactctctgatcaatcaattaatcaagactttgtgcccaaaactactgtttgcagacaaacgcaattctcgctcttcctgaccatgctgctcaagacatagaaaggatcaggacagaaacaaaattgtcctggagattgtcctgcgtgctggccgcctactcagagaaagcattgggaccccatgtctaggttctttctttcctagcactacagctcccgtgagtccccaaagctaatactatatagccttgctgttctgtagggtgtctcagttagggtttgctgctgtgaacagacaccatggccaaggcaagtcttataaaggacaacatttaattggatctggcttacaggtttagaagttcagtccattatcatcaaggtgggagcagggcagcatccaggcagatgtggggctggaggagctgagagttctacatcttgttctgaaggcaaacagaaggctggttctcatgtggttaagagaagggtcttattgcccaccctgacagtgacacacttcttccaacaaggtcacacctactccaacaaggccagacctccaaatagtgccactccctgggccaagtatatccaaaccatcacatagagattccccaaagtccgcctctacaggttctgaatccacagactcaaccaaccttctgtttaaatattcagggaggagactggggagattgctactgtatataaagtatttgccaatcaagaattccccctcccaggtcccgagggctgggcctttgaaggtcatagcccagacctggttccaatctagttctctgcttcttttcactcaggctgccaccaatacttccatgtcttcctcgttatgaggaactgcaatctccctgagcatcgtaacgtctctcgttagaatttagagcactattcgaaggctctgtcagtcaagtgcgattctctggggctctgtgtcctcacctgccataggtgagccttgcaagctcacctgatttagatcctaggactcaggtaaagatgtggacgcagcgacacacacttgtaatcccaacactaaggaggcagagacaggaggatccctgaggctggatggaccagcccttttagcctagttggtgacttctaggccaataagagagaccctgtcacaaaggatggcagaagatgacacacagggttgtcctctggcctctactcacacattcacatacatgtatacatgtgtgtattcatacacacgtgaacggacacaaataaatagttaattataaaagaatttagagtagtatgtagaaaggtgaaggaaaagcggagagaggcccctcctaggaaaaactgagtcacagcccttctgcaaagacactgtttagatatagtctctaatcgtgagggcaacaccataggctcccaggttaacctgctgttccatgagtgctgcatccatgaaaatatggctggcaggtgaggacacagagccccagagaatggtactgagtctgaaaaaaacatcaaaaaaagggagggtgatgagtcatttgaagactctgaggtagggaaaggtcatgtgcactgtagccaagcacttgggttgaggttggggcactggtggcagctgcctccagtgagacaaggcttggctcaccacaaccttaacaccctgtgagcagatctcttgcaacctctgctccacttcctgaatctgccaggttgaggctgcaggtggtcagtggggcttgggattctcagcctagagactgaggaactggctctcacctacctcaaatgtgcaggtttgagggaagctcatggcccaccagggcctcagtcatctggaaggtggtccaggacctgccaagagaatgttacagtccatgaaatatagctttgccccaggtgtgttcacagatagactcaggaccagacccagctctccagacatgttatttgtgactctctccacctccctggaagcataggaagttgctgggtatgaggttttatggacaggaagaccagccccacactctgcagctcagagaattttactaacttcccttccgtgaagcctctgacacacatatgcattccatatctagaatgttctttctccacaaatctcttacatggctcttgccacaggcctccttctctgcaacagaccactgccacacacttcctgtgaaaagcagaagctgtcactgggggactctctagccctcttcctccaaatacacatacgatccaccttcattttctccctgacaaaggatgccaacctagcacctgcttcttcagagagtcaacccttctctgcattcctggactctcctctgcctgtcccaatcacttcagccttgcctgtctctctggggtcattcttgatagactatgatcattcccaacaacatgtcatcttcaaaacaccactttaggcagtgacacgttgttgctgtgtgatagaattttcctggggagatgcaaaacatacgtctacccaccccagataaggagcccatggcagagcaaaggataaataccaccaaagtccatcttggtgaaccaatgagttttattgagattacttaccggaacatgggcaaggggtgacttataggagcagaagtgactcaaacacaacaccaaagcccaccccagcatgagtgaagacaactcacaaatgctacgcacctggagcacactgcacagcctgcaggcaggttagagggtatcttttccaggtggctgcttcttccaggctgcttgactggtttctgcttcttccaggctgcttgactggtttctgctttgtccaggctggtcttggaatttatttgcagttttgctttcctgagggcaattctcagcctttctctgcatttctagactctcctctactgtttactacaaaggagcctagtgagtcttgttagcttcagggacttcctgaaactatgttgagttgtttactttctgtctcaaggggtttcctgaaagatatacaatgtttcaatctaggaggaaactgtcgtacaacattggctaaaacccaacactgctaacaagtgctggtagggatggagaaccacagggactttcatgctttgctggtgggtatgcaaggtaatgcagccactttaggagataacttgatagtttcctctacaactgaccatattgtaccatctgatctttcaagtatgctcccaagtgttcacccaagtgagctgaagatcacgtggataagagcactcactactcttgcagaggacctggcttgagttcctaggacccacacgatggctcccaacccttcctaaccgcagttctaggggatcggatgctgtcttctgacttctatgttattgcacacaggtggtgcatatgccgcaggccctctggtcccctgtgcctgcataggaaagagtctctagagtagatgagcaaagatttggatgtagtgacagtcagtcaaacacacaagagaggtgttgaatctgaatgtaattttccagtcgagcatcagacttttataatacagaataaattgcagaacaaggcacattgaatttttccaggtgcaaaagaagtgacttcaaaaggaaccagataaatgtataacactagagattagcacagatgcaaggagtgactacaaagggaatttgtagggaccagataaatgtttacattagagattagcactttctgccaggcaagagttttacacttagagttaattgcctcagggtagttaactcttgatacgcctcaaggctaatgtagtgtcaccgaccccaaaattctctaggcctcgttaattcttatctatatctggagactgtccatttttagtatagcatactaatttgctcttggcatggaatgtagtctgtaataagaatttctatctcagtgagaattttagtctctatctgtaaacagctgagtaaaatggcaagtgcttaattgttagtaaactaaatgggttaagctccttgctgctatctgaaatctaagaacactgggaaaaggctttagctatgttagaatacaatcttaaaaggcatttactataaataaggtgatgcttaatagagtgcatgtgaatctatacactagattaatgtggtggaaatttgaatataatgggttagggaaagagatgccataactctgggaggaaaatttccctggattcttatccttgtaaaacagcttccaggcttttcgcctgacaaaccgatccaaactggagagttagctttcgccagaatatccaggaggagagtcttagaaattcatttttcatgagcagctttttggcatttctgcctcacaagctgactccaccagagtgccctgacatgcatatacactaatgtaggcaaaatactcacaaagcaaagcaaataaatctaatttaatcaggtgttttaaactttaaagtcttcttttttttttctttctttctttcaaggaccatagtcttggtgcatctagcaagactccacccaacccaaggtcatcgagcttttcattgatattacttactaggactcttcaaggtttgtgctttatgttgaggtctagggcctacttttgagttagtttttgtgaaaagtgtaaaacctgtatctagcttcacctttttgcatattgagtttgtatcaaacagctttctgctactgtaacacatatccaaggtaatcaatataacaagagaaaaggtttgtttaggcttactctgtttttagagtttgggcccatgattaagtatctccattgttcttgagtatccacagtaaagcaataaatcaaggcagggagcacaaggaagagaggagaaggaagagatcagattcccacagcccccttcaatgccctgttggccagagtctcccagcaggctctgcttcttaaaggcttcactgctttccagtagaaccacagtgagagccagatctttaacccacgcaccctgggatacttcattcaaactgaagtggtgctgtcggtggaaagactgccttccttctagagaactgtctgctaccatatcaaagaccacgtgactgcatttgtgttactacgtgtcccatgtaattgatctgtttgacctaaaagtgagattgaatgctctcatggaattaatcatattaacatttagagtttttgggggggggttattggatattttctttatttacatttcaaatgttatcccctttcccaccctcccaaacccttatcccattccccattcccctgcttctatgagggtgttcacacacccacctgcccacccactcctgcctccccgccctggcattcccctacactggggcatgctgccttcacaggaccaagggcctcccctcccactgatgtctgataagacatcctctgctacatatgcagctggagtcatgggtccctccatgtgtactccttggttggtggtttagtccctgggagctctaggggcacgggggtctggttggttgatattgttcttcctatggggttgcaagccccctcagctccttcagtcctttcgttggggagcccatgatcagttgggttttgtttttagtgattaggacaatgataatttttccacaagggcatacatagaaatttcaacaatcctgtgtgctgtgtgtgtgtgtgtgtgtgtgtgtgtgctcgcatgcaccccattatactttattcctgtgccctcattcctccctggccaccccttcctcctcttggtcttcccttcttcctcccaggtacagagcccctggattctactttcatgacttgaatgtctgatgtcctctctggttctccctccctccttggatctcctcctctactttcatgccttctgtctacttccattgcttatatgtaaatttgcatatatttaagtccacactccacatatgacagaaacagaccaatattattgagctgagtttggtatattttgctgaacataatgatttccaatcccacacgttttctgaaatatttctatttttaatgtgcatgtgtatataaaagggggcatgcagaccacagttttgtatcatctttaccccacttgctcggggctacttctacaacttctttgaaactgtggctgaaactatttcagcactgaacggcttttgtagagaaccaggatcccagataagagcctttcaaattcatgagactggtaggaattctgccagtgtgacataagtggtggaaacctcttcaggtcagcccagaaagagagactcagcaactgtcagtcctggtagatgaaactgttctcttaaactgcatatggtggctctggaatggtgattctagcatttggtgggtagggcggggagatcttaagtttcaggccagctggacacacaaagagatcttgtctttaaagagggggaaaacacatacacacgctttttaacggaaagaaaatccctttacataaactgtgaactacctccccttctcttccctcggagatctgaaagtgagaatccaggcccaggtaggcatcattgccacgcctcctcttacagacttccattagcatttccaccttggaacttccaccttcatacttagactgtgcatacgctacagaaagctcccgcgtattccatttcggaagacaagggatgtcagttcctaagtaggtatggaaagattgtttctccttactctaaaatcgtttggtctttagccgggcgtggtggcgcacgcctttaatcccagcactcgggaggcagaggcaggcggatttctgagttttaggccagcctggtctacagagtgagttccaggacagccagggctacacagagaaaccctgtcttgaaaaaccaaaaaaaggggctggtgagatggctcagtgggtaagagcacccgattgctcttccgaaggtccagagttcaaatcccagcaaccacatggtggctcacaaccacccgtaacgagatctgactccctcttctggagtgtctgacttacatataataataaataaatccttaaaaaaaaaaatcgtttggtcttgagagagggccctggggaatagtaagcaaagacccaagaagaagcaggcaatgagttatggtatttataatttttgtttgtgtcctgtgtggaaaattataatcagaggagcttaaaaacaagtaagcacaagatgagagagggagagaagagggaggactgggaggggaggggaagagagggaagcatgattgacaagcgttctgacactcagttctgcccagacccctcttcctttgtattttgagtcagggtgtccctacattgcccaggctggccttaattttgctctgtatcagataggtattgaattcgagatcctcctgccaaggccttcctggaagaagagagtacacacccgcatcactaggccaggcacccaacccattcgtatccagttagttctagggatcaggcactacctagtcctccaaggaggcagcgataaacacaacaaccccgatccgttaactctggctccctggactgtacttgaagtgggtggggtcgtaatggatgcgaaagtgcccatttgtcgccggctccgcccgggccccgcctctcgcctcgttctctgttcaccgctaaccccgcggctgggaacccttggcctccgggagcctgcgtggtctagccctagaccaggggaaaccaggctgccagcggagactcttcgggtcgcggggcaccggccatcccgccgccgtccctttcgcctggctcggctcccgcctgcctccactgctcgccagccgcgcgcagctgcgcctgatgcccagagcagctcggaggtggccccaggacatcccagagggggattcacgagacccggcgattcaggtactgtactgcgggcattacggggacatgaatgggtgtcgctcgcctcgcggacagtaggactgggccgcctccccgctgccagttcccggaatccccttttcaattctcctcttcgggactccgcctcttcctgcctttcttccgtggagagtctgaggattctagctcccccgacccacaagctgcgtatggggggccctcgtggcccccgcatgggcgccttcctttcaccgttcctttggtgaactctgggtttttgtgggctctctgccttcactccaccagcgtcgcctcaccgagggtgcatggggcaccttagcccgagccattgccagatcctagggggtccacattccttaggatccactacgccttgccaagctagttatcatctccagcctctgggtcctgttctgcgtcctgacaccccctcccccctacacacacacacacacacacacacacacacacacacacacacacacacacacactgcgcgccctgaaacctacctaaggtcccaggatcgtttgttcaagctcctacgaggtcactgaaggggttgtggcccgcagaagatgggcagggatgggatacaggaaaggcactgagtttattggtagcttgcatttctattccaagccagccaatagtgcatgcggtaaaccgttggccccattgacccatttatttggttaacatggctctactggaaaactttgacaacctatgaacttttgtgttttaatgtttgttttatgtccctgttttgtgtgacaggagatcttaggaaatagcccaagtgtcatctaagaaaggtgctaagattgggaccagagactgagtttgccctactgtcccctgtcccttgcctgtcagtccttctgtgcagccttgggagagtaatgaggtggggtctggtactggggtaacagaggtcacaccaaatatggcttcatcgacttcaccaacacactagcaatttggggatcgttaatgaggttcatcagtgtggcgcaggaagtgactgttgttcaaaagtggcttttcaaatttaaatcataaaaagaaaaacccggatgtgactattctaaagttttttcccctgtatttatttgaacatttaaagagagctgaagttgtagtgccccttcctcgtagtcttggatttcctggcttggattctcagggctgcaagttttagttaagtagttaatgttgagttaaagagctctctgaggtttggtttgagttactcaacaatgtgtctaaaataaatctaggaagaccatagcctaagaggtactgttttagaagtgaaactactttttgttgttgttgggttggtggtggtagtggtgcaaccatatcagataaatgataacagtcggctgcggagctacagccccagaccagacgtaaaacatgcatacctccatctactgagtaacctgtaatctcacttaaaactcaagggactgaggtgaaaggatgttgtgttagaggcaggagtaagctgcttggtgagatcttatctcaaacaaagaaaagaaaaaaaaattagaccactcccaaattcccaaatgaatattctactactcctacctgtccacaccaagcctcagtagactgattttcctgttacatctctagacattcacactgttgaagattcagtgatacaaatatattctctgattactggccttcatattttaatctaacctgtcacccaaattaaaatgcactgaccttaagaagttcttgaaaacgggcaaccaagtgagaagagttgttcatgctgccatttctggttccagaaatgtctaaagtgtattctatcattcatgaaatcagaggtgctggcacagagcctgtgttttgcccacccttctcaagtatagccatcatgactgcaggctgagccagggtccatactgatcatgtatgacctgtttttatgccactaaccccccactccaccccccaaaacagtgtgtagtggtttgaatgagatagaccatcattggctcgttagttcacgattagtactcagttgatgagctgtcagggagggagggattaggaggtgtggtattattagaggacttgtgtcactagggggtgggctttgaggtttcaaaagccggctccaggtccagagtcagtcagtctgtctgtctgtctgtctgtctgtctctctctctctctctatctctatctctctctctctctctctcctctgcctgtggatcaagatagcaggatgtagatcttagcttctgctgcagcacctgcctgcatgccgctatgttccccgccatgttcccaccatgatggtaatggactgactaaacctctgaaagtataatcaagaccccaattaaatgtttcctttatataagacatgtcttggtcacggtgtctctccaaagcaatagaacagagacgaagacacggtataagagctagttccgttgtacagagtattctaagtaagatggtggcaatttactttacgtgagaggatgtatgttctgtgcagataccctgccacttttataaaggacttgaggattctgggggtaaagctcctggcatcaaccccccaagggatattcaaagaccactgtccagttccttgaagtatctttaaagtatagtaggggctggtgaggaggttcagagccttagttctgaaaaaaatgagaggacctgagttcaaatccccagtcttcacatacaagccatagccatgcaaacctttagccccagccctggacagtgaaaacaggtggctcccagcagccctctggctagctagcctaaccttaacagtaagctttgtgttcagccagaggccttgtgtccagaacaagcaggaagttatagaggaaagacttctgactctacctgtgtctaaccttagcttacttgtgtctagggacacacacccagacatacagccaacccacacatgtgcacacaaagaatgaaacttgaatctctttcttttggaattctcaaagaattaagcctttaatccctgggctgaggtaccagagaaaaagggatttatgtgtgagctcaaggccagtctgggttatcatggataacagcaggttatcccatgccatccgaggctacatagtaagaggctacctccaaagaagcaaacaacaaaaagagagttaagctggtgtgtgcaatccagggaagaactaacggcaggcaagcacctgagaggaagctggctgctataacaacagtgggaagcagaggaaagggcggaggagggcaaggggtgcggatggggtggaggaaggggtgaaaattattggaaagtgtttttccaacaggaagatgcacccagcagtcagcctagaagcccgtctacaggctggataaccttaacccttgccttagcttttgttcgttcattttcaattctgagattctttaaaagtgcctttaactgtgctccgagcattagaaactgttctacaggtccaacagaagtcttgaacacttttttttagtcatcaggaaagaagcgaatggccaagtatggccttatttctttttctcggaggagcagtgggcctttgtgtgagcagaggcccttgagaggggacggccacagttggggagcaatccaagacaaatggttgactccattcgcctctcccctatgggcagtgagcagtaccagacaccagagtctctgtggagaaagcaagcccagggttttggcacaggcctcgctcgagttcttacgggctgtgccgtataccctgaccagagtgtgagctcctccttcggaacaagaggctgcccttgctctcctgacaaagcagaacccactgagttagatgaaaagcagcttaagattgcagtgcaccacagtacagcagctgcaatggaagccatccaagtatagttctgtggagtgggagacagagtagcacaggaggctcacaaggggtctttaaagtaaaaaagccgggtgcgcgctctctctctctctctctctctctccctctctctctctctgagatgctcgcctagcgtgcgtgaggcctcctaggtttgaccctgtatacctggtgttaaagaatgagagaagatgacaagataaataaatatatttaaaatttttttaattagatttattttatttatgtgagcgttttgcctgaatgtatgtgttgcactgtgtgcatggttagtgacagtcatggccagaagaggccatcagagtccctagaactggagcttcagatggttgtgagccaccaggtgggtgctgggaatagaacctgagtattttgtgagagcactaaggcctcttcaccgctgagccgtctctccagccccaaatacaaatattttaacaacagaaaggcttgctttaagcccaaaggaaagagacagattaagttacttagaagagtctcctagggggcaggcacagcacaatcagctatctaggatagttggaatcttttgtacagccaaagcccccaagtacaacagaaagcgcacacatgcacaccagaacaggacgaaagaaagaacactgaggtgaacgggggacgggcaacagggcctgtggccagcagcaagaatggcatgcgcgctgcgctcagcgtcaagaggatcttaaatgatttcagctcgttgaaaacgaatgagtagaagaaaaagttctgggaagtttctgggaagaaaaagttaagggagaaaaaaacaaaaacaaaaacaaaacaaacaaacaaacaaaaaaaaaccccacaacccaacaataatagcaaggaaaaccaagccgacctcagactttgccagagtcaatcaatgattctatgcggtctgctcagctcgccattcaagttgaaagtcggtggtcagattcctcatatactgaaggccaggggtgagggttgtggcagaggggacagctagaaaataaaatgccagaaacagcaaattctcataaacaaggtacaaagcttccacagctgcatcttggtgcagcatagattcgctggctcaggaaccggaagaggactttgtagagcccaggatcagggaatcttttgtcacctaacatgggggaggagggtctggtagccggaaactgacacaaagcaaggtggtcctcagtcaaaatgttcagggcagaaagcaaaacttcaggctggagaggtggctccgagggtaaagagctcgctaagcaagcaggtcatgtgttcagtcccttagagcccccgtaaaaaaaaaaatctggggcggggtaacactcgcctgtaatcccagctctggaatggatgatacaggaggatccctgggtccttctggacggccagtgcagcccagtctgtgggttccaggttcagtaagagaccctgcctcaaaaaattaggtgtggccgccctcggacgtttgaaactctaggagcccgccactcctgtgaaaaccgtcttgtctctttaaatgaaattactgtcgctttgctaaaaataaacaaataaagtgaaaggtgatgggtgaagacatttgacatcgacctctggcctccacatgcctgctctcacaaacacacaaaccagaactacaagagaaaaaaaaaacaacaacaacacacacaaacgaaaaagcaaaagaggtcagaacctgtcattccggtatttctcaaactttaagaggtattttagactcctgaaaacggttcgttccagaagattaagttactgacagactatctggacctggatggcaacttaacgtctgttggggaaatcgtcaaggtttggagaagaatgcttggtctctttgtgacctttttgatattttccttgtccaaagatgccaagaggatcgcacacccgccccctcggcttcccccccaccccccaaggaggggcagtgcagctcctcgaaggtgtaaagtgagtgtaaggctgacctgcaaggctcctattcgctccctcatccccttttctaaggacccgcccgtcctgtagtcctgtagtgtactgtccgcctctaagtgtctgtaaacctctgttccaatctgctagtgcctgggggcggggcgggggggcggggattacagacctgttcccaccagcccggaactccagccagtttcccattataaaagaaccagtgggctcagtacaatgcagggctgaagcacccagtcctgaccacccaggatgaagggctttagtggcaaaatgagattctgctaatgtgacctagttggtacccaaccatggaaccacagcattaatgagtcctggttagcccaacttgctgggggaaatgaaagcagcccagatatgagctggtgctttgagcccaggctgtgccactgtcccagcagaaggtgctaacaaaccagagtcaaagataagttgggaatgttgagacagaagaccgtgaaaataagttgttcactacacaaggccctgagactgaaaggcctggccccagagacaataagagctctgttttaggaagacagagctgtttgggttcagggagacttttaagggtctctgttaagaattcaggcaggactccaaaagtggaaacgagattcaacaaacaagaatttagttagaagacgtcttgtgtacagtggagcctcattttgcctggaacaaaacaaaggaaggaaatattcttggcccagaggagaagagtggtgtgtgtgtgtgtgtgtgtgtgtgtgtgtgtgtgtgtgtgtgtatgtgtgtgtatgagtgtgtgtataagtatgtgtatgtgagtgtgtgtatgagtgtgagtgtgtgtatatgagtgtgtgggtgtatgagtgtgagtgtgtgtatgagtgtgcatgtgtgtgtgagtgtgtatatgagtgtgtgagagtatgtgtgtatgtgtgagtgtgtatgtgtgtatatgtgtgtgagtgtatgagtgtgtgagtgtgtgtatgagtgtatgcgtgtgtgtatatgtgtgtatgtgtgtgtgagtgtgtgtgtatgagtgtgtgagagtatgtgtgtatgagtgtgtgtgtgtgtgtatgagtgtgtgtgtatgtgtgtgtgagaatgtgtgtgtccatgctcccactactgaagcaagtgagtcttcctgcagatacatcatgaaaacaaagatctttcactatcagaagaaaagcagaggctcaagggttcaggtcaggtgctgggatgtgagtgagctatctcacatgtgaccatgcaggtgtgcctgtgtccaggcaggtttctagccctgcagcctctcttctgtggcacagggcggggagataacaacacacgtcacaaggctagcccggaaggtgcttcctcgggaaagcagggttattagataagttgtggggaaggtgattggctgtctctgcagaaggaatgtaagctttaacctggaatctcccaaatgtctctcgaagattccatggatgggaactgccaccatgcagtcaaggggaattctaaagtaaagttgtttatagcttaagctgagacagtcatttcctggtccttttccttttttatttctgtctcaaatggttttatttgtgggtgggagcatgggggggggggcaaagaatctctctttgacctctaaatcttcggtgagagaagaaatcagatcaaatgaagctcctttaaactaacaagtccctatctcaccttggaatgggggttccttctaaaagggcaaaccccagaggctgagagaataaacagtcacgccttgataacttttgggtccagagtctcttgggatatcaaactccgaggatgctcacaccccttgtataagatgttgtcgtgtctgcatataacccatgctccctgggcaagcgggtgtacagctatcgtcccagtgttcacgaaataggtaaggcaagaggatccctccagattccaaggcagcctgatctacatggcgagatctggagatggggactggagttctgcctggagtggtgagatgcctgtctgtcacacgtgggtttagggtgtacccccagcaccacatcaaacctgattcaatggcagacttcttaggggtcttgaagcagagggagaggaccagaaagtcaaggtcattctccattaccgagcaagttcaaggccagagtggaatacgtaagtcgccgttccgaagaaaacaagagctgttgcctagtttattgtctgtctggttgtatatttaaatcatgtccaaattgcaggaaatacctagtgtaacacaaatgatatgtaaacagttatattgtatcatttaggaacgactgaaaataaaaacaatcacctatagcaagtcttttgtttccatacaaaatcctgtacaaagctggtctaacactaatgcagaatccccaggtaaggagggacaattgtactttttcatatggaagagtaaaactcagaaaattccaagtggtttacacacacacacacacacacaccagcacaagtaatcaatcaaaaggcaggcagagagctcacaagaaaaaaaattgatttatatcaggaagggccaggttccctcatacttaaaaaaaaaaaaaaagtctgccaaaaaagggagaaagaacaatagagatggaataaatagttgactggaaaagaaaactggcatcccaggcccttggtgacatcatttgagcgctaacagtcttgaagaatcctgtctctccaggtctgctgtggcgcagatgtccttccccttggaccagccccagcttgcccccctgcagctttccttggtgaacattcctgactttgacatctccgataacctagggtctccactgcaacgtgggatttacctgcatggctttacacacagcctatttgggagcttcctgcaagaaatgcatgttacaccttctcagaaactttctgaagtgttggcataacattcttaatctactttgctcttgggtcttgcacagccagcgccacccagaacactgagattcctgctgtccgtgtgagatgtagcctggcctccctggatggcagctgctcttctactcagagcttttccattgcgggaggggggtaccgctgtcttctacctcttcggttgctttcttttcatacgaaaagtattgttcacctggaactctcagtaggtgacatctaatcagccagatgactttcttacaaccctagggcaaagtccctgggtttctctttggtatggcagcatctgtaacagttaccaatgcttcggccacacccactttgcctgcaagcaattttaaatccacccccttccttgccagactccatgttgttcccgtgtttccacctcactgtactccctcaccatagacacggataaggttgtgagcagtagccatgacagcctgcacgagcacgccatctttaattcagatgcccttctccatacaaattaatgtcactcccctctcagcctgctcagattctcaggacacaggcagattctttgcccgataatagcacaaatgacctcgagccaacttccccaaagagttcttgttcctctatgaagctagagaggacagtctttactgtgtgtatggctgagaacgtttttggtctttaaagctttaagcccttcagaggcacttaaaagcttctataaccaacggctccaaaatcttccacattcctcccaaaaacccattcccaaggcttaggaaccacacggtcaagtttgtaagagcaaaggctgcacttgttgcgagttttctgtatgagttgccttgtcccctgttgtaaccaaatacccggccagaagcaactccaaggagagagttatctggttcacagtttgagcaagtctaatccatcctagcggggaagacaggagagtcaggggtggctaccgtaatgtcggtaacattacggtaaggggtctcatgtacatatagtcatgctgtgcaactatgtcaaaaaacaagaaaattgtctttggttggaaggcttcccaaatttattaggcaaagaaaaattaggtagaacggggctgtatagtctacctcttgcctgaaagaagagggaaatgcgtttggccagaatggtggtgtctgtctgtagtcctagcgtttgggaagctgaggcaagaggctctctcaggttcgagccagcctgggctcgaacgtctccacagcaatgtaggatggccataattgcctataaccccttcaactgcttaagcctccacaggcaacaatgcgcacacgtgcacattcccacacagagacataattaaatttttaagatttaattatttaatactgaaattaaccaaatgcctattgcctgttcaaaatttaagtttttggttttttggtttttttggttttaagtcgttttaactagggattgataccacagcggaaggtgagctaagcaagtcccagggatcaaggaaggactgaaaccagaatttggctactttttaatttatttttaaagacaggtagctcctctagctggcttcaaacttgctatgtagccgaggatgaccttgaatgcctgacctttcccccacctctctgcttagaggacagatgtgacacgcacagtaaactcatgcaagtttaaccctaatcctaaccaatccagggctaccacggggccgcatctgcagctaaatctggctcgttcttactcgtctctcgttagcgtgtatgtgtctatcatgtaaattacaatataattgggtgcttctgagttttgaccaactcaatattgatctctttcaggtgtgagagcagaaaaacggacttaagagctgagcaggatgcgttcacggtgcaccgtctctgccgtcggtctcctcagcttgtgtcttgtgggtaagggctacttctcagcacagcccttagaggagaaagcctctgtttctgtcatcacagagagccctggtgtggagcagcacactgatgtccatatctggagaacccagatcagcacggccagcatcaggcaccccacgggggtcttccccttcattttagctaagccagaataatataggctacagccatattcaggaaacggccttgtttataattcaaagggttgcggctctgcacaccctgaatctcacgcccggtggcgtttagaaggtggccatccctttatctcttcccatataaactaacttgaaaaatccatccctacacattgatttatactcttcctttctttttagcccttatcttttctatatctgtatttcttcacgtcctttctgttccttcctctgaactgtttgaattccacaatgtcatctctcccattcattgtcctcagcggatccaggagtatgacaaatgtctcagtgtggacatccacagttaatgtgtcccgcctatggtttctaaaaaataccaggaactctactccctgtaagtcactgcaagatcaggaaacaaatgacccctcttgcccatccctactctaagggacgacactcactaactccaatcacaaataccctctcttcatctgccactcttgttaaatatctttactttaaatgtattaattaacagcgtgcttatttctgttccgagaaatgtgtcacatagacagccacttctcagacactctctcaacccttccaacccctgccgtttgtgtcaagtcccagcggcctcactttacatccgccccgattgccaccttcagatggcacacgtgtcatgtcggccataccacattacccaagagcatccatactctccacaggatttttgttagcacaagaaaatctcaacccttaagtagcacatgtatgtcatagagccttacatttagagtaatgttgacagtctgggcccgtaacaagccctgttgtaatctgttgtgcttccttctagtgtctgcgagcctagagactatcacaccgtctgcttttgatggtaagaactgttctgagcttgactgaatttaatgtaagggtcaaagtatctggctaacaggcaggaaaggggggggggagtttgatttctgaccccagatatgctgaccagtttattggaatcctttctaggtagaggagctaagggtgtttttcattatttgtgctctaaactattataagagggaacaaaaacaaaaacaaaaacaaaaacaaaaaaagcactagtgattattaggaggccctcttaaaggcacactgaagcttttcagctcactaagaaaaggatgaagaaaacagaacagggtccagacgaatgtctctttaatttccaatcgtctacagattagtttcaggcaaaggaaaataaatttcttcaactgaaatttgttctcctttgtgtgatgaggggaataaaaatgcagtggggatttgagatcaagggtgggaaggaggggggtggggagggaaggataatggggagagacttcaggagggagggagacagaaaagggagagtgtgggggagagagagaaagagggacagttggggagggagggaggaatgagggggagaggggtgggtggcacagcagtttatgggccagttgagagaggaatattttgaatccgtgaactcaaaacagttcagagaagccctttgtcctgtgtttacagggtgccgagttcccatttgttagttttcctgccctgataataagttgtcactaatcaactgaattgcttcacttcccgtgtccagtggacttcctgcttggtctaagtgccagaatgcttccactagggcttgcctgtgagccgtgtgtgtccgagctcctaagggagtgccaccctagttccaaatctcatcgtttcttctcatcgtttcttctcatcgttgcctcctgttctttctagggtatccagatgaaccttgcactataaacataacaatacgaaattcccggctaattttatcctgggaattagagaacaagtctggcccacccgctaactacaccctctggtacacagtcatgaggtcagttggcgtggcctttttgtgttttttgttttttctctctctctcactgagtatgttacctctcctccattgcatggtttctcccctcgctaggcatacttcctgccccagaactttttaggttaacttacatgttttggggaggggtgtgtgtgtgtgtgtgtgtgtgtgtgtgtgtgtgtgtgtgtgtgttgacactggaagttcctcaatcactctctgccttattttttgacacagtctctctcactgggcttgagttttttgctaggttatctggccagccatctttccagttctctgtcttgttggggttttttgtttgtttgtttgttttgttttgttttgttttttttgttttctgactcataaaaggccaaagtcaaaacacctatcctttcctaattaatttaaattcttctgtagcccaaagctattgcagcaggagccaagcttgtgtttataagccaaatcctggcagtttgcagtttgcacagtgattcctccgaggtcactctagagtttacaagtccgaatttccatcaggctcaaggtctcgtgaccatattggtggtttatgtccctgtttctttactcatggagacaaggtatactccagaaagccctacttggcaagcttgggtccaaagccactagatcactggactgcttaatatttagcccagagtttttgtctttgcctaaacattgctatggggataaggatggaattggcagggaccaccttggccctcctctgcccacaaacaacagccgctttccgaagtccttgcttttctcagtagctctttggagagagtgtatctatgatgtaagtcctgtagccctggcccgaaactgtctattctcttgtatatcataactccaacggttataccagccaggagaaagcatgagtgtcttgtgactttgccttcctcctgcaaaactcacatttcctctgctgatgatcacacatatcgctagcttgcgcgttctggtttcatctctgtggttgtgataaaatactctggccaaaaggaacttgggaagcaacgggtggttgtcgagggaactcaaggcaggagtttcaggtatcccatcagtcctgagcagagagaggatacatgctgggctcccttgcttgcaaactacccagctagctttccatcattacacaatccaatgcccaacccacagaaggctgccagccaccctacagttaaccatggagatggtcacctgcagacatgcccacaggcgaacctagataatccttcaaccctgggttctcttctatctcctgttgacagttggaactaactagcacactcccttactttcccaagcttggtgaatcagctgtccctgatgtccctaaatgaacagaattctgacttaagatgtaaggctatgtgaccttcagccagagacacatctcaaagaaagcactgctaattatcctagggagggaagtctggggcccaggccgagaaaagcccaaannnnnnnnnnnnnnnnnnnncctccctcccttcatatatgcatgcagtagattctatctattaaacaataaaagtataatgactcagttggggatgaaccattaagggaaaacaaatccagaagagattagaagtgggtgggtgggtaggggtttgcgaagttgaatgtgttcagttttagaatgatgtgattgtgggatatctgggcaacgcctacaaaccatttcttttagccatcataaaagatatgaggcacaggaaacggattctcaccacacgcatgttcgtctttccttcttcaatctttccccctccaaagcaaagacgaaaatctgacgaaggttaagaactgttcagataccacgaagtcatcatgtgacgtgacagataagtggttggagggcatggagagctacgtcgtcgccatcgtcatagtgcacagaggggacttgaccgtgtgccgctgctcagactacatcgtgcctgcaaacggtgagtgggtgtctgtgtctctcaacctcatcagtggtttgctgtgaacgaggaaggtgtttggctggagagctggcctgactcctggccctaccttatgtggccatttggttgctcagagcctcagctttccgatctagaaaatgggttcataaccttagcttctcaggtttttgttcggcacgtgtataaggcaggttttcagaggtaattgttgctgtctttctgttcactttacaacctggcaggaagcaggcagaggctttgcatgggtctttctataccatcacatctctttagggcagtatctttctgtccaccacctgagactgtaagtcaagaaggctatatatatgaacacttagggcactcagctcacaaggcaagtggggcccaggagtggggtgacccttctatcttcccatgtcctgagcacttatgctagtggctccagctcccactgtgttttcagtgactaaatttataactggtttccatggtaacgtttttttggtttcagcaggtgtgtgcactcgtacatacttgggaaaatgacaacggttgaaaccatgaccagatcatgagtcagtcttaggaggtcatcccaggggtgtggaggttgtcccaggggtgtgattgtttggatcaacaatcacatctgtgcattgcactcacagaaaaaaaaaatcaaagcacagcttatagatcgtgataaagaatatatattaaagtaataagtatttttcatgatccaaatcctaaatataaaaaagatactaaaacctaaggccaccagatgtggtggtgcacacttgcaatctcagcacccatgagcctgacacaggaggagtacagaggtttgaggtcagcctaatgttacatagaaagtaggaagccatccaagactacatagcaagatgatgtgtcaaacaaacaaacaaacaaacaaacaaaggagttacagagacaaagttcggagcagagactgaaggcatgaccatccagaaactgccccacctggggatccatcccataaacaaccactaagcccagacactattgcagatgccaacaagagcttgctgacaggagcctgctatagctgtctcctgagacgctctgccagtgcctgacaaatacagaagtggatgctcacagtcatccattagacggagcacagggtccccagtggaggaactagagaaagtacccaaggagctgaaggagtttgtagccccctcagaggaacaacaatatgaactagccagtaaccctagagctccctgggactaaaccaccaaccaaagaaaacacacggtgggacttatagctctagctgcatatgtagcagaggatggcctagtcggtcatcaatgggaggagaggcccttggtcctgtgaagattttatgctccagtataggggaatgtctggaccaggaatcgggagtgggtgaattggggagcagggggagggggtgaggataggggatttttggaggggaaactaggaaaggggataatatttgaaatgtaaattaaaaaatatctaataataaaaacaccaaacaaaccccccaggactaggaaaaaaagacagacatcattctttgacatatttcttctgaacagatccagcaatatattttgttttctttttttgttttgttttgttttgttttaaagtaacataagccaacaagatggctcagtgggtaaaggcacttagcaccaagcctaatgacctgagttcagtccctgggaacccacaaggtagagagagagagctgatccctacaagttgtcccctgacattcacacatgtgctgtgacagagtggcccatacacttacacatactcaaacacaaaacaaaataaattaaaaatgtaaaaaaaaaaaaatttaatttttttaaacggttaccttaaatagatgtacttacatcaaaagagagagagaataaaatttaaaacctttctcacgtgactcagaattcctctctaataatttgttataaagaaatgaccaacaggactggagagctggctctgcagttaagaattcaatgttccccagagggtctgagtttggttcccagcatgcaagtgggcactcacaaccacctgtaacttcagcctcagggacctgctgccctcttctggccactacaagcaactgcacttacttgtatctattccccaccaaaaaaaaaaaaaaacgcacacatacacataattttaaaaaattttgagccaggcagtggtggcacacgcctttagtcccagtacttggaaggcggaggcaggcaggtttctgagttcgaggccagccttgtctacagagtgagttctaggacagccaggccacacagagaaattctgtctcaaaaaaacaaaaataataaaataataataatattaaataaaaaatacaaaaattaaacacttttatttttctaaggagaaagaaatggctaagaacaaacgcagagattgagctccagaaacaccaaatgacacatagattctgttcagaaatattaaaaataatctgtttgttcaaaatagtaaatcagaggggtcacaagaacacagggtttaaattcagcataggaagttacaaagtgagtcgggagtcagtgaaactccatgaaggccagagacgaaacacgttagactgtgtgggccacatccagtctctgtcctatgttgttctttgtgttttcctttgagattccttaaaaataaaaaataaaaataaaaaaacaagaaaaaatgttcaaaagaagaaaaaaaagtgagattgtaggttgtgccaaaatctaacccatgagacatggttttctaaccctcagggtaaataaatgtgtattaacatgtttatgtcatatagttaagtaagtcagccatggtagcatgcgcttgtaatcccagaactgaagatccagaggcaggaagttgtgagttcaaggccagcttaggctgtatagtgaaaacctgctttgttttgttttgtcttgtcttgttttgttttgttttgttttgttttgtttttaagtagttaagtaaaattataaaaaacattgtgggatagaaggacttcatttcagtgtgtgtgtgtgtgtgtgtgtgtgtgtgtgtgaacatgcatgtgcatatacaactatttatataccccaattaatatgtaagaatatgtatatatttatatacattagcatagaacagttgattatactcaaagaaaattccctgtttatattactattgtttattactattatatattcatgttgaatcatgaaaataagtcattttaaatttcatgtctacaatccagcctgagaattgggaaggttgttgacatccatctcaagtcagggtaccatgtgccataggaatgctaatgaatcaaattgttccgtttttcagcagtaaatccaaatagcactatacagctagaattagaagcccattcagacagaattagcctttctttaaaggaaatgacactgtctctgacaacaggatacaatgtacatactgaaataaggaaagactgttactcatttctctttcttatgaagagtgtctgttttccacagctcctcttgagccgccagaatttgagatcgttggctttacagaccacataaacgtgacgatggaatttccacctgtcacttccaaaataatccaggaaaagatgaagactacaccctttgtcatcaaagaacagataggggacagcgttaggaagaaggtaagtggtccctcctgttcagatgaaaacaatacgtagctggcagtggatacattgtacttccttctcaagaactgtgtaaggccagggaagggttactttagacggcttgctcagtggtagactgcttgctactgtgttcagcacccaacattgcagagggagggagggagagagagagagagagaggagaaagagatacagagacagagagacagagagagaaaagagacaaagacagagagatacagagacagagagaagagagatacagagacagagagatacagagagaaaaaagagacagagagaggtacagagacagagagaggagagagatagaggagagagatacagagatagagagaggagagagatacagagacagagaggagagagatacagagacagaaagaggagagagatacagagacagagagaggagagagatacagagacagagagaaagaagagaaatatagagacagagagagagaaaagagacagaggcaaagagacagagagggggaagataaggggagaggagttgtatcatctactgctgtatttcatccatgtttctctatgttcaaagcatgaatcacagcattttagactgtgtgattattaggataacaacaacatcataaaatgaaaactgtacacagaggcattttttttaagaaaattgatctttaagtcaaattaaatcatgaaatagaagaggccattggtgttacccaggcagcaggcaggagtggcctggaccaattgttggtgctgtgattttccagtgcttcatgtgtttcatatgtgggctctacggtgtggtagagaaaccttatggccacagcaccttacagttgccattaactgaaataatgaggactctgatgaacttcggttaggatatgttaaatgcaagatgccagtgtggcatttagaaggagacaatggccggcatctcagctcccatgtctggagttaaaagagtctttataagagtgcctttggtgagtcatgggcaaagcctggttgcatggactcaagtaaagcgttgaagggctcattctccagagcctttctcatatagctgcagcagcaactctagaaggtggggcctggaggaatgacaagcacgtccacgtgcaggtgaagtgtcctggagaaggtgacagtagcatagcgggcgagttgtcctagagacttggtggaattttgagagcatggagaaaggtgcccttggctgggaacagagatgagatggaggatgctgcacagatgcagaaagaagagtgtcttagtctgtttgctgtgactgtaaggaactacctgtggctgcacactttatcaagaaggagggttattttgactctggcttctggggctgaggctaagagatgaaatccacggatggccctcccactgactgagtcctgaggcagcggagactggtgtgacaagaacagggagcatgcgtgcatgtgttcagatgtgcttcccaatgtgagtcaccagggtttactcatggcgccccactctgatgacccaaactcaccccgatcatcttaccagctacagaaaaatgataatattgtggcaatgatatcatggaaaccttcaatccccttttggatttttccttctcatccataaaacggatctgataggccagatatcgtggttataagattcgtgtacatatgtaggaacatgaggtttggcaattaattgcttgcttctagtgacataaaccttgctaagccagtgatatgtttaaacttctttaagatttgaaaatagaacccttagggctaacctctcaccaaagtcttaactgatctgagtgtttgtttgcgtgtgtgtttctttttacagcacgagcccaaagtgaataatgtcactgggaacttcacatttgtccttagagacttacttccaaagacaaactactgtgtatctctttattttgatgatgaccccgcaataaaatctcccttaaaatgcatcgtccttcagcctggccaggaatcaggtatggctaggtttttaaaatttgcactattgttttgatggaaaacttgctgaaaggaaaagaaaaaatctcaagttctagcacactaaatgtactcctgccaataaatgcacaccactgagctgcccctatggctctgtctctaatgtcttgtcctgccgtcagaataatcaaatacctgtcttagaagaacagacccctgtagcactttccttttaagggaatctgggtgagattcagcattgtgtgccctttggccattgcttgtgccgagtgctagaagatcagaagttgcttgaaaagccagcattaaaagcctgggagggaacagtatggaagtggtgtgagtcctaagaatatttgttctgcatgtatcagaaaggggccttgtccgcagagaggagatgaccactggtgacgtcagaaagccttccagttacagagacattgagacagccaatactgtgaccccaacctttctttatctgagaaaccctgtgcggccaggacaaaggaacctgggatgtggtggtgcctgcctatgctctaccccccagaaggaataggtgggctcatcataaggttgaggctgtgtagtgagtttccagccagcctgggttacatagcaagaccctgcctcggaaaaaaaaaagcaggaaatggaggttagttgagtccaggagccctccccgtttttcagtcactacctctcccacagtctcactaaaagaaaaaggctttgaaactcctcttctaagatagctctctaaattcctcagtcccaaagacagactcctaagcatcaccattcatcagagtaaaattaagtttgggttggcacgggaatgaagaggtgatcctctgcagatgggctcctagatttgagctcttgacctccagctaatggcaccagtgtggatctttctggaaacgctggagtgaagtaggtcaccaagaacagggctagcctttgacttgggaacagcctttgaaggtcacatccaccccctggttcctgctgtatggcatgctctctgctctcgcagccaccacttgaacagcttccagaacacactccagccatctaactgagctcctccaccccgcctctcctgccagaatggactctctctaaaatggtgagccaaagttaatcctgttacctgacatttcttctgctaggcagtctgccacaatgttgccaaaggaagctgttaacaaaggacttagctagtgtgggatgcagcaagctacactacatggggcctggcacctagggtaccctgatagcagtgtgtcctcacggcctaatgtttctcaaagctgaaagatacacagactcatagtctggccaaaagccagccttagcttaacttgtgttttagtctcttacaaaactgctaaactgttaacataagccccaaacaaatcagtattggcatgtctgacaccagagctcttaactccaagtagccaatacttcaggccatttctgactcaaaatcagagcagactgggcaggataagggtctgtttgcaaaagacatcccctacttcggatgctagccacaagtttacggtcttcagaccatatcgattcttgtccaaattggctacaaaataaaaaactcctccaaatttctctcaggtccaatcatttgatgaagtgcttcacagaactggggagagcatagacttatgagactatttggataaagctgaagaggtgggtgggacaaggggcagaagggtctgagctttgtccatggagtcagcctgcatcattctcccaagaacctcagaatgctcactaaacaggaagagcatcaagtccacacgtcctgggattacctgggacggaccaagtcattgcccacagcgcaagggttaatctcctaaggtcaggagggcgggactagaaggaaccacacctccctgatcatagcagttcctttctctgcaggtcagcccccagcttaagactgtcccgctgctccccaggacccgcttcattagcagaaaatcagatacagttgctagccttagtcccttgtctnnnnnnnnnnnnnnnnnnnntccagcgtttccagaaagatccacactggtgccattagctggaggtcaagagctcaaatctaggagcccatctgcagaggatcacctcttcattcccgtgccaacccaaacttaattttactctgatgaatggtgatgcttaggagtctgtctttgggactgaggaatttagagagctatcttagaagaggagtttcaaagcctttttcttttagtgagactgtgggagaggtagtgactgaaaaacggggagggctcctggactcaactaacctccatttcctgcttttttttttccgaggcagggtcttgctatgtaacccaggctggctggaaactcaatacccaccaccccccacccccattgcatgactatataaaaaagagatatttatttctcctagtattggaagctgagactaaaagtgggaaggcttcctggctggaccattgtgggaggtgccacatgtcacagaagggaggtggcaagccattttatgccaatgccatatttgcagtgtctcacttgttcccataatgacagcattactccacacatgagggcagcgcctcctggcaaaaacatcccacctcccagaaccttctcagaggacgccaactgcaagagacatattccaaccatcacagcccccacactcagggaatttcatgaagtttgaagccctgagcctagaaccaggagtaggagagaggggggcactattacatatatatgtgtgtgtaaaatagcatgatcttatatatggataaaactcccacaagcaataataattcaagtaagggttgatgagatggctcggtgggtgaaggtgcttgctgataagcccgatccccagagcccacatagtggagaggagactggactccatgaggctgtcttgaaacctccatgtgcacactgcagcacagcatacacgaataaatgtgattaaaaagtaaagtcaaggtggctggagagatggctcagtggttaagagcactaactgctcttccagaggtcctgagttcaaatcccagcaaccacatggtggctcacaaccatctgtcatgggatctgatgccctcttctggtgtgtctgaagacagctacagtgctctcataaataaaataaataaaacttaaaaaataaaaattaaaaaaaaataaagtcaagttagtaagaccacagaggaaggtttcttgtgacccaggggtgctgaccaagcagctggccattccatggaggctggcctttccctccccacccccacgccccacccccatgctccaccagttaagacagttaagactcggtctttgccatagcatgctgtgagtccatcccaccgctatctagtgataacacgtccttttgcacatcgttgccctcccccttctgtcattagccgagacagttaaggggcaaggagctccagctttccaaatggttgtgtttttttttttttttttttttttgtcaggcactcagaaatcaaacggatggaggtaattcactattatttcttctcttactcttcagctgccatctgaactacccttaaccagtaaaaccaaaggtcatacgcgtgcagtttggtggacagcctcccctagttaatccctaaatgcatccattggctcttaggagacccagtgaaccctgtggggaatctctccatctgataaatacagcagggctgaaggcagagagttctgacttttgtgcaactcccactgaagtaggagacaaaaaaatgaggttaaaggatagaaaggcaatgacagaaagaaaaaaaacggggggggggataaagaaaaaggtgaagaagtgactgggggaggggaggggctctccaaagcagaaaaggcatagatatggatctctgatgtcaccctgggcttcatctcagtgaagttcattttggacatctaaacctcggaactgtaagccagtctgagttaaggtcaaaaaggctgaaggacactagacactgtaggtgaccccaaaagccggtcggagagatggggacggggtggggtgggggtggggggcgggaacttatggatctaggaggaacttgggtgtgccacaaagtgggggatccaggtgactccccgccaggcactgcaatcatccaagtggttatcacccagagggcctggcaaggaagtacgttgtcttgcagagaagaacaaccataaaacactgtccttgctgcccagggctcctgggtttcaaaaaaaagacaagacacatccaagggtgaggtttgaagataccagtttggtctgcccttcccaatatgagatgatctaatccctcttttaggaagatgatccacaatgataacacacatgaatgatcggccacagcccaagacagattgtatgttgttacccgctttaggttacacaaattcttcaagtcataaattctctgagactgatgacagaatcaccatttgcgaagcaccgctctagctagcggactatgattagcataatgtgctttgtagcatgtctgtggagttcaccgtgctgctccgtgtagactctagaagttgggtagacctgtgagtcattcgtgagtcagaatcccagtgtcatgttcacgtcaatgcttcaccccagggttacgtggggttgccttccccttcttaggaagtgtgtaaagatttagtgtgtctgaaagctgtgcccctgagcctagacctgatcctgggtctttcacggatgggaggagcctgcgtcgttcattcttcatgggcaggagactgggctccaaaaccagtgtcagccaccaatcctctggtccttgcttagctaattgtgtagtccttccccttttaaaagacgtcgagcatttgatccattttagcccttctcttctgtatcctatgtcatgttctttatccttcttaaaaagagaaagaaaaaaaaattaattgtcccagaagctctggatatggggatcatactcttatagctctttttttgaaatgtaagagagctttgcctgcggtggctcactgcttctcagccccactgtacctacaagaagcagctactttcactgcggagacagaactcaaaaaggaaatttggcaagaggctaagggaagttcttcacaagcaagagctgcatttgggaaggccaagcctcagaatggcccagttggttctccagcccggttctctgtcttctaaggttcccacctgggcaatgagtacccacaggcatttgggctatggctagtggggtggttctgattctgtccagatttgatcgttgaaatttaaagagccacagacagacagcaactactctattgcaactatagaacataaaggttttttttttttttactttgaaaatctaaatacggtttatttaaaatatatgcacttagattagcttccattctttggtatttagcaaattttttttcttcttaactttcgcttcctcttctttgatttctgtcaccagaccaatatgggtgtaccccacccgtgaccatgtattatatttcttttgaataaagtcatttgtcttttcattaacaggattatcagaatctgctatagtaggaataactacttcgtgtttggtagtgatggttttcgtgagcactatcgtaatgctgaaacggattggttatatatgcctaaaagacaatttgcccaatgtcttggtatgtagtttttctgtctttattttttttaacttaatattttttgttacagacataatattttttttttaggaaagaatctcattttccaatagcatctgtcagtttggccatcctaaattctttgttgtccctgcaagtgtcaaatgtatatgacattttatattttctgtgtgtctgcctattctctctgtgtgtgctctctcatgcctgtgagctttctctcctcccccctcctccctctctttccctctgtggtagggatttgttcatgagttcattgtgtgggagtcatacgctgccttaaggcgtttatcccagtgactctccgcctaatttttatgtatttatttttttaattcagtctttgacagtttcatacagtatcttttaccatgttctttcctggatccaaactcctcccattacaccccccaccccaccctctagactactacccacccaactttgtgttcttcttcctccttaaaacaaagaaaataaaacaaaacaaaacttagctacacgcatttctttgtgattggggagggagcatctttgagggcatcctgtggcgtcggagggcaactttaaggaagagtcagctctctgtggtgtggctctggggtgggctcaggtgggcagctttatgtccgccgcttttaccctctaagaaccctttccactctatcgtttgcttgcttgtttgtttatttggctggttttgttttgttttttaaacatgagtaagatgtgttttatttttattaaaattatttgatttttttctattcaaccatacaatttctcaaaaataagctaatgattgctttataaagaactttacgctttttacattttgagattataatgtaatgacatcatttcccccttccctgccctccctcccacagactctcctctctctctttcacactcgtggccccttttttgttaattattattacatacatatatatccctaaatgcataagtacagcctattcagccttcacagtgttgctttgattcgtgttgttgtggccgaccatttggcactggataaccaactggtgtacacttctctggtgaaggctgatttccccattgtgacttcggggacgactcagttgcctgtggatctttgtgtagggttgagccctcctggctttcccagaccccagtccacatttgagtgtccattgttacccatggttaggcactaatgttggtgagaccttacggatgtaacacgtgacattcctaggagacacaatctccccgctaactccctgaacctctggttcttgcaaactttctgttctttcttctacagtgttctctgagccttaagggtgtgtctcccccccccccatatctttttagactaggtctctcactctcactgaacctggaggccatcagttcagctaggctggctagcttcagggctccctatgcctctatcccaccctgtccaggctgggattgcagatttaggctactggccccatggtaattagaactcaggtagttatgcttgttcagcaggcaccttactgacagagccttctcaggcctccacctatcatattttatgatcaggcaattacattattatccagacactatttttcccagctgtagggcatttgggtcaattctcttctctctttctctcattccaactaggagtagtacaatggaagtttttatgcaggtcatctatttgttttaatttacttcagcagatcatatacacaccccaggtttgtcttatgtcagacccggctgacagtgctttcttccctgtgatggcagagcacagtccgtctcacctgtggctttccttagtcacaaagaaactgtctgcttacctttcttctaagcttccacttagagctgggagcccttacagactctgactattgatcctacagctttctacaccgtcggatgcagctgcctttcccaacctttagtctctgtttctatcccactgccccacccccaccttgcgtttgtaacaacatttcaagtagaaataccttactctctcttgttgcagcttgcctgccttattctgttcagctggtagagttttagtcactttgttttaatgtcacttggggtctgtctctgttaaaaattgtagctctccatctaagaaaatcctccagcagtaggaaaatatgacactgtaagcctagttgagcttatagatgaatttgttggccagtttggggaattgagctcagcatcttaaacacgctaataacatgttcaagtggttgctgctttgcatttaactctactgaatggtgagacaatgtattccaagtattggcgtgtggaacaaggctgccacagggctctgtttgaagagctgggcagacagtaaaagtttatagacaatatcactaagctcatattactctggagctaaattttagtttcagcaatctgtcctacagagtgagtagctaggccagccaaggctatacaatgagaccatctcagatttagggttggcaacgtcatgcatacttaaattactgtgttttattagaaaatcggggtgatgctgtttccagcctcaggaataaagtacacaagccatctgtggaatgctcatggaattttgcccaaccctgaacaatcatttaacttatacccagaccgaggaagaaaacacagccagctctcccagagtcctctcttgccaccttccaaagaaccaagctcaccatgattggcccagattactagtggcataggttattttcccggtttttaaatttgtaggaatagaatatcatttttgatagccctgatactcgtacaattacagaaacagcaaattattttcttaatttaaggaataaatgtattaaacttagtgaaaaggataacaatccaccgaggagcccagaaacccaggcacatgcacagagaccagggacagtgacagtggctgtgcaaactggtgggggacctcagtggccagggatagtattatctatactaggaatcataggatcctgctgaacctcataccacacatggctaaatgcatagtaagtctagaggcaggatgtggaggtattgagtccagtagtgtggggtgtgcttatagcatgcaagaggccaagtttagtcctcagcacacacagatacacatacacacacacacacacagagagacagacagagaggacagagtgagagagtaaaacaagcctgcttcatagagcacttctgagggcaaagggacttaggaaatggcttgcatccacagactccatctaacaatagacagagtatctaaatgggcttgttcttggcagtatccctaagccatgtggtgtgtctatatcgtattgaatactgtaagcaatctggaggtgattgaaagctaaagaatgtacagaggtgacatgcaagtgctgtaacattttatagggaggaccctagcatccttgggtttggagggtcatattatgaaatgcagcagtgcccagcatctagcaagtgccagacaaccatcagcttttcttattacagatgggtgttattacacatgtgtattattacacataggtgttactacacgtgggtgttatacacatgggtgttattacagatgggtgttagtacacatggatattattactacacatgggtgttactacacatgagtgttactacacatggatattattactacacatgtgtgttattatacatgggtgttactatacataggtgttactacacatggatattattactacacatgggtgttataacacatgggtattattactacacatgggtgttatcacacatggatattattactacacatgggtgttatcatacataggtattattactacacatgggtgttatcacacatggatattattactacacatggtgttatcacacatggatattattactaaatgtgggtgttactacacatgggtgttatcacacgtggatattattactacacatgggtgttataacacatgggtattattactacacatgggtgttatcacacatggatattattactacatgtgggtgttactacacatgggtgttatcacacatggatattattactacacatgagtgttattactatacatgggtattattactacacatgggtgttactacacatgggtattattattacacatgggtgtcatcacacagggatatggatgtcacttgtatccacacttcacagtgaatactaagggtttgttgttgttgttgttgttgaagacctaatacgagtgaaagactttttctctccctccctcgtgccctccccccttctctagaacttccgccactttttaacctggataatccctgaacggtcaccttcagaagccatcgatcggctggaaatcatccccacaaacaagaagaagagactgtggaattacgattatgaggatggcagtgacagtgacgaagaggtccccacagcaagtgtcactggctacaccatgcatggactgacgggcaagcctctgcaacaaacctctgacacctcagccagccccgaggatcccctgcatgaagaagattcaggcgctgaggaatctgatgaagctggagcaggggctggagctgagccagaactccccacagaggcgggggcggggccttcagaagaccccactggcccctatgagagaagaaagagtgtgctcgaggactcattccccagggaggacaacagctccatggatgagcctggggacaacattatcttcaacgtgaacttaaactctgtgtttctgagggttctccatgatgaagatgcctcagagacattatctctcgaagaagacaccatcctcctagacgaaggtccccagaggacagagtcagaccttcggatagctggtggggacaggacacagccgcccctccccagccttccttcccaggatctatggactgaagatgggtcatctgagaaatcagacacctcagattccgatgctgatgtgggggacggctacatcatgagatgactccaaagaggttcactgactggcgctgggcacctacagggtttctcttcagagtccgacttgatgccttgtggtctccaggtgtctgtcatggagggactagagaactctacagccctcttggcccttgctgattggccttctctatgcagattgacaatttgggcatcaggattgtttacaggggtcatgagcgtgatctgcccaccccctttccactaatgcactaaggtggtttgtgttacatttcccagggaacaggttcagtgtggttttcagaggcagcccaaggtctcctatccctatgttgtttctaggaaatgattaaattggggggagagaaagggaaagaaaaactggccaagcagtgttcaggaggactccaggaatgaacctgaaagggggcggaagggtcagaggtaaggcatgctgagctggctgctggcacaagaaaagccatcaaggtttgagcccctgctgtctgggcccttcccagatgtcaacatctgtctcctctactctaggaagttcattcacccataaagccccgcacagtgcacgtgaggagggggagaagccgcaggaataattctaggatccaacgcgtgactcagagagagggatatcatggccatattttaaggtcatttctcgtcacctctttaaccttcagttttctcaacttatgaaataaagggactgagcaggtagccttgggagagatgcccaaagtggatgaagggtgtagggtcctcccatcttactcttctcacccccaaaccagtgtttcacattttcttcttttcaaagaagaactggtacatgggtcctggctcaaagacttccaatggatcacccatgtaaagcggttcaaaagaaacccttgtgggactgataaaacccttgtcggactttttatcctgtgtgataaaaatcccacaggaaggagacacccccccccaaaaaaaaaaaaaaaaaaacacagagcaaccctttctctgccctctgaatacagctatcctcattctcccggagcagcagctttcttttaagctttgcataattgctgggagttggctttttaatgcttgcacttcattgtttgtttgtttgtttttaaattttatacgatgtttgaaattgtcagtgtaatacaaaagtacttttcatacaagactttatagtctttttgaatcgtttctctctggaatgctttctacagcatttttgtggttctgataccattacaagattgtactagctttctctaaatctgccgtggcctgctgggatggtcccctccgactctcgtgacctgttctaacttagacatgtctcaatatgtagtcagccgaccttcggtggggtttcccacctcgccacctgttctctttaagaagaggaaattaaacctttctcagcagccttgtgtaagaagcaagctaccaagaaatgaacaaactggccttgtgccatgtccttcgggtggggaggggcactaaaacttcccgagctgggctggattcagcttttgtttgggagacaagactttggaggggtgatggggaaaaacaggggacactgagtgatccaaagaaaagcaactgcccagcagcagggaagctgaggcaggaggatcacttcgaattccgggctacgtgacccacccaccaaggaagagagacagaagggaacactggaggggagagaaacagaagcgcggattgggggagggacagcactgtaacccaggatggcttcttagtgcacttagcttgaggccgccctcgaggctccggtcctcagtggggctgcgggcggagggagccagaggggagtggcctggccgcccggcggaggttccggaaagggcgcgggcggccgcggggctgccgcacggggccatgtcctgggcgccgagcgtggcgggctggctgggtggcttccttctggtgccaggtgaggtcggcgagcaggggccccgggcgggcaggctggcaggcttgggaactcggaggcggggcgtccccaaggcttggcccatgggctccccgaaagggacctgtgcggcgcccagcaccaggaagggtacccctcgccatggtcggggcggggggtgcacacccgcggcgatgcgctgccgctggctagatcctgggtggacccttcccgagcccgcagctgtttccaggatgtctagaaggtaaagtaaagcggggtgcggggacagttgttgacagcgcccccagcctgcccccgaagttctaactgaaaccagattttctgagcacccccgcagtggctgtctggtccttagggacacacaccggagtcctcccaggccccagcactccttcctctccccggtcctctgcagcgccagctccccttcaccacatctccctcttcacatgtccacaccctaaaatctgaattctgcccttcagctccccagagagctgctggggactcttctccacaactggctttccgttggctgagctctcgggattccccaactggttctcagtgggattctcttcctgagcccaaacttcccaggcagcctggtgttgagtaattaccaccacacttcgtctctgttggcaacagctgggtgataagtggtttagagtttactgcgtcaaaacttaataagtgatttctgcccttagcccaaagctgccctctatgcgacctcaggctcactcacccagaggtctctctgacagtccttcttgggtcttcagggagacctattctgctgctgactcaagactcccaggttccctgccccagctccagccagggttccaggggcttcggccagaaatccttctcattatagcttcaaataaaacctagcctccccggcatagctaacacacacacatacacacacacacacacacacacacacacacacacacacacacatccacacaacatttgaagacatggatctgagagacccaaatattggatatagtcgttttcttggatttagtgtttgtttgtttgtttgtttgtttgtctgtctgtttggttggttttggttttgttttttgttttttttttttttttttcgtttttgtttcattttgatttggtttggtttgggtcttgctttgtttttatttttgttttgttttgttttgcataaacattgctacctctcccgtcctcctcctcatctttttcagctctaggaatgattccaccccctgagaaggtcagaatgaattcagttaatttcaagaacattctacagtgggaggtacctgctttccccaaaacgaacctgactttcacagctcagtatgaaaggtaggtctgggggctgttcttaagtcagaaggcccctccttctaattccaggtcttgatctgcctactgtgttgttacccagggtagtatgacagaagtcactatgtagcccaggctggccgcaagctgaagtatttgaaaaggaaagcaggtgccgctgttactcccagttatacacctagggctgtaaaagtcagccctgtgcaaaggggggggggggcacctgaaaatgccaagtgtgcacaccggtcaggaaggcacttgcttcgtaccacctaccctccactgcagaccttctagaccaatctgggatctgccaccaccactgcagggcctctacctgtccttcctgtctgcaagtccccatatccggtgaagggtgcaggccagccttcccttgacagcctgtccaccttgcctattggctggatgccaggtaacacaccagcagcagaaggaggcccagggcccatgaaccagcacacctggcctggcctctcggtgactcagaaacgtggccagacagacaggccatagagaacatgcctttccagatctcggtagccctgccctgtttgtcccagctgtcattttacatggaggctgaagggctctacatatatacataatatatacttattatataatatatactatatatacaccatattatatactataaaaatgctatatcatataataagtatatatgtatgtgtgtatatatatgtgtgtgtgtatatatatatatgtatatgtatatgtgtatatatatatataggctcgagcacctacgttgagatttaccaatatttagcatttcctttttttttttctccctgaactctctgacttagaaactgtattaatttcttttctcgttgctgtgacaaaatgtctgatgaaaggaacgtgaggaaggagaggggctttgtttgtttgtatgtttgattgattggttggttggttggttggttggttggttgggtttattttggggggggtgggggcttgggtaagaggttgcagtccagcacagtggcagaagcagctggtcacacacagggcatccaccaggaagcagacagaaagctggcactcagcttgctctctccttcttatttagtctgagatgccagttcatcagaaactgctgctagcatccaggcatccaggacatcataaaccttcttgctctgttgaaccttcctcgaagctctcacagacctactcaggtcatttccttgctgattttaaattccatcaggttgacaacgaaaattcagcatcgtgcacacatacattccggtctgtgtttcataaaaacagtgtgtcctgttatacctcagtgtagttgccgacagtccagagaccagtgtgtcctgttgtacctcggtgtagttgccgacagtccagagactgtagttgataaaagaccatctgcagcagccctagggtggtgctcctatgacctcatctccttgtcttctccactcgggtctggaaagacacagcaatttcactgtggagattaactcccttcttctatcagtggctgttgctgttatgaaatgcctgagcctggttacaggtatctagctctagatggcagaaggacaaaacaatgcagggagggtgtcctgagtgagtgacaggacaggacactccagcaggagcttaagagggacaaaccacctctctctctctctctctctctctctctctctctctctctctctctctctctctgctcttactctgtgtctggctggcttccagggttgggtgattccagctgnnnnnnnnnnnnnnnnnnnncagggttgggtgattccagctgtctgtccttgagatggaaaggcctggtggcttcttggaggcagagaactggaggtggttattaactaagggttagtaccttgcctccagggttcctctccatagaaccacagatgggtacacggtacataaagaatatgcagccatgtccttaggaaagacactgggcctgagcggtcaggttgttatgacttatatgagtccataaggttcgctttgacttcagcccaggcaggtgaatgctgcttacaaggtgcaataaaccctctgctgtgtgcgaagtttacctttgtcccttgtcacttgggcaacagagggaggctgtcatccaggggtcaggttgtctaaaataagacacttcaaagggtgtgttggtgatattcctacagaaacatccaaaatgtaagtatgagagacactcctatcacacacttaccagaaaaaaaatactcatctatgacaaaaaatgaaaagaggagttgctacaagatgtcctctgacatgcagcatggtcgaccaccaggtgtggtaactgaatactgctctacggtagccgaacgataggcggccagccagaagagttattcggttggcaaaatgtaaagcctgagtttttcttcccaaccacttaattcccagcaataacaactcagagactgattattgatcagtaaatgcctagcttcagcttattctccaactagctgttaactattatccctgttattccaagttcagctatgtgcctggtttcttctctttaaccttcaggggcaaatcttccgcaggcctcactatttcccagaattctctctgtccctgctggatatcacgcctcctactccctgcctcagttcattggccataagcttttttattgacaggcaatacttataagagatatgctctacagcaaaatgtgcatatatattaagtgggagaggcagatggtacaagactgggttctcagtagtccttacctaccttttgcaaagctctgggcaccaataacaatggagtgagccacaatgtggtccctagagccctaaaggcaacagaactgagtgtattgagggcgcttgctgcttttgcagagaactcaagtttagttcccagtacctgtgtggggtagcttgcaggcacctgtaactccagccccaggggattcaatgtctttttctgtcctccaatggcacatgcacacatgcacgtgcgtgtgcacacacacacacacacacacacacacacacacacacacaaacaaagtaaaccttctttaaaagggcaaaggtgatccagacacacacacacagaggcatgggtttcttgtgctcttttaacctcagacttaatataactatttgcttcaggctcctggtgccttctgttcccttccataacacactgcaacctggacctgtgaacgagaataaactttctgcctcgaattgactttgccagaatattttatcatagcaacaggggaaaaaaaaaatccatgacagacaaaaagggtggccgagattggctttcacaactagacaggaaggtgtagtgggaaccagtcagacagctccttacttacaggaagggagctcctattttcttaggctgggggcagctaattacacctctccaggctgctgtgggcgagttaggaattctatttgccaagattcctgccatgcttcctgctgctctcattctgagggtggatgaattgttttagaatttgtccaggatctttgcaatgtgagtcactcttgggaagtgatttgaaatcatcttattatttcctagttaatctgtgtatgtcaaccatagcccaatcgtagcccagcgttttcagaaatgcacactcaggaaggaagctttctcagtcagaagtgttgaatatacaacctggggtgtggagccatgaaagcttatttagatattaaagtttctgctgctaagataccaatttttgtttaactcaatttctccacaaattactgagtataggatggattgtattttagatgccttgagatcattaagatcttagggaacacatagtttggaagatattaatttcctcatgcgtactatttatccaagctagtggctactgggcacagtggtacacagctgaaatcccaacgtcggagattttaaatcggcaggaagatttttaaatcagaggccaacctgggcaagaggaggaggttctctaaagcatgaaataaaaacaaagaaggagaaagatgagaagtctttcttttacctttgccataaaagggaataaagcaaccatcttcccagaagcagcaacctcactgcctttgtctttctggttgtgtagttacaggtctttccaagatcactgcaagcgcactgcctcgactcagtgcgacttctctcatctttctaaatacggagactacactgtgagagtcagggctgaattggcggatgaacattcggagtgggtcaatgtcaccttctgccccgtggaagacagtaagccatgcatgtttccactttgttatatcaagtcatcttaccttgcttctgtccccatcagtaagaatgtttagtaggcctacagatgaaatggtccgtgccatgaagcgtggggtacagcagggatgctgtgtctgtaagttcatggattcatggatgaagcagaggaaaatacacatgtgctgaataaaataaatgaatataaacttggtggcttcgctactcacaaatatggcaaattaaggccagtgctgttaatgagggaatggaaaactctagaagaaagtcagtgtgagactatgaattaagccaagagataggggcctggaaaatggctcagcgcttaagagaactggctgctcttccagaggacttgggttcaattcccagcacccacaagtctactcacaacagtgtataattccagtcccatgggatttggcaccggttctggccgctttgagcacctggtacacagagcatacatacaggcaaagcaccatacacctaaactaaaaataaaatgcaaaataagttttaaaatatgggagaagtggagagaggtagatgcagagagagaaagcccagtgcagagagaccactgtcctggagaagggtggaagaaatacactcactgatggtagactctgctgaggctggctggtaagctttggaaagaagataccctggttagaagtggaggctagggggacccagaggtcctgagatgcacatgtttaaagtatcaggaattgaaaaccagttaagctgccatcaagcatctgggagaattagaggttacaaaaacatcagggacaaagctcaaataaggccctcccaggggcatcagagggaatacccgggtctgggggccagggcttatacaggtccttacaggtgggttctgtagcttccacagagagatgctcactcagacagaatgaggcgaaagtcccttgttctctttccagttctgtcttaggacaagcaccaaacttagaattctgcacctggaaatggccagttagtcttcttcgctaaatgttcctttctgaaaacaagggaaggaaatgaccgttgcaaaaagacagttcactgagagtcaggctctaaaactaaaccggtcttcagtggttaccaagggttcctgcaaacccatctcgagcagaagataccataaatcaagagtgcatttggcacgcctagcctgccatgccacaccctcctgatcccatgactgatggggaggtaacagactacagccatttccttgaactgaggggatatagcaattcaaaggtcaaaggtcaaaggtcagtctctgtttcctgccagtatctttcacacaaccattataagttggggaccgtttgatagataagtttccactgtagtaatttcttattgggcctggctggttctaagtcttacattatgtcccagggaagccagttctctgtagactcagatcaaagagcatgactcaaggttacacgtgtaaaagtgagagagcagagacgctgacacaggcccctgtggcttagcaagaggcccccctcaggagtggcgatggtcagagaggagaacacagggccaatcttcctcagagtcttttgttattccttctgtggttatttttgagcacctactgtgtgcgaggcatgttcttagcactgaagctacaacaacaaacaaaaacaaagtcttgccctcatcgagtgctctagactcataggaagactggcagcaacccaagaggcagatatttgacggtacagagtgaatgcggctctcaaagtggaaaaatcaacaggaaagaggaatatattcttaccagagagccacagtatacaggctccccagagtgacgtttgaatggatggagatggagaaggggtgaagggcctagctacataagcaaaagaaaagttgtaaactatatatagttctagatgataaatatttatgagtaatccctacagttacagaaatatcatttgtagctttaaggctagaaaatgaaaaagaatccaagccagtagaaggcataaaacaaagagaaagagaagaatttaataaaataagaaatgtaaaaacatattgtgtgtgtgtgtgtgtgtgtgtgtgtgtgtgtgtgtgtgtgtgattgtgtgtgaagcatggtgatggtgacatgcctttatgtcatgtctgtaacaacagtgttgtcaagacttaggcaggaagatcgaaagtttgaggctaacctaggctacgtactgggatgacccctccctaaaaatgccatttttacaaacaatataaaacaataggattggaataatcctaaatttattagatattactgtgaacataaatggatttaattcaattattacagacaaaggattttggatcttttgaaacaagcaaaaaaaaaaaaaatccatccatcctcctgaggcactgtagatggtgtatcaagagccagcgttatccttcagtagatagttgcacatatatatgaggaattcgtgttcgagtgaagtgtttaaaatgtggttttttgattgtcattctggtgtgttcttatactcagccatcattggacctcctgagatgcagatagaatcccttgctgagtctttacacctgcgtttctcagccccacaaattgagaatgagcctgagacgtggaccttgaagaacatttatgactcatgggcttacagagtgcaatactggaaaaatgggactaatgagaaggtaaggccgcctctcgagtgcatctgacatgagtattgtgctctccgctcagtttggtaagctgtgatgagagagaggaatgggcacccagggaccacgcggggaaggctcagtgggtaaagtctttgctgtgcaaacatgagggacagaatttggattccccaacacccaagtttaaagccagggatgcgcagcggtagtcacagtgctgagagatggggacaggagaatcctgggatctcactggtctgctgttttagtcctttggggagatccagattccgggagagactctgtttcaaaaacaaggtggccagtgacgcaggaaggcactgatgccaacctctgacgtgcacacatacacatattgatgtgtgctcacacctatgcatgtatacatatacatattgatgtatgtacatatccatgcatgcatgcatacatacacatattgatgtgtgcacacatccatgtatacatacatacacatattgatgtatatgcacatttccatgcaggcatacatacacatatgg

SEQ ID NO: 128 - DNA, 2714 bp, Mus musculus
gccagcggagactcttcgggtcgcggggcaccggccatcccgccgccgtccctttcgcctggctcggctcccgcctgcctccactgctcgccagccgcgcgcagctgcgcctgatgcccagagcagctcggaggtggccccaggacatcccagagggggattcacgagacccggcgattcaggtgtgagagcagaaaaacggacttaagagctgagcaggatgcgttcacggtgcaccgtctctgccgtcggtctcctcagcttgtgtcttgtggtgtctgcgagcctagagactatcacaccgtctgcttttgatgggtatccagatgaaccttgcactataaacataacaatacgaaattcccggctaattttatcctgggaattagagaacaagtctggcccacccgctaactacaccctctggtacacagtcatgagcaaagacgaaaatctgacgaaggttaagaactgttcagataccacgaagtcatcatgtgacgtgacagataagtggttggagggcatggagagctacgtcgtcgccatcgtcatagtgcacagaggggacttgaccgtgtgccgctgctcagactacatcgtgcctgcaaacgctcctcttgagccgccagaatttgagatcgttggctttacagaccacataaacgtgacgatggaatttccacctgtcacttccaaaataatccaggaaaagatgaagactacaccctttgtcatcaaagaacagataggggacagcgttaggaagaagcacgagcccaaagtgaataatgtcactgggaacttcacatttgtccttagagacttacttccaaagacaaactactgtgtatctctttattttgatgatgaccccgcaataaaatctcccttaaaatgcatcgtccttcagcctggccaggaatcaggattatcagaatctgctatagtaggaataactacttcgtgtttggtagtgatggttttcgtgagcactatcgtaatgctgaaacggattggttatatatgcctaaaagacaatttgcccaatgtcttgaacttccgccactttttaacctggataatccctgaacggtcaccttcagaagccatcgatcggctggaaatcatccccacaaacaagaagaagagactgtggaattacgattatgaggatggcagtgacagtgacgaagaggtccccacagcaagtgtcactggctacaccatgcatggactgacgggcaagcctctgcaacaaacctctgacacctcagccagccccgaggatcccctgcatgaagaagattcaggcgctgaggaatctgatgaagctggagcaggggctggagctgagccagaactccccacagaggcgggggcggggccttcagaagaccccactggcccctatgagagaagaaagagtgtgctcgaggactcattccccagggaggacaacagctccatggatgagcctggggacaacattatcttcaacgtgaacttaaactctgtgtttctgagggttctccatgatgaagatgcctcagagacattatctctcgaagaagacaccatcctcctagacgaaggtccccagaggacagagtcagaccttcggatagctggtggggacaggacacagccgcccctccccagccttccttcccaggatctatggactgaagatgggtcatctgagaaatcagacacctcagattccgatgctgatgtgggggacggctacatcatgagatgactccaaagaggttcactgactggcgctgggcacctacagggtttctcttcagagtccgacttgatgccttgtggtctccaggtgtctgtcatggagggactagagaactctacagccctcttggcccttgctgattggccttctctatgcagattgacaatttgggcatcaggattgtttacaggggtcatgagcgtgatctgcccaccccctttccactaatgcactaaggtggtttgtgttacatttcccagggaacaggttcagtgtggttttcagaggcagcccaaggtctcctatccctatgttgtttctaggaaatgattaaattggggggagagaaagggaaagaaaaactggccaagcagtgttcaggaggactccaggaatgaacctgaaagggggcggaagggtcagaggtaaggcatgctgagctggctgctggcacaagaaaagccatcaaggtttgagcccctgctgtctgggcccttcccagatgtcaacatctgtctcctctactctaggaagttcattcacccataaagccccgcacagtgcacgtgaggagggggagaagccgcaggaataattctaggatccaacgcgtgactcagagagagggatatcatggccatattttaaggtcatttctcgtcacctctttaaccttcagttttctcaacttatgaaataaagggactgagcaggtagccttgggagagatgcccaaagtggatgaagggtgtagggtcctcccatcttactcttctcacccccaaaccagtgtttcacattttcttcttttcaaagaagaactggtacatgggtcctggctcaaagacttccaatggatcacccatgtaaagcggttcaaaagaaacccttgtgggactgataaaacccttgtcggactttttatcctgtgtgataaaaatcccacaggaaggagaca

SEQ ID NO: 129 - protein, 517 aa, Mus musculus
ELSRMRSRCTVSAVGLLSLCLVVSASLETITPSAFDGYPDEPCTINITIRNSRLILSWELENKSGPPANYTLWYTVMSKDENLTKVKNCSDTTKSSCDVTDKWLEGMESYVVAIVIVHRGDLTVCRCSDYIVPANAPLEPPEFEIVGFTDHINVTMEFPPVTSKIIQEKMKTTPFVIKEQIGDSVRKKHEPKVNNVTGNFTFVLRDLLPKTNYCVSLYFDDDPAIKSPLKCIVLQPGQESGLSESAIVGITTSCLVVMVFVSTIVMLKRIGYICLKDNLPNVLNFRHFLTWIIPERSPSEAIDRLEIIPTNKKKRLWNYDYEDGSDSDEEVPTASVTGYTMHGLTGKPLQQTSDTSASPEDPLHEEDSGAEESDEAGAGAGAEPELPTEAGAGPSEDPTGPYERRKSVLEDSFPREDNSSMDEPGDNIIFNVNLNSVFLRVLHDEDASETLSLEEDTILLDEGPQRTESDLRIAGGDRTQPPLPSLPSQDLWTEDGSSEKSDTSDSDADVGDGYIMR

SEQ ID NO: 130 - DNA, 52677 bp, Homo sapiens
gggctgggccctgggccaatttggtatgcacctttggtggaagcatcacacatgaggtgctgccttgttttcatcacttcctgttgcatgatgcacagctctgctttgtctcattattgatgacgttcaattttaccatttaagatgacctcaccagggtttgccactgtaaaattattcttttcccctttgtaattaataagcatttttgtgatgagacactttgagactatataaatgtattgttcttcatcaaattttctatttattcagtatttaaaaaggaaaacacaggtgtaaactcccaatacgtagcttgtcttttcattatcttaacagtgtttttcacagagcagaactttttaatttaaataaaatccaatttttttttttatttcatggattgtgcttttggtgttggatctaaaagtcatcaccaaactcaaagacacctagattttcccctttgttatcttgtagaattttttgagttttgccttttacatttaggtctatgatccagttcaagttaatttttgtgaaaggtataaagatgtgtgtctcaatacatcttttcacatattcagttgttccagcaccatttgttggaaagataattctttctccattggattgtctttactgctttgtcaaagatcagtctactgtatttttatgggtctatttctgggctctctattctgtttcttaggtctatttgcttattttttcaccaataccatactgtcttgattattatagctttatagtaaatcctgaagtcagatagtatcagtcttccagctttattctacttcagcattatgttagctatctgggtcctttgtcttttcacataaacttgagaatcagtttgtcgctattcacaaaataacttgttgggattttggttgagattccattaaatgtatatcaaattgggaagaattaacattttaacactactgagtcttcctatccattaacatggactatccctctatttttttttgatcttttatttctttcattaacgttttatatttctcctcatacaaatcttctacgtattttgttagatttctctctctctctgtcactctgtgctagtgtaaatggtattgtacttttaatttcaaattctaattgttcattcttgatatataggaaagcaattgacttttgtatagtaatgttgtatcgtgcaaccttattaccatttaaaacactaactatttctaggagtgatttgtgagggttttttttttttaatcagttctttggaatttcctatgtagataattatgttatctgcaaatttaaaaagttttatttattctttcccaatctgtacatctttctttttcttatcttattgtattacctagtacttccagtacaatgttgataagactaatgaaatggatatccttgctttcctcctaatcttagggaagatgcatccagtttttcacaataaagcataatatcagctgtagggttttttgtagacattctttaacaagttgagaacattctctcttcctagtttgctcagagtttttatcacaaatgttagattttgtcaaatgctttatcttcatctattgataggtgatttttcttctttagcctgttgatatgatggattacattaattgattttcaaaggatgagccagccttgtgtaactagaataaatcttatttaatcatggcctataatttcttttatatatggttggatttggcttactaatattttgttgggaatttctgcgtctatgttcatgagagatattggtctatagttgtcctttcttgtattgtctttactggttttaccattagggtgatgctggcttcacagaataaactagaaagtgttccctctacttcaattttctagaagacataatagagaattgctataaattcttccttaaatatttggcagaattcaccagtacaatcatctgagcctagtgttttctttttggaaggttatcaattgttgattcagttctcttttttttttttttttttttttttgagtcagagtctcactcttattgcccaagcaggactgcaatggctaatttttgtgtttttggtagagacagtgtttcaccatgttggccaggctggtcttgaactcctgatctcaggtgatccgctggcctcagcctcccaaagtggtgggattacaggcatgagccaccacgtctggccttgattcagttctttaatagatataggactattttgactatctatttctccttgtgtgagttttgatagattgtgtctttcaagaaattagcccatttcatctaagttaataaatttgtgggcacgaaattgttcataatatttctttattatcctttgaatgtccataggattagtagtgatgacctctctttcatttctaatattggtaatttgtgtcttctctctcttttttttcttggttagcccacctagaggtctatgagttttactgatctttcaaagaatgagcttttggtttggttgattttctctattcattttctgttttcaatttctttgatttctgttttaatttttattaattcttttcttctgtttgttttaggttacattgatcttctttctctagtttcccaaggtagaagcttagtttttgattttaggtctgtgttctgtcaacaaaaagagtcaaactctgtaaaatatttgaagagatttattctgagcccaaatgtgagtgactaatggcccctaacatagccctcaagagatcccaagaacatgtgtccatggtggtcagggcacagcctagttttttttttttttttttttttttttttgagacggagtctcgctctgtcacccaggccggactgcggactgcagtggcgcaatctcggctcactgcaagctccgcttcccgggttcacgccattctcctgcctcagcctcccgaatagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctcacagcctagttttatacattttagggagatatgagacatcactcagatatgtgttagatgtacattggttagatctggaagggtgggttaatccgaagtggggtgaggcttccaggtcacaggtagatttaaatattttctgattggcaatttgttgttattatcaatagaaaagaatgtctgggttacagtaagggattgtggacaccaaggttttatcacgcagatgaagcctccaagtagctggcttcagagaggatagattgtaaatgcttcttatcagacttaaggtctgtgttgatattaatgctggtcagcttttcctgaattccacaagggaagagggtataatgaggcatgtctgaccccacctttcatcatggcctgaacaaatttttcaggttaactttggaatgcccttggcagagaggacagatccattcagatggttggggggagggcaggggctgcttataactatattttttggtttacacttcttttcttgtgtattcatttaatgccatacattttcctctaagcactgctttcattttattccacaaattttgatgttttattttcatttttattcagttaaaatattccaattcttcctaagtcttcttctttgacccatgtgttatttacaagtttattgtttaatctccaaatattttgggactttttctagctatctgttattgatttcaagtttaattccataagatctaatagtatattttgtgtgatttctattctttcaaatttgttagcatgagttttatggcccagaatgtggtctattttaattaatgtttcacaagaacttgagaatgggtattctgctgctgttagatgacatattctataaatgccagttagatcaaattaattgatggtgctggtcatctcaactatatccttactgattctctccctgctggctcaatctgtcaattactgataaacagatattgaaaactccaactgtaatgatggatttgtctatttctccttgcagttctattaatttttgcatcatatatttagacactttggagttgggtgcatatacactaaggactgttatgctttcttggaaagccgactttcttatcattatataattgtcttttaccccagataattttctttgttccgaaatctgcttgcctgaaattaatacagctactccagctttcttttgattaatgttagaatgtcatatatttctccatttttcttcttttttttttgaaactggatctgcctctgttgcccagcctggagtgcagtggcacaatcatagctcactacagccttgaactcctgggctcaagtgatcctcccacctcaatctcctgagtaactaggactacaggcacctgccactacacccagctaaaatttttttgttttttgtttttttggttttactatgttggtcaggttggcatttttaaaaatgtaatctatcagtgtctctatatttaaagtgggtttctggtagacaatatatagttggcccttgatttatttttaaatccactctattagtctctgtcttttaattggtacacttagaccattcacttaaatatactattgatagttagattaatatctcccatatttgtaactgttttctattcaatgcacttgttctttttatgtttattgttgttgctgttattgtttttcttccttctctttttctgccttctctgttgttgttgtttttttgttttttttttttcttttgagacggagtctggctctgtccccaggctggagtgcagtggcacgatcttggctcactacaagctctgcctcctgggttcacaccattctcctgcctcagcctcctgagtagctggcactacaggcacctgccaccacgcctggctaattttttgtatgtttagtggagacagggtttcaccatggtagccaggatggtcttgatctcctgacctcgtgatccgccccctcggcctcccaaagtgctgggattacaggtgtgagccaccatgcccagcccttctctggttttaattgaatattttatatgattccattctcccctcacttagcacattaattgtattagtcaggattctctagagggacagaactaataggacagatgtatatatgaaagggagtttattgggagaattgattcacatgatcacaaggtgaagtcccacgatcagccatctgcaagttgaggagccggaaagccagtccaagtcccaaaagctcaaagtagggaagccaacagtgcagccttcagtctgtggccaaaggcctgagagcccctggcagatcactggagtgaagtccaagagtctaaaagccgaagaacttggaatttgatgtttgagggcaggaaacatccagcatgggagaaagatggaggccagaagacttagccagtctagcctttcccccttcttctgcctgtttttatcctggccatgctggcagctgattagatggtgcccacccagattgagggtgggtctgcctttcccagtccactgactcaaatgttaatctcctttgacaacaccctcacagacacacccaggaacaatactttgcatctttcaattcaatcaagttgaaactcactattaaccatcacattaattatacttctttttaacaaatctttagtgactgccctagagtttgcaatatacattataactaatctaagtccattttcaaataacaatacactaattcatgggtagtacacaagtatcttagaaaagagtatccccaatttctccctctcaacccttataacattgttattatacatttcacttattcataagctataatcaaccaatatgttgctgctattattatttggacaattattctcaacctgataaagaacatctacagaatccctacagctactcacagaactcaggaaagcactttacttactattaccggtttatataaaagatacaattcaggaacagccaagtggaagagatacctaggacaaggtatgggagaaaggggcactgagcttccatgccgtctctaagtgtaccaacctcccagaactttaatgtgttaaccaacccagaaactcttcaaactctgttggttgttcaggggttatttatggaggttacatcatgtaggcatgattgatcattaactcagtctctagtccctctctccttcctggaggttggggtggagggggtagggccaaaagttccaggctttattgattattgggcttggtctttttggtgaccagcctccatctaaaagctatccaggggctcaccaagagtagcctcattgctgggcgcggtggctcacgcctgtaatcccagcactttgggaggccgaggcgggcagatcatgaggtcaggagattgagaccatcctggctaacatggtgaaaccccgtctctacaaaaatacaaaaaaaaaaaaaaaaaattagctgggtgtggtggcgggtgcctgtagtcccagctacttgggaggctgaggcaggagaatggtgtgaacccgggaggtggagcttgcagtgagccgagatcgcgcagctgcacttcagcctgggaaaaagagcgagactcggtctcaaaacaaaaacaaaaacaaaaacagtagcctcgttataacgcctatcacccctattactcaggaaattgcaggggatttaggagctctaggcaggaaccagaccatatatttttctatgaaaaaacaaaacccttagcatagcgatcatcatgattttaaattcctagtctgatttgcaaattctctgccatctccgagtcttatttctaagcttgctttgtctcttccaattgtgcttggtgttgtctgcctttcagcatgccttgtaattcgttgttaaaaactagatataacatatcaggtcatgggagctgagataaatggccctttaggataaggtgttaggtttatctggctaagagttaggctgtgttaaatgtttgctgtagttgtaggtgtcagaggcttcagttttatttagtgtcctcatttttgtctcctccattgtctttgggttttcctagaaatgccttcttaaatggagttgtaatccaccgttattatactacagagtcctgttgatgtggtggtaagatactgtggaggcaaaacattctacaatcttatgattaattcccagagttttctttaatgggcctgagtctctgggctatgaccctccgagaagtttcttaacttttgcttttttcctccagtcatgatagacaggaaggctagagggggctgagttgtctaattgcccttctgctaggtcagtttaggctccagtaatgtaattgccctgaggacaggtttttgttacagaacactctgggcatatctcaaaatgtttacttttcccctcccaccggccagtcaggaatttttctgtggtctttaccatgagaacttggtagagcttcttggagtaaacctttaacaatttggggagcatccctctaagactgagtacccaacagtgtttaattctcaagctagtccacactcagtctccagcaattagtcaattacaatttaagttttgctatgatttcagaggcttctggtccctgtaaactgtgattctttgcatttgtctgtctttcagtttttgcagtttgccctgtgactcaattcactgatactgaaacaagaagagttgttaatcttcaatttgttcagcttttctcttgttgtggggagtggagtgacagctttcaagctcttcacaccttggcatagactgcatttgcttttgttttgttttgttttttgtttgtttgcttgttttgagacggagtctcgctctgtcgcccaggctggagtgcggtagcgcaatcttggctcacggcaagctccacctcctgggttaacgccattctctcgcctcagcctcctgagtagctggggctacaggcgcccgccaccacacctggctaatttttttttttttttttttttttttttggtatttttagtagagacggggtttcaccgtgttagccaggactgcatttgttttttaaaaaatctttttcctaattatataagtaaggatgtttactgtagaatgtttggaaaggaaacaaaataaaaatcacctactatcatccaatctgcaataagtcatagttaaggttttgacatagttttatttttaatatatatgtttatataaaagagtgcatgcagcacatggagtttggtattggatttctcccattttcagaggctatttctgcaaattctctaaaactgtggctgaaaatattttcaatgttgaatgtcttttataagaaataggatcctagataagttcccttcagatcgtatggggctggtgggaattctgccaagggtcacataagaggcaggaccgtgacatcctctttatgatcacccttgtgcctagccttaaaggagtatcagcaaatgttggttgacttcatagattaaaaggctcatttttcccatctacaaaaagtatgaaacatcctcctcctccctttcctaggaggccagaaagctgaacgagagattaaatactcagttaaaacaatttaggtggttagtgtatcttttccctctccttcaaaaagatattaacatttccattttagtagctgtaatgtttagaatatacatacattttacttgaaagctgcctcatagtctattttggttttggattttcttttttttttcgtttttcttgagacagagtttcgctcttgtctcccaggctggagtgcaatggtgcaatctcaactcactgcaacctccacctcccaggttcaagcaattctcctgcctcaggctcccaagtaactgggattacaggcgcccgccaccacgcccagctaatttttgtatttttagtacagacagggtttcaccatgttggtcaggctgggtcttgaagtcctgacctcagatggtccatctgccttggcctcccaaagtgctgagataacaggtgtgagccaccgctcccggcctcatagtctattttagaagttgacaggctataaataacaagcagacaaattaatgaagaacatctgtctttctgcctatcccgaaacacgttgatcagtggggggtcgagggaagggtaggagtatggagaagagacccgcggagaagaggggagaatctacaacggataatgttgtagatatttacaacatttactcaatggtaggtatttttatcctcgttttactagttggagaattatatcatgcaggtttatacaattaacaagtgggggagccaggagagaacccattcactctttagttcattcattcattcagtcagtcaacacatctttgggtgtcttctaaatgccaggcactattctaacccctaaggatacttcagtaaacaaaacagtcccaaattcttcccctatggagctttctcggcgaaggcgggattggttaggagctgacaatcggcagcagacgattgtaaatgaccggaccttttttctattctcctgcccagcccccggcccggcctccgcctccggccctgctccagccccgccagcggcccaggacccgcccctggctccggccccgcccctggctccgcccccgcccccgcgccggcggcggcgcggcgcccgcgcttccgtatcgctcctcgtaggccggggctcggcgcgcgcacccgcactaaagacgcttcttcccggcgggtaggaatcccgccggcgagccgaacagttccccgagcgcagcccgcggaccaccacccggccgcacgggccgcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaaggtaacgcagcgtggcggggtcgcgggagcggagcgcgtggccagctgactggagggaaaacgccgcctccctgcagcggttcccggaatcccctccggttccctctcgctctccccgactcctcctcctcctcctgccctccctctgcgtcttgagtatgcggctagtgcgcccttcctctctcccggggccgcacctgcgaccccaggacccctcccgggccctgtcctgcgccctccacgcgtcgcccctgctgggagtccgctttcgttgcacccctccgcgtcccaccccaccccaccaaggatgcccaggataccgggcatttgccactgcaagatgtgagtcgttgctaagtttgagggtcacattcctccaggtccaccccgccttgcaaaaccggctcaccagctgggtgctcaggttcgggatctccagcccgcccccttgaggtcccctgggattagcccccctcgacctgcgtcagggtcacagactgcagccggggctggagcggcctacacccctccggatccgctgcgtggaggcaggagggggaaggggcgaggggacgtggccgcggagacagaagggtgcaccctcccagggtcggagaggggagatactgggaagatactccgcgaatatggagaggcgatcggcacttgcatttcaaccctgagcaaatcaatccgttacacgcagtagcgagttgactccatcagcccgtttatttggttagcgatggttatattgactctgagtattcccacctcctttcttttaacatttttttttttatttccttgttttgtttagcaagaagtcttagaaacgaatatagcatgcttgggcgttgattcagtggtgagaagtgccggagctggctcagggagaggtggagtttcccatgtgtgctcactggcccaggggctaagtcccactgcttgccaaggtttctcagtatcctgtccacccaccccctatccacctgtgcaggcttgagggggtgagggggtagcagatactctatcaaaatctaccctaaggaaaatattcgataaacactcctagcaattagggcatagctgataaggcttgatctgtttgtcgcagaaaatgacttgaacttgtaagttctattgttcataaagttgttttccacaattttagataatcaaaaatgtacatgactcatttttcttacctattatttcctctaaagtttctcatgtatttattgaaaagttaaagaaaatctgattttggttcacataatttgacaatggtgatttgtctaaaagtcatttcaaaaagtagtatgaaaaggatcataaccctagaggtactgtcatagacgtgaaacatttattaaaatatatattccatggctcacacttgcacactcaaagccacattggactcattttttctgctacctttataaaccttcaaactgttcaagagtcaatggtatgtatcatcttccgttatcaatcatcatgttttgttttgtttggtttggtttggtttggtttggtttttgacaaagtctcgctctgtcgcgcaggctggagtgcagtggcactgtcttggctcactgcaacctccccctcctgggttcaagcgattcttctgcctcagcctcttgagtagctgagattacaggcgtgtgctactacgcctggctaattgtatttttagtagagatgggatttccactatgttacccagcctggtctggaacttctgacctcaaatgatccacctgctttggactcccaaagtgctagtattacaggctcaatcatcatgttttatcaaagctaaaacccaaactaaaatgccattgcttataagatgcactttcattttatgtaatgaagtaagaaaaaacactgtcaatcatgctatgccatgccaccagaatgaaagcattctgatttcagaaattctcaaatgttaaaagaaaatgggcattttataatttgtgaaatattagtgagttagagcagagcttgacggcactggccctgagggtccttcttcttcctttggaagaatgaaactgggggctatgcaattcagggaagaataaaggaaaaacaggtaattggcagaggaggttggctgacttagaggtatggaaaagacaaaacaaaggagggaaaaagagaggtatgtatgatggggaggagttcagagccactgaaaattttctctggccctaacaggaaaacgagttaccccacaagccagggttttatcatctggtacgtggagatatccatcagcattgtcattggttttcatttgtttgtttttaattctcaagtttaaaaaaaaatttaaaatttaaatgtgtctcaaccaccagaaactatagtgagatttctctgtaataaataggaaagaaggagactgatccagtccttgttaaaaaaaaaaaaaagaggaaactgaatcacaacatactttgcttttttcttttctcacaaaggaacagtgggccctttatgctgggtgaaggtgagtgagatgggggaaggttcactgggcaccaaccttctgggctagagaaattgcccaggctttacagaacaagctggaatcagataaagttgtggaaaggaagtcgaggtttcactctgccatatcagtaggaggtactaaagccaaactagtagcagcaaagtgaacagaaatggtaagggggaaaaataggaaaggaaagaacaacgtggattgcaagacgtcttactaaaaacaaagaattacacttggaacagaagaaattcattaccattgccttacactgtgcaacaacttgataaaaatataaatccaataaaacaaactcaaagatgagaaaattgtaaactggagatgaaaagggagattgcagacctaaaggaaaattgaagaccgtaaaaacatagtgacagaataaataagtcaggagaaagaacagaagcaatactgctgaaaataaaagtattttaatagaagaaagcccagtaaggaagcccagtaaattcaactgaaaagggacaaagattaagaagaaagaagctattatgaaagacaaaatacaatcaagaattgggaccactgaagtcccagatgtagagaagtcaacaaatgggacagaaaattcaaataaaaataagtccaaagaaagcttattgagatgaagaaaaaatggtctgtaggccaaaggaacatgccatgttccagaaaatgtcatgtgggaatacggaagcactacgatatcttaaactatttaaattcaaagaaaaagatttaggaatctaagaagaaaaagtaaaggagggaaaaacaaaatcaagctcgcctcagacttcagtgcagcactaaatgccagactatgatggttgtgaggaaacagttccaagggaaagaaacttttccgaggggcatattttttttccggaagaacaaagggaattcagcacccatgaaccgtttttggaaaaacaaaaacttgctgagtaataaaatccaggaaatagcaaattaagagataaatcaaaataaagaacttaagagtagagaaaggtaaaaagacttggtgagtatttattctatttaaatatagaagtaatacatctatagaaattgtgggtaagatagaatgcgattgttattaatctagacaaaaatatacagccaaaaaaaaaagaagtcagagaggaagatggaaggaaacatgagaataccaatattctcttctttcaaagaatggaatagtaaatatggtataaaattaaaagatgctatgtgaatatataatactgcaacttttaatatctttcataagttttatttaaaaccttagagggatatcataggaaattatactttcttatggacaaaaaaatttaaattttaacaactcctttgactttattttagtcttttcccaagtaacattaaacagaaacactgtgtgtgtgtgtgtgtgtgtgtgtgtgtgtgtgtgtgtgtgtgtttatgcatagaaagatctgtgggattatgttcgcctaatattaatgatagtaatagtttttacagaagaaaaaagaaagatgtttgaaaaataagctagaatcaaatatgccaagatgttaacaattgttgatgctggatggtaggaataaggatgagtgttactttcttatttgtactttttcatatttttctaatttccagaaaaagatatgtaattgtttttgtctaacatttctgaatccacttcattcattattcattgcctccttgacaatgtgcatcagtctatgtcaaacagaaggaaagacacagccatactttaccaggagactatgaggcagcgagttcctggagggttgtttgtctgtctaggaggagttggaattcaaagaatcacttcactcaatccatccattttatctgggccttgaaaattggcagggtttgtctggtctcagggtgaatagcaggtagagctcttctttcagaatggagaaggccacagtgtcacagggtgaacctgtgacaaaattggggttcagcctgggaagccacatgagttgttggcttcgcacaggatggaattaaagagcaagctgacagaattaagtgaaagcaagtttattaagaaagtcaaggaatgaaagggtggctactccataggcagagcagcagcatgggctgctccactaagtatacttatggttatttcttgatcatatgctaaacaagtggtggattattcataagttgtctgcaaaaggggtgggagttctggaactgagggttcctcacttttttcgatgatatagggtaacttctgcatgttgccatggcatttgtaaactgtggtggcactggtgggagtttcctttagcatgctaatatattgtaattagcatatgataagcagtgaggacagttttgtcaccatcttggttttggcaggctttggccagcttctttactgcgtcctgtcttatcagcagggtctttgtgacctcctgttttatcacataactaagaatgcctaaccccctgggaatgcagcccagcaggtctcagcctcattttacccagctgctactcaagatggagtcactctggttccaacacctctgacaagagcagggggtgacctgtcacctggggctcagcaggacaataactctaggaaaaactggaaaggctgatagccttgaatttaacctaaggagcttggtgcattgtcaggcaacagtgagctacagactgagctcactacataattcacagggcccacccagagccaaataaaaatgcctgagaaagtaccactaaaggtactaaaatataaagccttttcttccacagtctctctctctcaacacgtaatgtttttttgtttgctatttaatatcattctaagtaaaaaaataggccgggcatggtggctaacgcctgtaatcccagcactttgggaggccaagtcaggtggatcatgaggtcaggagatcgagaccatcctggctaacactgtgaaaccccgtctctactaaaaatacaaaaaattagctgggtgtggtggcgggcgcctgtagtcccagctactctggaggctgaggcaggagaatggagtgaactcggaaggcggagcttgcagtgagccaaagtttgcgccactgcactccagcctgggggacagagtgagactctgtctcaaaaaataaaataaaataaaaaataaaaataaaaacttgaattattagcatgaatattgcagttctttatattatgcaaaaccagatttaaataagagcatttaattcatatatggaattgccaagttataccattagtactttacagcacatcttgggaggttcccttgaactagccagaagaagcaaactgaagccagacagaggaagattgcaaagaggaagagagggtctccaccaggcacagagccacccaagggagccctccctcaggctcagggataccgagggagccagagcagattcacacaggtccctggggcccctctgccctggtgactctaggatgcatgtacttgcacctgacttctaggcatccccctcctgctagcttcccctcgatccagcctggggcaggctctgtggaagtcaagccttgcatctccctttcccaagcacctaccatcctaacccacagtgtagtggccacgtccaagggtctttacgtctctgcctcagatatgctaggtacctgggtcaagagtgacccagagactcatccctgccagacccaacctccagccagtcaccctctgactccagtccatggggcgaggctggagtgctggccctgacctctccagcatctgcaccaggagggcttcagcggaatgtggtcccagttgatgccccatgccaacagtagcagcagcagttgttaggcatagagattgaagccagacagggcctgggattcctctgctgggagcctaaactgcaggagatggggaaggatccaagtgtgagctggggctcctagcacaaaactcacattgaaagataaaatggttaagaatttcaggatagccacaggagaacctcaagccaagtgtaggatccttctagctgcagggcctgggggtactgagactagccctgttgacaggagccatgctttaggaagactgatctatttgtagtcagcaagagttttaaggagctccattaacaatttaggcacgatgccaagatgggatattatattttccaagcaagaagaatctggtaatcaggcatatggttccaagtgaagtataagtcaccagaaagcaaggaaggaagccatcccctggcccagagggggagaatggggtgtgtgtgtgtgtgtgtgtgtgtgtgtgtgttttctcggctgctgaagagactgagtgttcctgcagatatataacaaagatgaagatgtgccaccgttggagacaaatggggaccagaggccacatgtcagaggtcaggtcaggtgttcaaatataaaggggttgccctggctgggcatggtggctcacatccataatccaagccctttgtggggctgaggccggaggatcacttgagcccaagagttcaagaccagcctggacaacatagcaaagccccatctctaaaaaaaaaaatacaaaaattagccaggtgtagtggcaaatgcctgtagtcccagctacttgggaggctgaggtgggagaatcgcttgagcccaggaggcagaggttgcagtgagccgagatcacaccactgcactccagcctgggtgacagagtgagaccctgtctcaaaaaataaagaagttgcccttctacaatctggatgtggtggtatctaggggaatgttcacaactaggcaacgcctctgctgtggattgattatgggagatgacatcacacatcaagatatctcagcagatgtttctcaatgggtacagtattatgggattagttccaggcagtcgtgcttggatatctcatgggtggtggagtctgtagcaaggctggaaattttgacttggaatcacttggatttctctaagagaataccccaggttggatgtgttactgtggcagcagagaagacttaaaaattacattgtttttagcttgaacttcgtcttgtgaagtcctaattagggaagaggagtcaggctgggggtctaggggaaagcaaagagataaagcagataagccataggtctaccttgcttcatggtccaggacatacaaacaaaaagaagaagcagataagctataggtctgcctttctttatggcccaggacatacgaccctcctgcacacataactcacaatcttcctgcgtatcatcaaatgcttcaacttatcatcaaacatctcggctgaccgaaaaatgcaagttagctccctgctaccttggcgttgtcagtcctccacatagcactcttcagcttaaattgcattttataaaatccccagcaagcctttgtctcctggcagtcaactcgtctcttactgacctgcccattgctcccttgcaatgtattttcctactttctctaataaatctgcctttcttgacctaaactgtcatggtaaattcttcttactcctatgtcaccagccacagacagtcgccacaagccatgacaagtctgcgatttcatggtctttttttattttgatgatatttccccagtgtttgggggacagaagaatgcccacaatctataggtcttagtcacatggatggggacagaatatctgagagagagagaaggaacaagatctactggggctccttaaaattcttcttgaagaactcctttctcaccttggagtagggaagactttctgattatgactcaaaatttagaagctaagaaagaaaatacctttaaatctgaaaacataaaactcaaaaacttctgggtgtttttttgggggggttgttttttttaaacagcacaagcaactcaaagggcaagtgacaaactggggagagaagaaaaagatgtgactcatatcacagtttcccttctacttaaaaaaaaaaaaaactgcaaaccagtaagaaaatagcaacagctcaacagaaaaattgccaaaggcacgaacagttaatgagaaggagatgcaaatcgctcttaaacctatgaaaagatgaaggtgttccatcacaaagagtaagagaaatacaaattaatattaatgtgaaagacaacttttcatttatgaatttgagaaaaatccaagaacttgatgatatacctctaagaagcaacggtagggaaacgaaaattctcacacattgcaggtggttatgtaaattggtatagccccgcgggtggtcagtgtgacagtttctatccaaattacagatgcatagtttcattgccaggtctcttctgtctgcttcttcagacccaccctcccctctccccactgtttagttggcccaggaccctgtctggtaaggatacaactccaggccccttgccctatggcttctggttgtgttcagccgatggggagccccaaataagagaaggaagggacaccgtgagtgatatttatccctcagcttcctgcctgcactgtcctcttggtctggctgtgtccagtggtctcatgtcatagctgctcatacaggagtttctccttacaaattgcaatgttggcttctcttccccctccggcccagagtgattacagccatcaatgttgtgagctacaggttctataccctcccttctgcaggcccagaatggtaacagccctcaatgttgtgagctgcaggttctgtactctccctcctggggcccagagtggtcacagccctcaatgttgtgagctacaggttctatactctcctttctgcaggcccagagtggtgacagccctcaatgttgtgagctacagctctcaatgttgtgagctacaggttctataccctccattctgcagacccagaatgttacagccctcaatgttgtgatctgcaggttctgtactctccctcctggggcccagagtggtcacagccctcaatgttgtgagctacaggttctatattctcccttctgcaggcccagagtggtcacagccctcaatgttgtgagctacaggttctatattctcccttctgcaggcccagagtggtcacagccctcaatgttgtgagctacaggttctatattctcccttctgcaggcccagagtggtcacagccctcaatgttgtgagctacaggttctatattctcccttctgcaggcccagagtggtcacagccctcaatgttgtgagctacaggttctggagtctcccttctgggccccagagtggtcacaggcctcaatgttgtgagctgcagattctatactctcccttctggtttgcctacagccctctcacacatttgtaaatatagtcctgcaacccctaatgatgtcttgggcaaagatggaccttttatatgacgatagccccataagattataccatatttctactgtaccttttctgtgtctaaatatgttcagatacacaaatgccactgtgttgcaactgcttacagtattcagcacagtaccatgctgcacagatttatagcctaggaacaatagtctataccatataacctagatgtgtagttggctatgctatctaggtttgtctaagtatactctgatgttcatacaacaaaatagcctaacaatgaatttctcagaacacagcactgttcacagttgcaaagatatggaatcaacctaagtatccatcaacaaatgattggataaagaaaatgtggctaggtgtggtgctcacatctgtaatcccagcactttgggaggccaaggcgagaatccaggagtttgagatcagcctgggcaacatagtgagaccctatctctacaaaaaaaaggtttttttaattagccggtgtgtgatgacacatacctgtagtctcagctacttagggggacaggtgggaggattgcttgagcctgggaggttgaggctgcagtgagccatgattgcaccactggcactccaggctaggcaacacagcaagacccgtctcaaaaaaaaaaaaaagttacatatatatacacacagtatattcagccataaaaaagaatgaaatcgtgtttttgcagcaacatggatggaactggaggccattatcttaagagaaacaactcagaaacagtcaataccacatgttcttataagtgggagctattaataaaaaatgtgcacacattgacatatatataatgtggaatgatagtcattactgactgagaagggtggattgggtgtggggagttaaggaatgagaaattacttaatgggtataatgtatactattcaggtgatggatacactaaaagcccaaatttcaccactatgcaatatatctatctaacaaaactgcacttgtaccccttaaatttatttttttaaaaagcgtgtatcctaatttgaatgagctgtttcttgccagaaccctaactgatatgtcctttgtctagcaattctacttctggaaattttcccacacttaaactggcacatgtgcaaaatgaaagagatttccttgcagaagagactggaaataattcaaatgtctatagtaggggtactaattatataaataatggtgtgtctatagagtagaactgtatccagctatttaaaaaacaaggatagaaagatcttccaaacatatttttaagtggaaaaagcagggtggaacagggactatacatgctatctcttgtctaaaagatggggaaattaggaatatgtatttgtttttgcttatgcatgaagatactctgaaggattcacaaaagaaaaaaaagttttctaaagggagcaagacttttcacaattttttttttgaatgcttaaaattgttgaacccaacgactgttgcctgttcaaaagttaaatttaaaattcctcccagactaggtaggggattgggcccagaagctgagaccaggctcacttgaataaatggggtaaatgactaggaattttactattccttacaggtctctcattatcttgtctttgctcccatttttatatttgcagtttaattagacacttcagaattttgatcacctaatgttgatttcagatgtaaaagtcaagagaagactctaaaaatagcaaagatgcttttgagccagaatgccttcatcttcagatcacttaatttggttctcatgggtaagtgctgctttttatcttagctcttatagaagcaagctgtgatgccatcctcactgagagcactggcaggaagtcgcaaactcatttccctgactagaggacccagtaccaccctgcctagtgtcaggagttaagtggaaagcaaataggaaacctacactagtagtttagattcaatgtagattcctgtcctgttgttaattttaggaaaacaaatgagtgacttaaggcaataataatcaggactatcctcgccataatttgaagagtaatttctcctaacacgctttcttcctccccaatctttgataaatgtcttttacctctaaagttgattaattagcaacatgcttattcatattctgtgaatatttctaggatggacaattgcctctgaggacattccctcagccagcccaagtacttaaacaaaaacaaggaaattctttgatgttaaagatctcgtgtgtgtccgggcgcggtggctcgcgcctgtaatccctgcactttgggaggccgaggcaggtggatcatgaggtcaggagatcgagaccatcctggctaacatggtgaaaccccgtctctactaaaaaatacaaaaaattaggcgggcgtggtggcgggcgcctgtagtcccagctacttgggaggctgaggcaggagaatggcatgaacctgggaggcggagcttgcagtgagccgagatcgagccgctgcactccagcctgacagagcaagactctgtctcaaaaaaaaaaaaaaaaaaaatctcgtgtgcgtgtgtgtgtgtgtgtgtgtgtgtgtgtgtgtgtgtgtgtgtgtgttttgaggcatagtttcactctgttgcccaggctggagtgcagggtgtgagctcagctcactgcagcctccacctcctgggttcaagcgattctcctgccttagcctcccaagtagacgggattacaggcacccgccaccatgcccggctaatttttgtatttttagtagagacaaggtttcaccatgttggccatgctggtctcacattgctgacctcaagtgatccaccgccttggcctcccagaatgctggggttacaggtatgagccactgtgtccagccattttttttttttttagacagagtctccctctgtcacccaggctggaatgcagtgagcgatctcacctcactgcagcctccgcctcctgggttcgagctattctcctgccttagcctcccaagtagttgggactgcaggtgtgcaccaccacacccagctaattttttgtatttttagtagagacagggttttgccgtgttggccaggctgatctcgaatcctgaccttgtgtgatccacccacctcggcctcccaaagtgctgggattacagacgtgagccacgacgcccggccccagatatatttttaagtggaaaaagcagggcagaacagggaccgtacatattgttgttagtgtcagctcccaaatggatcttattttatctcagatcacagtccttgcaccatgtgctgctggcaccaatgtagagtaaaaaccatctatgtgggcatttttttggcacaagaaaaatctcaatctgataccaataaatgtgtgttaaagaatgtcagacttagagtaatcattgcaagttgagcccagataaaactattgcctctctaatgtgttttcttccttctagtgtatatcagcctcgtgtttggtatttcatatgattcgcctggtaagagatgttttttggcttcactaaattttgtataagagtgaaagtgttggggcaaccattcagaggtataaaatgtgggagatttgatttctgattgtacatctgttgcctgttttattgggattctttctctgtaaaaggagctaaaatgagctaactctggttttttgagagatacaaaactagtctaagaaatgaacactagagatcatttttaaacttctttaaagaatattcaaactcttaataatctcactaataaaagaatgaggagacacagactgtgccaaataaaaaatggcccagaaatatttactctttaatttacattcttccaccctgatgattccagacaaaggacaataatttttttttaactaaacttcttcctacgtatataaatctgtccacaaaacttcactaagtattaaatatgtgtccaaccttgtgctaagtgttggttgggggtgaagagttggcagttgagaaacaaaggcctgagtcctaaccacaggaaacttcagtgatctttaaaaatttaaccgtataaggcagaatttggcaagtctggctttaatgtctcatttatcactgccacttcccacctacatgacattgtataattcaactcagtttcacagtctgtaaaatgaatcttttcatagtgcctacttcagcattgttgtggggcttaaatgcttagaaagggccagtctgggctcatgttatactcccctgctctctgtgatccagggaataagtgagctggggaatccagaggaaggaaaatttgcagcgggctgagctacttaaggaggacttcatggaggagctgggagcagagttgagagaacggcttggggagggagaatgggtaggggagagtgaaaggaagtgcatcatgtgggctgggatggcctgggttattttggtccagtgaaccatggagggacagtccaagggcatcggagaagcccttctgtccagactctccttacacagtgcacagtccctgtttcccatgcttgcctgccctgacaatatgttgctcgttaattgacttactaatttatttcccatgtcctgtagacttcctgttttcaagacaccagggctctctggagaggttatctgccagaggtgtgggttctagatcccaagaaatgactgaacagtggccagaatacaactgtgggttccaaatttcaatgccctttttcttcttctctttagattacacagatgaatcttgcactttcaagatatcattgcgaaatttccggtccatcttatcatgggaattaaaaaaccactccattgtaccaactcactatacattgctgtatacaatcatgaggttggtttgatatttcattttctcttggtaaacatattattgttctgttatatggggagaggtgatcttttctctctctctgtctctccctctcccttttcctatctacctctccttctctctgcgtttcttattcagagccttaaaaagccaaagacaaaacaccatcacacatccatttttaattcagttgaatactttaataatccaaatctattttgacaaagcttgtatgtgtcatcaaagccaatttctacaggtcagaacctcacatacaaaataattcttgtgtatgggttaggcaatgatttctctaattcagtcagtctgaatgtttaaaagtcctgttatctgaggacaggaatccaaaggtctattgaccatattgatggtttatgttcacttttctttactctggtgggacaccagaaagctgcctggcctagtctgggacaggcctgggtccatagtctggtttggtcactaaccagcttgacacttggcacggacctcagcccctaagctaatgcctctgctgaggggttgctgcaaggattcgtgacataatggatggagtcctgcttgtcttttgtcttcccacacctaccaatcgcccttagaagtcattgctttgatccagcagccccttggagtgtccttttgatggttatttatttggcctagagctgctgctgctactgcttattgactgagccagtgggagacctcttgtgagtttctcttcggtgcctgctaaaaagtttttctctgcattgagtggtcacatgtatcatccaactaactgaagcttggtagatgagatatctgcattgtccctgaaatagcccaggtctgacttaggactggatcatctagtcttagccagagagggagggggtctcagggaaggcattcataattgtcccatagaggaagggagatctgaggcttccaccatgagggcccaagtttcattcattcatttactcatccggcaattttttttttttttttgagacggagtctcactgtgtcaccaaggctggagtgcactggtacgatcttggctcactgcaagctccacctcccgggttcacgccattctcctgcctcagcctcccaagtagctgggactacaggcgcccgccaccacgcccagctaattttttgtatttttagtagagacggggtttcaccatgttagccaggatggtctcaatctcctgacctcgtgatccgcccgccttggcctcccaaagtgctgggattacagacgtgagccactgcacccggctcctccggcaagttttactgagcacctactacatgccagggggtccaactgtgaaccaaagtccctgccctcctggagcagacattatgtaaatggagacatcagtaaacaaaggtataatgtgacaggtgtgggtaaatgctacaatcaagaaaagagagggattgaaagtgcaggggtggggagggcataagatgttccattttcaataagatggttggggaagatcacttaatacaatgatatttgggcagagccctaaaggaaacaatgaagtaaggcgcccaaaaatagactctcattacatcaatgctaacaatttcctttttccatttttttctttccaaagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacagtgagttttatctctgtttctccacttcgtccccatcatcaagatctttattatttgctattccatgaaataggaggtctacaaaggtgttttagacctggggctgggctcacctcttggccctgccacttcctagctctgtaaccgtggactgctttgcttctctgagccttggttttctaaatctgaaaagtggaatgataatttgtactttgcagatttgccccgtgcctgtataaggcagtaggaactgctgttttcggttttgcagcctgacaggaagtctggagccaggttcaggtgggctggatctagcgctctcatctctctggcccaggattttctttctttctttctttctttctttttttttttttttgagatggagtttcactctgtcacctaggctagagtgcagtggtgcgatcttcgctcactgcaacctccaccttccaggttcaagcgattctcccacctcagcctccagagtagctgggattacaagcacacaccaccatacctggctcattttttgtacttttagtagaaatgtttcaccatgttggccaggctagtctcgaactcctgacctcaagtgatccacccgcctcagcctgccaaggtgctgaggttacaagcatgagccaccacacctggccccagtgttttcttaatacagcaactccaccccctcattataacccaatgttcttttgtgtgtgaacaccaagtgtgcatgcacctagtacccaaagctcagaggagaagactagaccccaagaacaggcctaccccttctttctttccctgtgactcaagtcagttccctaacacactgtgttaacagccccagctgtgttactttttcaatttcccactttacaacgagtttccaagagaaccatctggtctcagcttcctgttgtaggctatgcgggtgtgcacgtgctcatacatgattagcaaagtggtaaggataactgaatccccctgtggcaaacaattcggatacgacatttgctggatttgtgtgcatgtttacgtatgtgtataaacagacatctgtgtgtacacacagaaaagaaagaaaatcagaatttatagttcatggtatttgggttgttaaagaatgcatattaaagtaacagtgagatatgtttcatggctcaaatgataaatatgaaaaatacataaatatccaggtttagagggaatacaaagagtgtgctttggcatggtccatctgaagtaattggcagcatgtattaaaaaccttaacatgtgcttactctaatccagaattctttagtaatttgtcccaaagaaattattaaggccaggcacagtggctcacacctgtaatcccagcactttgggaggcctagaccagtgtatcacttgagctcaggagttcaagaccagcccgagcaacatggggaaaccctatgtctacattaaaaaagaaagagagaaagaaagaaagttaggggggagggagggagggggggagagagagagagagaaagagaaaagaaagaaagaaattattaaggacaaatgcaaaaatttagttccaagaatatcccatgatacattaagtctttaataaaaatcagagacaatttaaatgttcaaaacagtgaatcagttaaatcatgatacagtcacttagtggaatagcattagcaatgaaaaattatgatgtaaatcaggacttggcagattttctatacagggccagagaagaaccactttagactttgtgggccacatatggtctctgtgacatattcctgtctgtttttgttttttgcacagtgtcttttgaaccaccagagtttgagattgttggttttaccaaccacattaatgtgatggtgaaatttccatctattgttgaggaagaattacagtttgatttatctctcgtcattgaagaacagtcagagggaattgttaagaaggtaagtggcttctcctgttaggatcaaaacagttctgagtgggcaatcaatgcacttgactgtctcttttgaaaggaaatttgcagttgaacaattaaagctaaaacgtcaggcttcagtatggtccgacttagggaagaagtcactatggttcattcactattgatctaaacctgcagcacagtgttctttaaaagaataagccacggctgggcctggtggctcacgcctataatcccagcactttgggaggccgaggcgggcagatcatctaaggtcaggagtttgagaccagcctggccaatatggtgaaaccccatctctactaaaaatacaaacattagctggatgtggtggcaggcatctgtaatcctagctactccggaggctgaggcaggataatcgcttgaacctaggaggcagaggttgcagtgagccgagatcgcaccattgtgttccagcctgggtgacagagcaagactccgtctcaaaaaaaaaaaaaaaaaaaaagagtaagccacatgcacaacatcaaggaacacacaggagagagggtgtgggagggagatgcagagtacagccaaatttcagtgaaccctggagagatttatttgaaaaggagagtttagctgagccacccgtgaaaagcatctgtcgctgcctctctggccctcacacacagtaaggaagtggcttatctggcaggttctgtcctctcctaatttctgcaaaggacctgactctcagtaacctcagggttatctggtatcagacagccctgcatcttcaatttttgttgtccctagccctccaaatgctggaataagtggaaatggacaaattgctctcaccggtgtagcagcagcttatgtctgtagagccctttgccaagtataaaacccttgcaagtgagaccagcctgagagataatcagggtagatgcatttcaggcggagggcacaggaagttcaaaggctctgaggctggagtgggcccggtgtatttcagcaacagcgaggagaggtggctgaactggagtgaccaggcaggagatgaagaggaggtgaggtcagagggtaaatgtggctggacctggtaggagtttgtgggtctgggtcttctgagtgtgatggaagcctgtggaacccaaggcttaacagagcatcctggctgggctgttaaaaatagaccacaggggcaaagatgggagttaggagaccaactaagacacaatccagggtggcagtcacttaagaggcagtaacaaattatatgattattatcatttttcttttaatatcgacatggattataatcagtactctaggaaaaggagcaaaaatgggtgaaaaataagtttatgtggcctaaggactatgtggagtgtcattaaatctgtttcaatcatgtctcgtttgtgttcaccccataagcaactaactctatgttttagattatgattcctaaaataagagactgttgcttattaggatattgactactctataagaggaaaaactgtagttaataggcatcttcttcataaggaaaattagcctttaaatccagaaaaaaaaataagctactagtataatctaagcaacagatggtggtggcttggaccttgatagtagaggggtaatgagtagtgagaggccatcaaattctgcatatattttgggttttgtttgtttgtttttgagatggagttttgctcttgttgcccaggctggactgaaatggcatgatcttggctcactgcaacctccgcctcccgggttcaagccattctcctgcctcagcctccctagtagctgggattacaggcacccgccagcacacccagataattttttgtatttttagtagagacagggtttcactgtgttggccaggctggtgttgaactcctgacctcaggcgatccacccacctcagcctcccaaagtgttgggattacaagcatgagccaccatgcccagctcataattctgcatatattttgcatgtggagcaagactaacttccccattaactatggaagatgatgaatgaagcaggtgagggttagatagggttagagggtttgggacatgttaaattccaggtgtccgtaaggaatctaggaggagacgtggggaaggagctggatgtgccagtctgttgtccaggagagaacccgcagctagagagagagcctgggagtcactggcttcttggtgcatgttgaatgccctaagaccagatgaggtcacctgggaatagacactcagagagaaaacaagacatccagtgacagagcccaggaacattccaaaatttggagatctggcaaatgaggaagaaacagcaaaatcgactgagaaagagcaaccagcatggtagggagagaagcaggtgagagtgatgtcccggtagctgagagaagaactttccagaaggtgaaagtggtctactgagtccagtgctgtaaatgggacaattgaagaggactgactattggatttagcaacattgtgtccttgataaaagtagttttaatagagttaggggcaaagagctggttggagtagattcaagaaagagtgggaggagaaaaattggagacagtgaagagagctcattcttccaaggaatttttccaaacagggaaggagattgtgtgctggccactggaggggaagcttttagtttgttgggtcgtaagtttgtttgtttactaactcctcctcccaaacagaaatttacagaaaaacatcattactgaaggctgtatttgagctgctaggaatcctcatttattaaactgctagtaagaatgtattttaaaaactgtaaaacatgatacaaaagttattattcatgaaagagccttcatatcatcttttaaattctgaagtgaaatgcaactacaggaaagaagaggcaaggtgtttaaagggagatggctgggcacagtggcttacgcctgtaatcccagcactttggaaggccaaggcaggcagatcgcttgcggtcaggagttcaagaccagcgtggccaacatggtgaaaccccatctctactaaaaatacaaaaattagccaggcatggtggcgggcatctgtaatcccagctactcaggagactgaggcaagagaatctcttgaacccaggaggtggaggttgcagtgagccaagatcatgccactgcactccagcctgggcaacagagtgagaccccatccatctatctatctatctatctatctatctatctatctatatctgtctattgataaagggagaagatgagaaactagacatcagtcagttttgtcacagacaagctctgtgaccttggagaagttacttagccacactgagctacagttttctcatccgttgaatggaggtaatgcctattttgcagactgttttgaaagtcaaaagggttaatgtttatgaaggcactttctcaagtgtaaagtagacacacactgtccatgagagaagataatcttgtaaaaatgacgtcacagagacttttattcctctttgaagacttttatctcatttgtaaaatgaaggcgctagactagatgtcatggttataaaatatgtgtgtgtgcaggtgtatattaaaagtgcatgtaggtgtagttttctgataaattacttgctccagatgacttataaatcctttttcttaccaagcctgtgataaatctaaccctgtttgagatttgaagacaaatcccaaaagagattaaggcctacctctaaatgaaattctcagtcttactgattttttgcttatgtttacagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcaggtatgttcatttttttaaattcatgttttgagtattcatgcttttactctgagggcaagcctatttaaagaaaagaatctgaaaagaattcatggagcactaaaggtctttcttccagtaaacacctcacagagatgttttctgttggttcgtgtgtatgatctggtagagtcacttttatattgtcataccaaaaaacaatcagatactactcgatgagatcagaaatcttgaaatggaaacgcttttgtttcagggagtcaggattaaattcagcactgtgtgccctttgtgtggccattgctgaagccaaatgccagaagaggtggagttgcttgagacagtggtatacagtggcattaaggggtgaaaaggtggaagcagcgaggttgggtgcagttcatggatgtgatctggcatcagctctcgctcatagatgaaaggaacccttgccagggtgtacgagaaaatcactgatgaaggctgaacacctttctgttacacagacatcagaacaataaacagtgtgatcccaaaccttcttcccctttggagtgagaacaatcaagcctcggaactccctgctgattgttttctcaggaagtagccaagtttccacctgttttaccaaaagtgagaagctatgcaagtctccctcaaagaagcccttctaaatgtcccaaccgcagtgttaggggaaagaggtcccaatccataccccaagagagggttcttggatcttgcgcaagaaagaattcagagcgagtccgtaaagtgaaagcaagtttattaggaaagtaaaggagtaaagaatgactactctatagacagagcagccccgagggctgctggttgcccatttttatgattatttcttgatgatatgctaaacaaggggtggattattcatgcctcccctttttagaccatgtagggtaacttcctcacattgccatggcatttgtaaactcatggtgctggtgagagtgtggcagtgaggacgaccatcttggttttggtgggttttggccggctttactgccatctgttttatcagcaaggtctttaccaacggtatcttgtgccaaccccctatctcatcctgtaagttacaatgcctagactgtctgggaatgcagcccagtaggtcccagccccattttacccagctcaagatggagttgctctggctcaaatgcctctgacaccaatggaagtatctttaatgttctgatttaccagaataaaaataaggtaggatctataaagaaattactttagttgtaaaccaaaataaaattctaagccccccaaccaactgaatggatccctcctctcagccaagggccgagtaaagtaaagtaaacctgaaacactagttcaggccatgatgggagtgagtggtccagacgtgcctcacgggaccttcctacctttggaattcaggcacagctggccagcactaatattaaaacagaaaccttaagactgacaaaaagatgctttgtagcactaataccagcatgatggatagcaggccctaaaagaaaccaaagtgttttaccccaaaatacatttctttgacatattttgaaatggccctgcaaagctgtctcttgcagggaaaatctgctttctataaagaacccccttcccagtccaggtgttcttcctgatccaagagagaattcactaagagtctggcacttttttaagtccagtaagaaacatttacagtctgttctctctgaagcctgctaccagaggcttcatctgcgtaataggaaccgtggcctccgcaaccctttgtcttaacccagatgcttccttttattaattccaagtttttaatcagaaaatctttgaatctacctatgacctggaagcccccccacttcgaattgtcccacctttccagattgaaccagtgtacatcttacatgcattgattgatgccttatgtctccctaaaatgtataaaaccaagctgcaccctgaccaagggttctcgggatctcctggggctgtgtcatgggccattggtcactcatatttgactcagactgaatctcttcaagtatgttactgactttggctcttttcattgacaaagtgatatggtcacttgtgaatgaagtgagccacggaacgttgcctggcacataacggtgctctgtgttggcttcactacagggcaatatgatttgattctctagtgttcctcaagaccagatgatgcacaggctggttctaaaggaaaaaacatgtcaaacacctttagcgtaagttatttttatgtcagcaaatacaggcaaacttaaaactgcatatagattctgactatagctctttcaaaaatataaatccaaaataaatgtgcatgtctttgttctaacaccagctatctgacactaactagttgtccaatgattccattcatttctgatactaccccaggttagcacagaccccacaggttaaaggctcagtcccacaaaactgcctgcccccacttcagatgccagccacaagtcatgggtgacaaggttccctgcacttccacctgacttggctacaaattcaggagttcccatgacctccctttaggtttgataatttgctaaaatgactcacagaactcaggaaagtgttatggcttatgattaccattttattataaaggaattgatggacagccattgaagaggtgcacaggacaaggtctgaaagggtcccaagtgcaggagcttctgtccctggggagtcaggtgtaccaccctctctgtacattcatctgttcatgaatttggggactccccaacccttggtgttcacagtttgtattgggtttcattatgtatgtgtgattgattaaattactggctgcaggattgaactcagtctccagcccactcccctccttggatagaggtcaaatgggggagctggaagttccaaccgtctgatcatgtggttagtttttctagggaccagccctcatcctgaagctatccacaccctgccccatcacctcacaagcataaactcatatgtggcccctaaaagaggcttgttaacaaaagacactcctaacgttcaggaaattccacaggtttttgaagctctgctccaggaactagggacaaagactggatatatatgtatattttattatatcattgattttacatacaaacgaaactcttatagacaataaaaactgaaattagtgacctggcagacagatggtggtttattgaaactcagtccccagttccaaggtgaatgtgttgctgatgagaaggcacaagctccttggaggttgatgaattctgtgatgactcactttctcccctgactcttttccatttcacctactaagatgttcatgtaacaacatcctctcaggtcattccatttttacttggcgtgaatgcgtcatgttgcacatcaagtcagccctcattctttgattattacccgagataggtcaagtaccgctctctttaattatccaaatactgtacctgatgtcaaattcttgtttgaaactcaggaagcaaataggttcagataacgtggcctctgtcactatctgcttgccatctgacgtgccctcaaccagccaaactcagaaaccagacaggtttggatggtgaggggtcttggaaggatagcctgagaccagcattaacataggctcagcagtaagcactgtgacccaatcctagggcagactgatatggggggattttagcccagacatctggagaaacaccttccccttgtcaagccttaaaactaatggtttgtctcttttattaatattaaggccctaaggaaaagctctattcattcatttgacaaatgtttattgggggcctgttatgagccagattcttttctggatattgaggatttagcagtgaacaaaacagattaaaaacttctcaccttgtggagcttacattgcagtaggagacagaataacaagatcaacatgtaaaatagacagtatgttaagtaagtaccatggaaaaaaattatgcgggaaaggaggtgagggggatgtcaggttgaggagagcaggttgctgtttttaataggatagtgtcttgatttgcatttgctagaagcagagcctgggatgtgaattcatattcaagtgtgatttattggtgggggcatcttaggagaaggggaaagagggaacaggtaggtacagggagagagaaattaagcaggcatgtggctctcagctgagcctgatcccaaggggttctcggaagcgtgaactgtatcctcaagtcagcagccagtcagttactggtggtgatctatggcatggcctccagatgaggcagcccccttttgggcaagggcagttccttatgtgtccggagttggttcctgccaatgggttcgtggtctcgctgacttcaagaatggagccgcagaccttcctggtgagcgttaacagctcttaaagatggcacagacccaaagagtgagcagtagcatggtttattgtgaagagcgaaaggacaaagctttcacaccctggaaggggacctgagcgggttgccactgctggctggaggtggccagcttttattcccttattgtcccttcccgtgttcgtttctgtcctatcagagtgcccttttttcagtcctcctcgtgattggctacttttaggatcctgctgattggtgcattttacagagcgctgattggtgcgttttagagtgctgattggtgcgttttacagaatgctgacttgtgcattttacaatcctcttgtgagacaggaaagtccctgattggtgcgttttacaatcctcttgtaagacaagaaagttccctaagtcctcactccacccaggaagtccagctggcctcacctttcacttagagaaggatcagctctgagagatatcagcagacacgtgcggcagcagtagtgggtgtgcactgactggaaaaggggacatgggcaggccacccacagcatccaccacagatggccacagatggccttcctgagaaggtagcatttgaataaagacccaagggagatgtggtaagcagaataatggcccccaaagatgtctacatcctaatcccagatatgtgaacaggctaacctctatgccaaaggggcttgtgggtgtgatgaaattgaagatcttggccaggcgcagtggctcatgcctgtaattccagcactttggggggccgagccaggtgaatcacctgaggtcaggagttcgagttcagcctagccaacgtggtaaaaccccatctctactaaaaatacaaaaattagccaggcgtggtggcatgcgtctggagtcccagctacttgggaggctgaggcaggagaatctcttgaacccgggaggtgggggttgcagtgagccaagatggtaccactgtactccagcctgagctacagagcaagactgtgtctcaacaaaaagagaagcaggagactcagaggcagagaaggagctctcacagcagcagcagaggtcgcagagtgaggatgaaggagggggccatgagcaaaggaatgcaagtggcctctagaagctgggaaaggcaaagaaatgggttttcccctagagcctccataaggagttcagtcctgccaacatcttgatattttttatcccagtgaaacccattttggatttctgatctccagaactattaatataatatatttatattgttttatgacactaactttgcatcatttgttacggtggcaatgggaaacaaacacaaggtgagggagtgagtcacgcaaacctatcaggggaaggagttccatatgcggggttcagcaagtgccaagtgcccgaggcaggatatgcctggcacggcacggcaggagtgaactgaacaagggaagaatagtaacagttctggtcagaaaagatggaggagcctgaatgacatagaacttagaagccgttgcaagagatggggaccctcagagggttgtgagcaggttgctctccgtgatctgacgtgggatgtaaagggaacatccatccacatgccttgaagtgggagccaggtgacccctgggctgattactgcagtcacccaggggagaggcggtcttacttgttccagagaggtaagtacgggaggaactataagagactgatgttagtcatcgccagtcttttcataaagttctttatcttttccattaaagatcattgtgatcagatattaccaaccccgttgctcagttcagccctctgcttgtgaggtttcttattttttgcttaaaatatctccacagtgaatccagagacagacaggtttgtccaaggccaaatttttaagacacgacctggtctctccttcccaagatgggttgatctggtccatctttcatgaagaagatagttaacagcagtaacattcaatcacagcttctcctttctgagtcagaacattgatgggattcatctcttttcaaatatgaatatttaaaaatagcatgcatgtataattgtcatgaccccaagtgagatttctattttttagattatcatcaagctgaaaacaaacaaaaattctaagttctcctaaagaattctcagactcatgagaataccccaaattgaggaatattatcctagcatattaactacaatttacacaatttggtttggacatagagtgcattgtagctgttatatgcaagttggatgggtacatgagtcacaatctctgtattatgccattccttcaccagtgaaatcactttggtttacagtacccctttcaagaatgtaaacgctatacatgtcagaattttgtatcctaaaggcgtgcctctgtggctagatctgattctggaactgtcattgatatgacaatccaatccttcacactcttgatggaggtgagagtggattcttgaaccctgtgctatctaacagtgtttttactgaactatcaagggtttttactgaacttctttctattcattccttaaccttctggaagacttagagtacataatccatttgatttccttttttctcccctctatctatttttgcctgaggctatagttcgaggattaatactaatgaagacctttctggaagtgcaagagagccttagtgatataactactgatttttcagtctggtcgcacttcaggaaaataactatggtcagtcaaaaagctgaaattttccaaaaggaattttgatgagaaactaaggggaactgttaatagagcaaggcaggttctgcagagccctgacttgtggccccagcgtggctaaagtccagcctcagaatgacccagttggttgttttcaagcaaactttccttccccacttcttcctgcccgcagcgcatgctaaccagtgtggctaccgaacgtttgagatgtgtttcatgtgactgagagaccgagctcttaattctgtttaattttaatcatttaaattcagccagctgcagccagtggctactccactgtacagtgcagttatagaacataaactgaaggaaattttacttttaaaagctaagtctattttattgtttaaaaaatgcacacttagataattctccagtctctggtatttctcaatataaaactgttttttcaaacctttggtttcttgatcatcttgtaacaccaggccaatgtacatttatttccatctgcaattgtttattgcattttttgaaataaagtcatttaatttttcatcaacagaatcagcagaatctgccaaaataggaggaataattactgtgtttttgatagcattggtcttgacaagcaccatagtgacactgaaatggattggttatatatgcttaagaaatagcctccccaaagtcttggtaggtagtttttttgttttgttttgttttttctatctttgttttttattttaacttaagaatttgtatttatataaatattttcacagaagaaaatctcattttctataaacaccaaaatgctttctcactctgagttcttttccatatctataaatgtatattttgcagggtttttgttttgtttttgtttttattatacttttaagttttagggtacatgtgcacagtgtgcaggttagttacatatatatacatgtgcagttgtaagtgtatctgtgcatctgtgcattttatgttttctttcctttttttttttttttttttttgagacagtctcactctgtcacccaggctggagtacagtggcgtgatctcagctgactgtaacctctgcctcctaggctcaagcaattctcgtgcctcagcctctcaagtagctgggactacaggcgtgtgctaccacacctggctaatttttgcatttttagtagagatggggttttgctatgttggccaggctggtcttgaactcctgacttcaagtgatccacctgccttggcctcccaaagttctgggattacaggtgtgagccactgcactcagcaatgttttgttttgttttgtttttatacttcatcacataatttataatgatcaggtagaatttcattattattaacataccatttttcatttaaccatttctcagctaaagggcatttggatttcttttccttttcttttctttggtgatgatgaatagtacaataaacatttttatatggatcgtctttttgttttggattatgtcagtggaacatatacacaaagtggatttatcctataaaaagatttaaaaaggactaggcacagtggctcacgcctgtaatctcagcactttgggaggctgaggcgggtggatcatttgagcccaggagtttgagaccagcctgggcaatataaggaaaccttgtcttagagaaaataaaaataaattagccaggcatgctggcacatgcctgtggtctcagctactcaggaggatgtggtgagaggattgcttgagcccaggaggtggaggctgcagtgagctgtgattgcgccactgcactccagcctcggttacagagtgagaccctagctctaaaaatatataaatatcttaaaaatataaagaagcagccaaaggagaggaagttaagaggagtaagtcagaacatagtctatgtggccagcagcctgcctggtttgaaaggcagctgctcccactcactagtcacaaaccttgagcaagtttcttaacttctgcacctcattttctcatctgtaaagtgggcataagaatagtaagcctggccaggcgcggtggccacgcctataaacccagcacttcgggaggccaaggcaggtagatcacgaggtcgggagttcaagaccagcctggccaacatggtgaaaccccttctctactaaaaatacaaaaatttgccgggcatagtggcgggcgcctgtaatcccagctactcaggaggctgaggcagagaattgcttgaacctgggaggtggaggttgcagtgagccaagaccgcactactgcactccagcctgggcaacagagcgagactcccgtctcaaaaaaaaaaaaaaaaaaaaatagtaagcatacctcatagagcagttgcaagggaaaggtaaattatatataaagcaccaagagtcatgcccagcatatagtaagcatggtgtaactgttagctgttattattgctgtcatcatcatcaactgcatcatcattcaatctcattaagtttattttttatttttttagaggcaaggtctcgctaagggctggaatgcagtggctattcacaggtgcagtcataatgcactacagtctgaaactcctgagctcaaacagtcgtcctgcctaagcttccccagtagctgggattacaagcgtgcatccctgtgccccagtgattaagttttattatgtagaaaataaagagcaaacagtacagctgatacggactctctctctctttttttttttttttaagaattttcataactttttagcctggccatttcctaacctgccaccgttggaagccatggatatggtggaggtcatttacatcaacagaaagaagaaagtgtgggattataattatgatgatgaaagtgatagcgatactgaggcagcgcccaggacaagtggcggtggctataccatgcatggactgactgtcaggcctctgggtcaggcctctgccacctctacagaatcccagttgatagacccggagtccgaggaggagcctgacctgcctgaggttgatgtggagctccccacgatgccaaaggacagccctcagcagttggaactcttgagtgggccctgtgagaggagaaagagtccactccaggacccttttcccgaagaggactacagctccacggaggggtctgggggcagaattaccttcaatgtggacttaaactctgtgtttttgagagttcttgatgacgaggacagtgacgacttagaagcccctctgatgctatcgtctcatctggaagagatggttgacccagaggatcctgataatgtgcaatcaaaccatttgctggccagcggggaagggacacagccaacctttcccagcccctcttcagagggcctgtggtccgaagatgctccatctgatcaaagtgacacttctgagtcagatgttgaccttggggatggttatataatgagatgactccaaaactattgaatgaacttggacagacaagcacctacagggttctttgtctctgcatcctaacttgctgccttatcgtctgcaagtgttctccaagggaaggaggaggaaactgtggtgttcctttcttccaggtgacatcacctatgcacattcccagtatggggaccatagtatcattcagtgcattgtttacatattcaaagtggtgcactttgaaggaagcacatgtgcacctttcctttacactaatgcacttaggatgtttctgcatcatgtctaccagggagcagggttccccacagtttcagaggtggtccaggaccctatgatatttctcttctttcgttcttttttttttttttttttgagacagagtctcgttctgtcgcccaagctggagcgcaatggtgtgatcttggctcactgcaacatccgcctcccaggttcaagtgattctcctgcctcagcctccctcgcaagtagctgggattacaggcgcctgccaccatgcctagcaaatttttgtatttttagtagagacaggattttaccatgttggccaggctggtctcaaactcctgacctcaagtgatctgccctcctcagcctcgtaaagtgctgggattacaggggtgagccgctgtgcctggctggccctgtgatatttctgtgaaataaattgggccagggtgggagcagggaaagaaaaggaaaatagtagcaagagctgcaaagcaggcaggaagggaggaggagagccaggtgagcagtggagagaaggggggccctgcacaaggaaacagggaagagccatcgaagtttcagtcggtgagccttgggcacctcacccatgtcacatcctgtctcctgcaattggaattccaccttgtccagccctccccagttaaagtggggaagacagactttaggatcacgtgtgtgactaatacagaaaggaaacatggcgtcggggagagggataaaacctgaatgccatattttaagttaaaaaaaaaaaaagcaaacacaaagatgcttcaagatcttcaggagaagtatggtatacaagtttcagggaccctatttgacaattttcagagtgctctctatgctgattccgagtcgagtgtgtcagctgtgattacagtgcctgtggatctaggccgggttgggggggtgtgggcgggggaagggaagtctggcccggagcaattgctcctgccggtaaccccagcactttgggatgcctaaacaggcgtatcgcttgaggccagtaattcgagaccagcctgggcaacatggcaaatctgtctctacaaaacaaaattagaaaaattaactgggcgtagtggcatgtgcctgttgtcccagctacttgggaggctgaggtgggagaatggcttgagcccaggaagcggaggttgcagtgagccaagatcatgtcactgcacttcagcctgggtgacagaaccagaccctgtctttaaaaagggagttggtggggagaggttctagaatgtcatgtagcaaccagtttaaggactgggactcagggatccaactcccacagtttccctgtgtgaccctaggcatttgacttagcctttctgagcctcaggttttttgtttctgaagtaaaaggattggactaggtaatctccaagatcctaggaacccaggagaaagatgagaaaatgtacaagaatgaacactcaggtggaaatgctgcaatcctgagaagctcccaggatgaatgaaaggcacaggacctcttacccctcacccctgcccccctcaagagctggtttctcaaacctttctcttaggccccttcaaagggggaaaactaaaaattatacaagttatagttcaaggactttaaatagattatttatatgattgctcataaggatgaggctgtgaggagggaacaccttatttaatctaatgaaattccataggaaagaggccttttgtatattgaatcaatttatctgccttctcagtgcatctgtcatattctgaaagattctgggttgatcttttgcgataacctctatggctgtgagtgtgtgtgtgtgtttgtgtattttttaacattttgtataatgattggaggttggtaaaaagtaacacaacagtacttttttaatacaaacttggtgtggtcttgagttgtcttccattggagagcgtacgtgtgccacagattggtgcacctgccggcatctctaggattgcaccaactccctctagctcttcttggtggcctgcaggggcctagggcgcattcacttccctctgcttgactttacgtggtgttctagcgtcagacatcaggcgatgccgtgcattacccaagacactggacagctccggatcttcccgtctaaccactaatcaagttaaaaagaggaaattaacgctttcttagtagtctctgaaagaaactagttatttgcgtaaagatgacttggttttgtgttgtttatccctggggagaagggtaaagaagaccctcaaactggatttgctgctgaagtgcttttaactcacctgtgcggagagcggacttcaagagagggcgtgccggtgctccggacaaaacctggggaatactgaaagccaccaccaccaccgtcattccagcatgcagatctcagtcctgggttggtgttgtagggcatttatttatttgacttgacggcgcctttcaaagcttgcgaggatcccttcctcttcctcgtgtgcatctgccaagcctgtgccccgcgcctcgcgggtggacccgggctggtgggcggggcctgcagcggggtgggagcccggtcgcccggcccctccccaccccgccccgcccatctccgctggttcccggaagccgccgcggacaagctctcccgggcgcgggcgggggtcgtgtgcttggaggaagccgcggaacccccagcgtccgtccatggcgtggagccttgggagctggctgggtggctgcctgctggtgtcaggtgaggggtccgcggggagggggcgcgcttgggaaccgggaggccccgcgagatgccgcccctgatcccatccctgggcgccctgcaagtgacttaagagccttcggggcctcgggagagaagatgcaaacgccacggccggctgctgagacgcaactaggctgctgctgccgtcgattctgtaacaggagaaagccccatccgcgcccggattacagaccgtctgggccctaaactcagggggagactcccggcgtcttttgattccctgtcctcctgcagctctctgctggcgggcgtctaaataaagtagcttccccaaaagacccaagatcccaccgtggctgtcatctgacccttctggagactatcagttcaagtggaggcccccaccagtccccgagtgccctgacagccctccctgaccccaagtctgccccctcagtgccagccctccctacagatgtgcctcccatcacccgctgcacctcccctccttccggttcaggcccgagcaccctgaaatctggattctgtcccccagcgccccagctccatggcttctaaacctaaatccattgaaaccttttctgtcctctaaattgactgcctaggttccaataacaccatggtcacctccttcctttctcatgaactcttccctggccttccgggatacccctccggtttcccgccctgtcaggctgtctctgcttgggaccctcctgctctgtcaggtttctatgtagctaattgtgatgcccaaggccttttctctccttccctggcactgttcctttgggggatttcagccaaaccctggcattaaacacgggctataggcccatgactcgcacatttatatctctcttggtaccagttgggtgatgggtggtggtttattatagtcttctacttttctacttgcatgtaggtttcaaattttcttttctttctttcttcttccgtttttttttttgtttgtttgtttttttgtttttttgtttttttttgagacagggttttgctctgttgctgtggcccaggctggagtgcagtggcttgatcttgcctcactgccacctccgcctcccgggttcaagcgattttcctccctcagcctcccgagtagctggaattacaggtgtgtgccactacgcctggctaatttttgtatttttattggagatggggtttcgccatgttggccaggctggtctcgaactcctgacctcaggtgattcaccttcctcagcctcccaaagagctgggattacaggcgcgagccaccatgcctggccaggtttcgaattttctattaaaaggtttgaaaataatttctgtctctagcccacatctcttcttggtgtgacctctgggctcattcatctggctgtctccctgacattcctacttcagcctctctccagcatctccaacctaatgcagctcaaatgggactcgtgagttccccagctgagctccaatcggggcaccagctgcttaagcccaaaatggacattgacctcagcttttatgcatcaaatgtatcaggaagtctccagtttgtttttacgtctggaaatatatctgaaatccatgtgcccaccctaccccctcatagctttctgccaccagacaaatccaaggctcctttgtctgtccccattttactcctgcccctccagaaatttctcctcacggctgttcaaagaaaatctagactcctcagcacagccaacctgtctctccctccctcacccacgtggcctttgaagacatggagccatagaggagaaccaagtgctggatgtgggctttttcatgggcatctgttttgaggagaaaagttgtaaatgtttttgtcttattttcatagcattgggaatggtaccacctcccgaaaatgtcagaatgaattctgttaatttcaagaacattctacagtgggagtcacctgcttttgccaaagggaacctgactttcacagctcagtacctaaggtgggtctggcctcactattggcaggaacgcaccggaggagccagccctgggctggtcactgggttgggccacaggaggaagggagtctgactacggtcaccgtgtgactgtgacaaccctcagggagcctccctgccagccttttgctgtctgggaaattctcgtggccaccttttctcttttaggttttctagttgtgatggttgacgatttgactgttaatcacagggctgctggcagatacagacattttatcatgcgtatgtagatataatcagccatagtggtaacctcatgctgtgcccatcccagcttgtttgtcacagttgatatattttaaaagaaaaataccactgctgtcatctctaggtatgagtagtattgctggaagtcagcaatgttgagtggatgctacccaagaaactgagatatgcaaagcggtcaggaagccccttgctaccatatatcacctgttcccctccaatggattataacatcatgccccagtgccatgcgcgatgcacataatttgcataatgagtgctcagtttctccgtggttccatcctgaaattaaaagtaagacagctactgactgttaaaaaccccattctcggacaacagcaggggctgtgaaggaagagtgagtgtcaccctagacggtcatctcagtggtgatctgaacgccctctacctctcctgcctgtcagtgtttccctacgcctggtgaaggaagtcagtgccagcactcccttggcagcctgccaccatacgccacatgctggactgcaggtgacacacctttaggccaggcgcaaacagcagcaggaggcccaaggctgacaagccaacacacctgctttctgtgtgactcagaaacatacgaagatagacaagtccttcagtgaggcaggaggaaatttcttcccagatccagctgtcatttcacaaaaatccccaaggcctgctacatcagagaagaagtagaaaggtgaataagatagtcctcgtctgtgcattgctggcttttgttttttaacttttagttcaaaataattccagactaacagaacatttcaaaattttaagtagaatacaaagaatttccaaatagcctacaatcagattcaccaatttttttttttttttttttttttatgagacggagtctcgctctgtcacccaggctggagtgcagtggcgcgatctcggctcactgcaacctctgcctctcgggttcacgccattctcctgcctcagcctcccgagtagatgggagtacaggctcccaccaccatgcccagctaattttttgtatttttagtagagacggggtttcaccgtgttagccaggatggtcactatctcctgacctcatgatccacccacctcggcttcccgaagtgctgggattacaggcgtgagccaccacgcccggcccaggttcaccaatttttaatgttggtcacattctctcccttcctctctctctctcatgccctttgtgctgtaatatttcactgtgtatttcacaagaacaaggataatctcttacatcacatagtacagtgagaagctcaggaacttttacattcataaaatacttgtatctaatttacagtccatagtccagtactgtcagctgtcccaaggattgaaggagggcatactctataattaatttttttcctgatgtgcattttctagtactgattggctttatcatttgctttctgtgctgtctctactcagtctgaatagccacggagattttactgtggaaaattaaatttcttctctgtctgtctgtctccctgtagtttttcttgttctgtgctgtgcttttgggtttgtttgtttgtttttcttttttttttttttgagacggagtctcgctctgttgcccaggctggagtgcagtagcgcgatctcatctcactgcaacctccgcctcccgggttcacgccattctcctgcctcagcctcccgagtagctgggactacaggcgcccgccaccacgcccggctaattttttttagtagagacactgtttcaccgtgttacccaggatggtcttgatctcctgacctcgtgatccacccgccttggcttcccaaagtgctgggattacaggcgtgagccaccgcgcccagcctttttttttttttttctttgagacagggtctcactctgtcaccaaggctggagtgcagtggtacgacctctgctcactgcagcctccacctcctgggttcaagcgattctcctgcctcagcctcctgagtagctgggactacaagcacatgccaccgtgcccaactgatttttgtacttctagcagagatggggtttcaccatgttggccgagctggtcttgaactcctggcctcaagtgatccacctgcctcagtctcccaaagagctgggattacaggcgtgagctaccacacccagcccatgccatgcctttttgccattatagtcgaggcacttggctttgcatgtttatcttttatgttagcgatcccaatgacttcatgaagtgacttcatgagggtatccacacctgggttccaggtctcccccgcgtggaactacagagtgagtatggcatgtgctggagaaaacaaaatatgtgctggccgtgtccttggggaagatatttgatccctaaagatgtgattgcctcatgtggctctacaaaagagttgtttagagtttagcatgagcaattgcacagcacaaactctctgttgtttgcgtgcattggggcagggcgtccagagccgggggcacttcagaggatgtactggtgattttaatataaaaacatccaaaacaattagatgtaaatatgaggaatgggtcatattacctatttaatgcggggagaagtatttgtacatgcaataaaaataacctagtgaaggccaggcgcggtggctcatgcccgtaatcccagcactttgggaggccgaggtgggtggatcacctgagatcaggagttcgagaccagccttaccaacatggcaaaaccccatctttactaaaaatacaaaattagccgggtatggtggtgcatacctgtagtcccagctactcagaaggctgaggcaggagaatcacttgaacccaggaggcagagattgcagcaagctgagattgcaccattgcactccagcctgggtgacagagtgagactccatctcaaaaaaaaaaaaaacctagtgaaaaagatgttattgcaaaacaacttttgaaatactgcacatgctggacaattgatgcattagtttaaaagaaggaaatgggccagtaatcccagtactttggggggccaaggtaggataatcatttgaggccaggagttcaagaccagcctgggcaacatagcagcctcttgtctctacaatttttttttttaattagctggacttgagttggaaagaaggaaggcggaagggaagaaagaaggtagggaggaaaaaaaatatggccacatgtgagaaaacccccttaatgaaatgaccgctggattttccaaatgatgggatgttaagcagccgtgaagaaatggttgattgacaaatatttgtggtatattaagtgaaaaaatagcatgatcccaatgatctctatctactttttgcaagggatttttctaggtatcactaagaatgctgtgagatgtgatgtgctaccttagactatgaagtcaaacagatctgagttcagttgggcagatttcttaggctctccacgcctgacccctgtgtacttaataaatgttggctgttgttatttttatcaccatcactttcatcatcacttctgggagcaaccaaattggttttggcaccagaagatgtcttgggggaccaatcagatagctcctcacttttttattttattttataaatttttaaattaaattaaattaaattttttgagacagtgtcactctgttgcccaggctggagtgcagtggtgcaatcacgtctcactgcagcctccacctcccaggctcaagcgagcttccctccttagcctactgagtagctgggactacaggcgcatgccaccatacccaaataatttttttattttttgtagagacaaggactcaccacgttgtccaggctgttctcaaactcctgggctcaagtgatcctctgcctcggcctcccagagtgctgggattataggcgtgagccactgagccgggccag

SEQ ID NO: 131 - DNA, 1252 bp, Homo sapiens
gcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaagtttaattagacacttcagaattttgatcacctaatgttgatttcagatgtaaaagtcaagagaagactctaaaaatagcaaagatgcttttgagccagaatgccttcatcttcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaggcaaggtctcgctaagggctggaatgcagtggctattcacaggtgcagtcataatgcactacagtctgaaactcctgagctcaaacagtcgtcctgcctaagcttccccagtagctgggattacaagcgtgcatccctgtgccccagtgattaagttttattatgtagaaaataaagagcaaaca

SEQ ID NO: 132 - protein, 350 aa, Homo sapiens
SPNVDFRCKSQEKTLKIAKMLLSQNAFIFRSLNLVLMVYISLVFGISYDSPDYTDESCTFKISLRNFRSILSWELKNHSIVPTHYTLLYTIMSKPEDLKVVKNCANTTRSFCDLTDEWRSTHEAYVTVLEGFSGNTTLFSCSHNFWLAIDMSFEPPEFEIVGFTNHINVMVKFPSIVEEELQFDLSLVIEEQSEGIVKKHKPEIKGNMSGNFTYIIDKLIPNTNYCVSVYLEHSDEQAVIKSPLKCTLLPPGQESESAESAKIGGIITVFLIALVLTSTIVTLKWIGYICLRNSLPKVLRQGLAKGWNAVAIHRCSHNALQSETPELKQSSCLSFPSSWDYKRASLCPSD

SEQ ID NO: 133 - DNA, 116585 bp, Mus musculus
  misc_feature (1)...(116585): n = A,T,C or G
aggtcataggataacttaggtgtcacccttcgacttccaccttccttgaatgaaggtcttttgtttgatgacacacacagtaagctagctggcccaagggcttcctgtctcccatctcaccatagaaccactggaattacatggatcccagcgatttgaactcagtctctcatactagcatggcaaggactttacccactgagccaggcccctgcctcctacctatttttgataccttgatttctggcatagtgaggcacctcccaggctggttatattcctccctctctcaggcctgcagtggagggtgctttgaagaccagaatctggggtgaggtgggggaggggtgctcattgtcactgggacacagtactttcaaggaagggacatcaagtgtacagtgttaaattgacattcatttgttgtttctatgtagattttataatgttttcttagattttcatttttatctcttactaaatggatcttgattcctcccatcctggatataattgtggctgtgtgccctactaaagcaattgcaacatcaaaaatgctgacattgtagaccagcactttgagttggttcatcttattgtagaagaactgttgacatttgaattgggtcccactaaaatgttaggaatctagtgagtggggtagggatacaactcagaggagaggtacctgcctaccacgtgtaagaaccccagttccagcctcagcacacgtggtgggaggaggcagtggagagagttggccttgtaggatacttacacacttattcagagtataccaagcctctccgtttgctgagaccactgtcacctccttgccagtctcggcactgctgaccgctctgttcagggtccttgtgcctcccaggcgtcacaggccgactcatctgtgagcttatctgtaacatttgttgtcgctgttcgtgtcttggaaccgctccttacatgacttcagagggaagcgtctgacccatagcagattgtgtccacataactcccagattagtgatgtcccccttgtgtgggagatgcctgtccctctgtgcttgttcattgctgggtcatataaaagcctcagtcatttgaggtgtgaagggtgctttgtaatttaacctcagaggttgattatagtctcaggcctgctcagtgaaacattagtccaagtcattcccttcacttggtgtttggggtctggaagataaaagtgccaaatgttaaatgaaacacaacttttttgtttgtttgtttgttttttaaagaaacttatgaaagtagaaaattaattacgacttatttcttgagtctgttttctgtgttgggtatggtggtgcacacttgtagtcccagaagtctggagggagaggcaggcagatctctatgagtttgattgaggatagcctgagctacatagtgagaccgtatctcaaaacagtaacaacaacaacaacaacaacaaaaacaaaaacaaaaaaccaaaacctggcaaagccaggaggaggccagtgtgggccctgtcatgagctagaagccctgcaggcaggtcgctgagtatggggtctctctccttccttgacctgactggcaggatccctcagtctggcttttctgaaggggtaattcctgccctcatccgtggaagcgctgtggtccaccttccttcacagactttacatccggccatcattaaaagtttgcagcagacacgtggccaaggagcgaaccccgagttcccaaggctcctctgcccaggcttttatctcctcccttctgattacctgtgtgtcctgtgagctggtgccaggccacagtgaattcttaactaccatgggtgaccacaggtgacccctggccgacaccataagtaatagccagcattttgtcagacagctggacctgcagccaggccctccccgtaaaacctgaacagcatctcacaactcacgtggtgagcatgcgtgtgcgtgcgtgcgtgcttgtgtgcgtgcatgagtgcgtgcgtgtgtgtatgtacattattccttggacattcaccctctgtcctctccttccaccttaagacctggttcccagacaacctgctctcccctgtggtatcccatggcccatcgctcctgctgcccagtgtctcctgaacttccctggctcagaccttactttacctcctcttagagctgtggtaagatgtacactgtgagctcagcatgtgacctacacaccacaggtgtgccttcagcagcctacggggtcccgacctgaccctcctgacaggcccgtgcatactgacgtctccccacactgaatccccctcgcagaagctttgccctgcagcagcccccaggcctcctgagctctgctgtctctgggtttgatgactaggggtctcctcctgcattgtcctccatctggttccgtttgcttcagcaggaggccctcaaggctctccagcacatgactcctttctgaggctcagtgatgtcgaattgcttatgctgacacctccttattcgacagctgcggagaaagtgctcaaacgtgttaccccttacctcatgccggccatcgccccgctgtctgtgagggcgggcgggcctgtgtctgttctagatccaggaaacacttgttgcatttgctggaggagggaagagcactgcagctctggcctgtccacccctgtcctctcagggactgctgtgactgctgtggtgccacctctcaggatacccagggtgcccaagatgcccaggcataggctctctcatggctcccttctccttgctctgcctcggggctcttgaaaaggagatcagcagctgagggtggaagcagaccgtataaaacagctggtgtggaaactctgagacgcttgaatcctttctatagagttcatgggtttcctgtcttctcagaacaaaaaaagatgtgagcacctgctctggtctgaaaggcatcccagcccagctgcgaggatttaaagtgggcccgggtctgcgtgcaggagctggagtaggcaagctttgttaggtaagctttgtgaggtaagctctggtggctctgctcagtcactggagacttgctcgaatcaacagggccacccgagcctgtccctttgtccttgatgctggcaacggacttttcctggcagcctttgagcagagctgcgtactagggagctttgatctgtctaaggaaagtctattttgaactacaagtgaaggcagaggttttaggttagacttcttccccaacaggacccataacagctacactcacacaggtgccaacactggccagcctgatgccacacactgccactgcagtaccacagacttgccagtaaatgccagattgcggtggatgagaaaggaaaaccaaagaaaacctttggctcaatttagaaatcaagatttgaaggttttgttcagaactactttgtaaaattaaaatcagtgggatgtatttacaggcaggtgttttgttttgtttgtttgtttgtttttagtagacaacaaaacagcgacagaagagcagaggatgcaggctgagttctggtctcttccgcagttggaagcggccagagccttcatgggccgctccagctcccctggcacttgtcctgtaggaggcctgtccgtaccagccctggatagtgtagccatagcaactgagaatcagtgtagacagttgtagcactgggcgggtgatggctaaggcacaggccacggcctcgcctgcggtatgggagtcttcttcacaaccgcgggtggtgctctgactgccgggatgcagcagcatgtcctccctcttagtcttgcactgccaggaagagatgtgagagtagtcaaggcactctgaccagatggggggctgccgagtgctcaacctgttcttgccatacactaacagagcaccctccaggcactatacactgtctgagggctcgcctgcgggaggggggggagccacgcccccagagtggtcaagcccagtggccactccagggttagtctccacataggttctataagtggctctgctgtgtccccaatcatcacgtggggaccttccggtattcagttggtggacagaggcgtgttctgaggcgagcaatggctgcacctgccttctgctgaccttgtttggactgggcttagtggcatcctgcctgggtcctgcactttggtttgaactcagcaaggggatcactatggcgtatcggaacttctaatagcattctgctaactgatggatcagtgtcttgttcagccatcatcagggaagcttcctcctgcagcagacaggcgtggctgcagagaccgacagtcatacgtggcacacacaggatcacacaggcatgctgcttcattcccagccaaagaaggaagcttcgtgggccattgacggctccctctttccagtgccctccccctcccccttcagctccggagcaaacgactttagcaatgctgacaatagtgagagcgctaaagagtggccagtgcatccgtgccaccctcagtggcctcctagacactgagaagttgtgtcaccttttccgctcatatttctaatttttacacgtgtatggctgtataaacttcacaacctttctcagttcctttgacattaaattagtttacagtgtcttagaatcataaataacaggtcatattctcaacgaataaatttcttaggaatttcttattaaggagttgagaaactcctcactaaaaactctaagacacccagaacagagatagaagacagtgctgaagagaggagggtctcttagttagggttttatttcggagacacctcgaccacagcaactcttataaaggaaaacatttcattggggctgccttacagtttcagaggtttagttcattatcaatatgtcgggaagcatggtggcatgcaggcagacatggcgctgctggagccaagagttctgtgtcttggcccgaagacagccaaaggaaactgaaatttcacactgggtggagcttgaacataggaaatctcaaagctcacttcaacagtaatgcacttcctctaggccacacctactccaacaaggccacacccactccaacaaggccacacctacttcaacagggccacacctactccaacaaggccacacctcctaacagcgccactccctatgggactagcattcaaattcatgagtctatgggagtcaaaccaccacagaggagcagccaatgctcttggattggaagcctagggttgttaagggatcagtgccagcctagggacctacagatgcaggcagtcctaccaagaggtgaatggtttcatctagaaacagaaaaagtcatcgtaaaatccactgggaagaccaagacattccaaatcttgaaaaaggaaagggctggcaccttacgcatcttgattttaaagcaacaaagttacagtaaacaggatgactgtgggtttccataacaacacccaaggctaaaccagcatagagagccaggagtaaagccagctcagagcgggaaagtactggaaactggaagtccacaaacataattacctcagaaggcgtcaaaatcctaagtgctgtcaaccaaaagtataaaaagtctttgaaggaattggcagtggggagttcatggtattagattccagtgaatttttggacacgttgttaaatattgtagataataaaagacaaactaggtaaactgtgctatgtcacccttaaaacctcagtgtgtgtgagggtgcacagtcgtcagaatgggcagcctacagaggagagggaaatatttgcaaatgacaagcctgataacagattgatatcttgaccatatgaactcctacacatgcacaacagcgaaacaacttcatttaaatatatagaagactcaagtggacatttctcagaatatacactaatgacccataggcccaagcatacaggctcagcatcactaatcattaatgatgcaaatgaaaactacctcgagattacacgcaaaccagtgttgctgacggaagaggacggggacttgtgtgctgttggtaggaacagcagatggtacaagaactttaacaaccatatggaggtacctcacagagtttagagtggatttactccattccacgtcagggcacccatctgaaagattctagaccactgaggtgcacacgtgaaaatggttagttaggatggggctggcacggtggctcaggagatgacacatgctagaagaaaaggtctggttcctgtaggtgggtcctctgtttcatggcgtggtatgtgtgtgtgtgggggggggggggcacagacccaggtaaatgtaataaagaatagattttgtgttacgtgtcatatttcagcccagttgtaaaatatgtttttagtgaactgtttcatccatggttattttatttctagaatgggttctttcttttttttttttccccccgagacagggtttctctgtgtagccctggctgtcctggaactcactctgtagactaggctggcctcgaactcagaaatccgcctgcctctgcctcccgagtgctgggattaaaggcatgcgccaccaagcccggcttagaatgggttcttaaagtaaaattactaagcaaagcctctcggtgcctgttgcctgactgttttctaagccagtgagcagtcgatagctctgttgtcaaagctctggcacaacgcagttactgttctctgtatcattagagttgggtggataagatggctcagtgggcaaaagtgctgctgtcacccctaggctctgacccctgggaccaacatagcaggaaaggggaactgactcttgaactgttctctgaccctcacatttgtcccttgacatgtgtgcactaaataaatacagacatttgtaaaaaaaattatcattgccctaatagataaaaacactctgccttgcagtttctgattgttcatagttttgtttttttacacaaacttgatcatttaaatcctaagggcttaatgtttttctaataaattttattaatctgtatttatattttctttggttggaggggagatgtggaaaaggtcagggttatttgaattggtcttaattctggtgagtgggtattggtggcacacgcctttaatcccagcactcaggaggcagaagcaggcagatctcttgagaccaggccagtctggtacacagagtgagtttcaggacagccagggctactcaaagcctacctggaaaagcaaaaaccaacagagtagattcttgtgagacacagagtaactgttttcagatctgctcagggtccatcaggcgctggcctatagctgtagggttgatccctcatcctgtctgaagatccctcttcttgtaaaagctgtggggttggagaagtcgtggcttgtcttggtttgcttgtctcattcccagcgggttttttggtgcgaggaagggcttgagttgactgtttgcgaatcacttacgtgctgtcttctggggactgttcatatgattccccccatccgtcgacttggtttattcttcatggtctgagagcgtttgttggtgttgggtcactgctcctgtcccctgctctcctgtgatgtatgtctctttttgtataggcttactgtgtagtctgtcctgagttcctcctgcctcagctggatgctgagagtatggtgtgcctgccttatatctagtgcggcatgttttatagtcttagaagtctttaaaaactactttgtatgcctaaggtttccaagagtatgggagaaatcactaataaggtttgaaatcctttgatgtaagatcattaggaaaaatacatcaaaaagtgtcttcgctcttttgcctttgaatttgtctatgttatataaagctgttaggcatctcctctcctgcctgtctgtattccagttcatgagcatagctctagtgtatgctagcccccatctcacctcggatgacataggaaattattggcaggcagaagtgtctgcttgtggccccttagccccttcccacattgctgtttgtgtctgctgagtccctctggatcactcctcactcagggggtgacttgagggaagtgacgtttgccctcagcaccacctgcaggtcttgagaggcagtgggggcggggaggttgtagggatggagttagttgagaaactcctggagacaagtgggcaggcagaatctcatttacattaccttgctatccaagcagcagctgctccagtcgcccacaactgcagtgcagagaacaccatcaggcgtcttccacttgagtgttagagagagtacactaggactgaggtcactcgcctggcatgccctgcccccatgctctgctgagctgtagaatcccgcagcatctttggctctgaaggaaagaggagagggattcagatagacttttttcttcctgttgaactaccttagcagctactgagaaggtaagatccgttcttgttggtgaatggctgtaagtgttcgttcattcactgcagtgtatcaggctagacccacagacgtcatggagccgtgtgtcagacgtgtctgggagttaaaggcgtttatttgtcccgttcttgaattgagcattataaagtggcacagcataattccagagatgtttctccgaagggaagacttttcctgaaaagtcctgaaagcggtctcctcccactctcactgcctccctgcagaccggcagcaggcattatcttgccagcatcctgacagtgctctgactccgaaaggctctcttctctgagaatagttttttatgttaattcttttttgttttaaaaatatgaatagtagtataataaatgaatagaaaaaacctcttaattaatttaaagaaagcataacttaaggaatctaacataataacatttttaaactacaaaaaatagaatgggccagacagacagcttagtgagtaaaggcatttgccgccaattctgaagatccaagtttgattcctgggaccaagggtggaaagaaagaactgtttcccacaggttgtcctctgacctccacatgagctgtggagacacacacacacacacctgacattgtgttttcttctcatgcccccgcctctgttttgtgccttttaaaggttttcatagctgtggagtagacacaccttcgtctgtagcacttcctgactattaactattaagcagctcctccacagatttttaaccctcatttttctgggctgggggaggaaacaaggtctcaggaagaagccggtgtccgattatagatccctcagttgccctggtgatagtaaggaggctgagcacaaggcagagcccagaccggttggtcggtcggttggagcttttagtatttaaatagataaccccttgcttcctggaaactggggtgccagcatgctctgctcaggctggaagtctagcaatggcagaggtttgcctagtgagcaccaggccctaggctcaccccctagttctgttttaaaaaaaaggagaaaaaaaccctaaatgaataaaataagagctgagaggtagagggcacaggacaggttggcgtacggcaccactgaactggggggaaccagtttggggaacggtagatcttggagacggagcgtgcctgtgttcctttcttctggccgctcttggcgtcatttatgtgctctctgacggggctgcggcccccggtgccaccctctaagagctgggattcttacctaaaagttagtgagaaatgaagactctggaaagccggaaaatgcccaggtttttaatgcacacacactgacagccaaacagaacgctctttccgcttgcaggcttttttttttttttttttccccagtgtcattttaagttgcagcttctggccaatcagcgagctccatgcctagtgacatcacgaagcagccagttccctccagctgcagagagcttcagtttgtctttttttttttttaaactaaaatggaggctggtttcttgccttaaggagtacagcgcccttcccgctggagcctagatgttgacatgtaataaagcgggcagcgggatggtggtggatgcggccagctccaacgggcctttccagcccgtggcccttctccacattcgaggtgagttattgtgtgttctactgaccggaaccttccgtgggtagttaataaatggctattgtgctttggatgggaaaagcaggaagtctaaccagcagagtccccttcacgttgacgggactgcgcctgggcaggccaggggtgtcacctccaatcggtgggcattttacacattacttacggggcctgaggctcaggaggccttgcacgcagagttcaaagctggtttttctgctttctcgctgctctcccatccccctttcgaggctgtgctgatgtcaaaggatgtgaagtcactgcccggggaaggaaaggggcgggccagccgggcccggctaagttgtctgttcactgagtttgagttaccttggtgttagtgttgggtaatactgcaagggttttgcctcggtcacagctctgaattaaggatgaactgcaggcagagaatgtgcagaattgatgagaggagaacttcattttggaagatgtgtgctctagccatgcagcctgaagggagctaggctcctgcgtgaacccctgagatctgccggggttctggttgttaaatgctaggctcttagctttacagtggttgcctgtgctttgcattgacaaaggcgttgttaagatttaaaagggcaacaagttttcagtgtgcatgtaggtcacgggaatggctggcctgtcggaagcaaatgtgtagctttttctccagcctccttgaactgctgtagaagttggcttccacagtggttaaatgtaagatggccagaagaagcaaagggtgaccacaggtgcctcggctgcagaacccagcagcagtatgtatgttgattctgagccattggctaatgagcagtgacttgactggattgcaggtacaagtcctatattaatacatgtaaggaggtcccttatgggtatttttttttaatttttaagtttttatgtatgtgtatattttgcgtgtgtgtatgtatgtatgtggaccacatgcatgtctgctggtgcccagagagtcagaagaaggcttcctgtcctccagaactggactcagggatgctcatgaaccagcacgcaggtgctcggaactgaggccagctcctccccaacagcaacaagtgctcctcaccactgagccacgtcggcaacctcaacaacccctttggtttgtgagcctgctggtgcttattagacacctgatactctacttcttcttggaattatgaatttgttcaaaaatagaatcatttggttttacattttataaatagaatgattaatttatgggaggccctgttccacactttaccgtgcccatcacagagcgtcctccctgagctgctcagtgtctaactgtcaaggaaggtgccgcgcctggtcctcaaggttttcagaaagaaacctgtagccacctaaaaatggcttgtaatgcaaacggctggaatagctcctaattttaagtctcaaggaatacttgatttcctcatgaagacttcttaaagcagacatgttaatgttattgttctaatgacctggctgtgtgagccaagtgctgaaggtcatttaaaatgactaaaatacagcctcttcccccagagtcccctgctggagagggacagaggacagacaggaagagacacccgtgggcagggagccctggggagcacaggaactggggtgctgggaaggaaggaagaagacgcaggagagggtggccctccatcctacgcctccttgaggcagagggatctttcactccaaagggaatacagcctgcccaagaccacatagccctcaaatggtaggactagagtccaagtctaggaagctgttttatcttgtttgcaatctttataagtcacttttggagagaaattgtggctgttggccgaacgtcttgcaagaggattacagtttgctccccattgcctggtcagggctttagttcaatggccctgttttgcatgacagttgtatacccagagttcatttcttattcattttgcataccttgtgtttggcaagtttgacagccacactctaggctgatcctgacttggtccttgagcagatgcagtggcctgctttccccgtgggtgggggcactgggataggggcagtcaagtcgcagtgagtgctgctgctcacctgacgtttgctcccagttagttcggtagctggtgatgctgacagtgattaatgtggcgaattcaccattcccaaaagttcaagttcaagtgtcaagggaagacggtttaaccagtgcaggcctgactgccttcggggagagcgatggctgtaaatttagcttgatgacacagctcctgcactcacaggctgtccaagagagcagtctcccaagatggaaacacactttgtgatgtccactctactagcccgtggccacatgtgaccatctagcacttaaaactctttatcttagataagtgtcagccagggttatcaaattggacagcaaaggtctagtctggaattggcactctttcaactaaagtccagactgtaaatatttttggccctgagcaaaagcagctacagcggtaaatgaagaggcctgcctgtcgacccacaaagtcttatttacacatgcagggagcaggctgggtctgctcatgggttccggcctccagacctgttcttgctactgctgcttgtctgagcttctgtgaagaccatggatcactcctgccctccgtggaggacccatctcagagctaggcttcaggcagagacagctcagccaggaagatgccagccaccagagaaggaagcaggacaggcagtctagaacctcttcctgttgacctgtattcagggccatcagaaagccttgcacctgataaccttgtgctgattcatttcttagaaacttcctgggtgacagtgggaacacccagctcgcagcaggagagctggtggtcctttttaaagtagcctctttgtcctaggaagtggggtttaatgaagagagcccctctctgtggcagatcctcgctgggtcatgggttggtggacattcactctgccagtaagaacttaaaccaggcaggaagcaagtgaagtggatgagccctgtcctccatttcctagcacgacagtgtgaccgtgactgcgcagtgtgggtgggagggggcactcaggacgggcctgaggtagatgctgcgtgagcagaccagggcccactgctacccacattctccaaacagggaagggaagctgcccgcctgcccgagtgagactgtaaaggacgccctctctggttgccatgagctgtctgtcactcaccctctgagtggcagagtttaggaatgaccagtacactcttcctgtgcatgtgtgtgccctgtggcaggcatcctggagaaggtgcactcacacttgcatgcctgcatgtgtgcgtgcgtgcgtgcgtgtgtgctgcaggaattagttctgcccttggagttggggaggctactcacatggttgctttatagtagaagccatttctggtttattttttcactgagacatgttaattgtgtagaagaataagagggaaagctgaggaaagaatgagagaagcttggcaggtagtaatcacatggcacccatggcacccatgaagcccagggttcagtccccagcttctcatggagcactctggcagtggaggcaggaagaagagaagctctctcaggacaacagccccggctctggaaaatctgggttaggtgtctggggagggctggatggggtgtttggacctaggaagagaattggcggcaagggcgaggctggagtgcctgtgagtccccaccccacgttgatttgttccatgtttgtcccgcagtgccgtgctggctcaaggagcaccggctcactcactcgttctcgctctctctcactcttgctctccgtgctccagcctgctggggagcagctatcctgcggtgtctgtctgaacctcagtccacccagcctgggggccaactatgtgggtactgcctcggttatgtgggtactgcctcggctgtttgtcccagcgcagaggcagcattgtcttgttagtttcaggaccaaggccacatccacctgttccacttttccttttgagtccttccagtgccaaaagacattattcctcctcccccaccctttggagagaacagggagcgagcgccctctgcaggattacagaaatgcaatgagtctaagacagtcagagcccagcacagctcctgtcacagaatcacgaggtgaggggacagtccccttgtatccctacatgctcactgtctcctgcacataggactttgtgtcttgtgatgcctggggagcagcagttgtttcttacctgagagagtagggcttgctgtgggttatacactttttgtttgtttgtttgtttgtttgtttgtttgtttttcgtacacattttaagatttttgtatatgtgtgtctgtgtgagtatgtgcatatgagtgctggagccccaggagaccacaagagggcaccggaccttccgttcctggatttacaggtagtgtgagccactagacaatggtgctaggacagactcagatcctctacaagagcagacatgcgtttaatgacagagccctccctccagcccagagctgtttgttaaaccacgtgatgctatgtactcctagccctctggaaggttaaggcaggtaggattatgctaagatcagggccagtctgaggtgcatcgtcactttaaggtcagcctgggctatgtagcaaaaacaaaccagtcatgctcaagagatggctccacaggtaaaggagccgccgagtctggcaactcaacttcagtccttggattcacacagtgaaaggagagaaccagttcccacaagttgtcctctgacctttgtacataggccacacacacacacacacacacacatacacacacacacatacacacacacacacacccatacacacacacacacatacacacatacacatacacacacacacacacacacacacacacatacacacactcactcttaaattttttgtaatgtaattttgaaaacgttttaaagtcttcctttttaagtttgacaagaccaaagcaagcaaagtcactacatactgagcagatagaagactggttttattttaggttcgtgaattatccataaatcaaaaaatggttctagtttaagaatgcaggctaaagtgtaatggttagacgcaatgagtaaatgcagatcagcttcttgtttgtgaaaataccaagctcaggggcccaacaagatgcgcagagggaggggctgatgatctgagttttgtctcagcaacccgtgtgccgaagcagagaatggaatcttgaaacttgtcctctgccctctgacatatgtgcacacatgttccgaaatatatttaaaatgttattttaaaatatctacaaaatgaagctgtgttggagtggtgctgttctgtaattctggtgctgcaagactgatgtcaaaggaccaaaaactcaagactagcctgagatgcttgtaagttcagggccaacctggggctacattgtgacacatacctgcagtgaaacctgctaactgtggactggggcagttggggagcactgtgtgctgcagggccctggtgctgtggatgtccttgcttctctgggtgtggtaaagatggggattttgtaacttactgccagggaatggagactaaagtgtcttattagtgacgcatcaggatgtctgcaccttgctcgggtggtaaaggggccgctaagtctaaggcagcatgctgatgcacagagcggaggatgcagggaaggagacaccccagtacccattcacggggacaaaggctttacattcttcaggatgtttgaaagacgaacttcagagtgtgacagacctgtcacagcacaggaattgctcccgacctggtcacagctgccatgtgtgttggctgttttaccccctggttgctaactcacagcggctgcatggcccccgtgtattttggggtccatgcttgatttgatattgacagcattcttactggccttacacagtaactagctgcccttaaggttctcaaggagataaaaccaaggtttcctctgagcttcagggtaaggataaagacacgcgattagatccaaaaccttggttatatctggcaggggagcccttctctgtacctagaaataggaaaattaagggatttaccttttcagtgtttgtgagaggaataaacaagtaaatataagccaagagcttcgaatgaaatgctgtgagtctctccacatgttagtggtggccgtggggacccttttgtggggtgcctgtggttctttctagagcccaagagctaaccgcagttacagctggggcgcctgcatgcttgctctccttaaaggtctttttgcctctggcttcccaagccccctcatctcttcctgtgttgccccactaaagcagcaccctcagtacctgtgagcgtgtgtgatcccaggtgccacctccatggtttctgtggaacatgtcctaacccctgggagagcctttggggggagggggcgggggtttctctgtgtagcccaggctgtcttggaactcactctgtagaccaggctagccttgaattcagaaatccgcctacctctgcctctgaagtgctgggattaaaggcatgcgccaccaaccactgcccggctgattggtccagccttttttaatttttttcaagtccaacctgaaaactcgaacttaggtttttaactgtcaaagtggagtcttaccgttaacagccataagacatgttcagttttgaagtcagtgatgccgattgtgaccgtgtcgtttcccatgtcgtttcccatttgagctttgagcatagtgtgctcgtagtcggatgctttcgctgggactgactgctcacagggatgcatttcttttttttgttgttgattctttcccctcttttcttgagatggggcttatgttgcccaggttagtctcagactcctgggctcaagaagccctcctgtttgagcctccctcgtgtctgggacttggggcatgtgccaccgtgcctagctagtgctgtcgtgtgtaactaggaagctctggctctctgctttcccttcagcttactttcatctttcgcctgtcagactgggcagcattcgaactcagtgacatctcaggtgtaaccttaagtcttagtgttttaatttttaatatcgtggtgctttagtagagcttgatatgttaatattttggggatttttttcatctgcatatgacagctttcatcatatgctgaatttttgtgtctgctggttgtgttgcttgtaagtgctatttctaaattgtggtgttttaacttacgaaatcctgagaacagtaatgctcccttctagggagcagtcataacccttgcaaagttgctggcccttcagtctagagatgagaagcggtgtagatattgtagctgatttctgttcctgcacagctacagaaacgagtcttccagctccgtgtagaccacatgcacctgcgagccacatactcagaactcggtggttgtgacagccctgtagtctacagagcatcacacacactaggaaccccagagttgcagagctaccttcaaggggtctctctgcgggtgcccctttcagatagatagtctaaatgctgtgtagacactggcttgatggtgagacagtgatgggtaaacagctgcttttatagaagaaggtagcggggtccagctatcggccaccacgcactctgacatgcacatgcctgtctaccttgatgaaggtgatttgttttagaaaatcccacctctgacagaaactttctcaagtctgtgtgaggaagtgcaaagctcacatagaggcagctcagcatggccgccttggcatggcctcagcgctttggctctgctgaggagacgccccctcttggtaagttgagctgcaagcttacttctccagccaccttcctaggaccttcacttcttcttgaaacaccaagagtcacattgtgtttaggacatgaacatttgggcacatttcctcagatatgcaagaagcaagcttattggctcaaaggaaacggtcacaacactactttttgcctcttgtaaaatttcagcttccaaaccaagtatagatttatgaaaatttgcatctgccattgtggcattgttcagtgacagtgggacgagtcctagggaccagcaaataagcacagcgcaaggcacatgccagcaatggagtcagtgagggtgcactgcaggccagaggagtttcaggtacctggacttcatcagcacagcctcagatccacagtgcagctaagacttagaggtggtatttgctggtcaggtatagtggctggtgcatgtaggaggcggaggcaggaggatcactgttagcttcaggctagcttggactacagagtaagacagtgtcaaaaatcagccaatcagagttaacaaccagccgggcgtggtggcgccctttaatcccagcactcaggaggcagaagcaggcggatttctgagttcaaggccagcctggtctacagagtgagttccaggacagccagggctatacagagaaaccctgtctcgaaaaaacaaaaaacaaaacaaaacaaacaaacaaaacaaaaaaaacagagttaacaaccaaagtaactaaagctgcagctgtcacttcctgagtttgaatgtcagatggaagagcattggaaatgctcaggctgctgaagtgagcttgtgtgtgtgtgtgtgtgtgtgtgtgagagagagagagagagagagagagagagagagagagagtgtttcccatactcctcgacaaaaacaactcaccacaggaagttgaatacagaggcagccatgcaaacctgcctgccttctgttaagtctcctgcagagacatatacaaaagtgtaggatagtaccattccccctaatttaaaaaaaataagtttgttttagtaaaggtgtggtctgacatgaaataggcctattaataaccaatttaaggagagggtgacattgtaaaatttctcctccatggccggaatctctggatgtaacccacccaatcaaggctcctcttggtctgcacatagaacctgacactgagtgagtaggcgggttctgacgccacaaaaatcagaaaacctcatcccaagactctctagcccacactggaagggaacctaaccccgtgctccccagagctggtgtcttgtgtgttcccactcaggtctgtacgacaacaaaccgaacaaaataggctgagtgaactaagcagttaccccatggttgtggaaagggcgctcaggctgtgcagggtggatgtccggctctccctggcctccacacatcttggttagttccttttatctttttaaaaatctgtttttgaaattttttcctttgattcgtatataaataagccacttttgttcttttttgtctgtttcgttctgtttgtttttcaagataagatttctctgtatagctctggctgtcctggagctcattgtgtagacgaggctagcctcaaactcacagagatcctcctgcctcagcctcccagattaaaggtgtgtgccatcactctctggcttcttgcacttttcttaatcagaactaaaaccacatctccctggcctcgtccttgccttctgcatccacctgcacagcagagtgcttgccacatgtttgcagtctgctgtgggcgcttgaaggcgcttgcctgtgtgtgtgtgtttacttacaaacacaaatactataaaagtgcgtttattcacagaaagtttctagtctttttatttcttcagttagtaaggaaaacaagtaaaatgaaagaaatgtgagaaaacagacctttttgtaagtttgtaacgagggatgctctgagctgctggcacctttatgacctacctcatgtggtttatgcattcaggcagtaaacactgggttcagtttcctgcaccttcagtaaccgtgatttaacatttttgggctaggtaagcatttggaaggaggaggcaagcatgtagcgtttgccaccttccagagcttggtgtaggctcatttggtcagttttcaggtgctggggataacaaggcagagcatcttttcctggtgtagcttcagggcggtgtccccgtgttctcccttatcaaggcctggagatgggggcttccttttcttagttcttcagtcctgagcctaagtagaccttttagttttgtgactgtcagtggtcatttgaaggacattttaattttaaaggttaggccacactcactgagtgactttctgcccctccagacagagccctttctaggttgtcagatgacactgtccagacatcaaagctgtcagatctaggggaggggccgctgtcctttgcggagtctggcttaagtctttaccttccgagtctgcaacatgttttctttagaagtgcatttgaccagatgacttcttttcttttttttttaaagacttatttattttatgtatatgagtacactgtagctgtctacagacacaccagaagagcacatcgaatcccattacagatgattgtgagccaccatgtggttgctgggaactgaactcaggaacacacacacacacacacacacacacacagaggaagcccctccaaccttctgtttgcctagtttagtgtagcagatcagaggggcctttggcttatttgagtctttccacccttttatttttcacaaagagactcttctatacatgaattgtaggctaaacttggagccacaaagtaatttccgacaacacacttctcatttaaatgtttaaaaaaatagaggaaactttaagaagcattctcagtaaagtgttctttggcaagaagcagggacttatcagccaagttaatagccttaactgtggcatccgtagtaactagacaggctgcctgggtaaatatttacccatcagccccaaggcagagctggcagttcggggtccttcctactacccagtgtgccgggcatcaccaccttcttcatattgtttatgcaaaaagtttggatgaatggctttggtggcagcctgtggctcccagggagagtaaagtgaccctcactgctgtcattagcacaggggaacctttttcatcttcaaagctccttgcaggtgttcattagccaccgtcctctttgctgagaggtggtaaacaggtgttattagccccatttttacagttgtggaattcagagcagagagtttgccagcttgcctgaggtcctggagcagttggtgacagaggccttgggctttctgactcacagttctgggctcacatgctccagacaggcatgggaagctgctcttgcaggttcctttatctcggggatctcggcagaggtgtctgctgcgtttacagtggtgtagagtgcgggctcccgaaacaggctggtcaatctgatggtgtcatctagaaaaaacacaagatgcagatcctggggcgggaaggtaaggctcttcccaaaggcttgtggttatggtggaattaactcaccagggccttgagcggtgtagctgtatccagtgccggctgcagcctcttcacaaccctggtgctcatggtgacctgcctgtgtttgagttaaggacctcagctgccccgagagagccactgtctagctggatttgttaaagcaaagctggcaagaatctcattgctgaactcaatgttattcctggtaaaggtgtttagtgccatcctgagagtctggcagtgtggtaattctcttctttgtgccaacgctaagtagcgtggaattcttgtaaaacagaggcaccttcctccggaagcaggctctggctcagctcacccatttgttgaaggagaaatggttgtagatacaaatggttcatgacctgtacggtgaagaaatctccctgttctggaatcctgggtgcactgttgggagcatgctgacctcgcagccttttccgtaccagatgagcttgagtgtcacacagaaaccaggttgctcagcttacttcaaatccaagaaatcgttatccacggacggacggcaggactgagtcttcagctcctgcccgtggccatgtagagtctgatgtcctttaggcgagcgtttagaagtcaccagcatggcgctgggccatgtgcttggtccgagacttggtcatgttacaggtgctgtgtgtattgtgtgcgattgctttcagaggcactgagagggcaggcgggagtgattggtagcactagagcaaagggagctaagtgtgggggtgggaggtggggggagaatgggggagcggtcagaccaggatgaggtttccttaagtagcaaagtccttctcgggcctgatggcagagcagcgcagcagaacagagagccttggtgccctgagggttccttatgactttgatgaaatactcagaagaaactgaaagtgatgccggcagtaggagagtggactagggaggcgtgtgtgcccgaagcatgcagatatgcagaaggaagagccgagttaagaaggagggcgttgcctcctgctccttgaggcagatgcacacttttacccagttcatggctagaatacagaattgaagcaccaccatcctggctttagatttgagacttggccagaacctggctttcctagtccttctggccaggcaggccctctcagtgcttgccctggtctgccaaggcaacagagtgtaagcgtgtaagcggagtgtccaggttggcccctggtgaggcttggctcctgctctgcccttctgggttagctgacctctcggttctctgttcctttcattgaatgaaccagattggtgcatgcccctggtaggcctgggccttttgttttgtttgttattttcatggtaaatggtaagatgattaagagcaactctgatgaaaaagcttgcccttcaggacgaggaagggcccctgccttttctggagtaggaggctgtgtaagggaggaggttggccctggtggctttggtttttccgggtgctgaagaggaggcctcagcggggcaggacaataaatgggtagctagaagaacaaagaggggaggagcccaggcctggtagagtgtagaatggccggaagggtgtggccagtggctgtgggactgcggactgcgcagtccttgctgatttaggctttgcaaggtattttccactctggggtccttactgttttgccgaagagtggctctatctgtacaaaggctgcttccttttgtccctgtgctctgtgagccacatctaaggagctctacagagccccaaggtttgctcctgttccttccaagtcattttgcagcttgctttagaccttctgatcggtgtggagttggctgttatctccggtcagatgaagggaggcccttagcctttggcatgtggacaccctgttttcccagtgtcatttcttgagatgactgctccctgccctattgaacctgcttgataggcttgctgaaagttggtgtgccctacgtgagaaggtcgttcctgggccccactctgttcagttggtctccaccctcagcttccagccacttgctcttgactgctttggctttgctctcagctctggccacgggactcgggctcccatctctccatcttcttcccaagatggtttgatactttggggtctctggcatctccaggtaaagtttaggatctgcttgttggcacaccctatctcttccctctgttgtgtggcctccccatatgaagccagtgatgcagacaggaccacctacactccccaggagcacctacactccccaggagcacctcctagtctgggggaaagccttccagatgtttatgcctctgaaacccgaaggactcatcatgaaaacctctctggacttaaatagttacaggtcagggtaagagctgtgactgttcagttgcatgggaaaccaatcatctaggaagcagatagcatcaccctgtggctcacacaccctccgagtgagcgccgtgtgaagggaggaactgctgctggtcctgcctgcctctaacctctccagaccggaggccaactagaaagctgaagcctcccatctagctggggccaagacgtaacctgactcacaggcctatgtcctcttcaaagccgccatcctcttggtggtcctgatgtagattcggttctgtggtggtcctgatgtagattcagttctgtggtggtcctgatgtagattcagttctcggtcagtcttgcccatcatatgataagactctttcaagatgaagtctactcattccctgggagatcagggctgtgacttgtgcccacagatcttagttctcctggagccagactcagtcatgccccaacccctgtgcagctccatggcagaacttgtgatacccaaaaggaagaacaagggcattgtgttttgggttccagtataaaggactgccctttagccctagaatgttcttttggggttaaaatgggcttttttccttttttccttttttttttttttttttaaatctcactagttctatgccagtgaagtcccatagacccaaaagtgtttgccttcagagctaccacataatacttcaactgacttctgctaccccagagtccatgttttatatgaaataccctgactaagcaacttggtagaagctaaggtgattgtgatggcagcggctgacagagagaggagtagaggtgctgacctgggcggtatagggtatccctgcaatgaagagcctttgaaacgttgaagtggtgtgttctacccttatgaactttaaaaattcctttaaaaattattcactgccagccaaacatgatggtgtatgcctttaatcccagaggatggcagaggcaggtagatctcttgagttcaaggccagcaagttccaggataccaagggctacacagtgaaaccctatctcaaaaaaaaaaatatgtgtgtgtgtgtgtgtatgtgtgtgtgtgtgtgtgtgtgtgtgtatagccaggatgatatgacctgcttcctagatgatcaggtttgatgcaagtgaataagatcaaacatttgactttgaacggccatcattatgaaatgggatgctaatccaaataaaattattttaaatacacagcggctagaaggtgtggtgagtgttgtcatgctgtagatctgaggagcattctgtacctgcaaggagacggtgtgttggtgaggatccagggaacattctgctcagacatatagatattgtctggtatggggggagaagatgacccggggagcactctgttcacacatacagacataatgtgtgttgatgaggatccaggagcactctgctcacctgggtagatattgtgatggttggtggggacctgggagcactctgctcacctgggtagatattgtgatggttggtggggacctgggagcactctgctcacttgggaagacattgtgatgattggtgaggacctggggagcactctgctcacatatgcagacattgtgtgaattgatgaggacctgggagcactctgctcacatatgcagacattgtgtgttttgatgaggacctgggagcactctgctcacatatgcagacattgtgtctattgatgaggacctgggagcactctgctcacatatgcagatgttgtgtctattgatgaagatcatcattactagaagatgctgagcaggacacatgctctgctttgggaaagccacaaagtttggcttagcaataagtcaagaccccaaacagttgcttacctcctctcagaaaggctctctccagcctgtcacgttgcacagctggacattatgaagggccattcagctaaatctgactgagcttcatctcatggcccagttgaggtggcctgttctttggtggccatcaatggtagaggcaaccattagctcctgctgccagcactgggaaggagatgaggagtggaaactttaaaaccttgtgtgttgttttcaagtaggctgtccaaaagctgagttgggctttcgtagttacagtttgtccctccttcctgaggctgtagtgcctgcccagtcaagggtgagaattcttacagggcggcctttgtagggtggacatggttgggggcctggcagagaagtgtgggtgggtgggtgataaaggggttggtttgtatgtctgtcggggctttcctttgagtgttcacttgtcagacatttctgagcacatttgtactgttaacagtttcaagtgagcagcaaatggcagtggtgccaggggagtagctgtgtggcacgggggtgatggtgccgtgtggcacagggtgagaactctcccagggatgttcacagcctggggagaatcgccccttgagctgtggggaagatgtgcactggtttccctttattcatttgttagttttacttgttttaccacaagtgaaatgctgtctttgctacgttgctattaatgccttgatgtgtataaaaagctcacatttaccaaggcgtgggacattttgttactttcttgctacttccataagagaatttgatatggcagaagcgatcagaacatctgcacaaagctatcgatgagtggcagtctcaagtggtctgggctggtcttggaaatgtccaagatgaccctgccctcctgtcctcacgctgagtactgagactgcaggcgtgctccaccatgctgagctcagcagcagtgtcctaacggaggaactggacagagtacagaactgattcacatttgagtggagtttggttggattttgtttggttgttggttgttttgttcttgttttatggcattggaggtgtggggatgcaactgtgagtccattgtctgtaagatgggagatacacacacacacacacacacacacacacacaccacacacacacacacacacacacacacacactatccctttagaatgttcctaaagtaagagaatgaatttgcctattgttaacatccatacagaaatgttcttatttgagctgcaatcatacggtgtacattcagaagtgaagctttatagaacctggggcctgggacccacagagagagtctaacactgggatctttagtccttcatcttacttccaacgctgctgtcttcgtattctgttgctgtgaagagacaccacggccaccaccacaactcttacacaggaaagcatgtaatgagggctggctcacagtttcagagagttagcccactatcatcatgggactggagcggttgctcagagctctacttcctggttcacaggcacagtgagactgggcctagcgtgggcttttgaaacctcagagcctactcccaagtgacacagttcctccaacatggacacacccactgcagaaaggacacagccctaatcagctagggactaagcatgcaaacacatgagcctgtgttggccattcttactcaagccaccatagctggcaagggtcagcaaaggctgggaggaaagggtcacttgcttggtcaattggtctgtctgtctgtctgtctgtcaatcagtctgttttcccagtagaaaaaaagaacataaccatgggcattaaagtcacgttctttttccttgttgagtggacggctggaaacccgaactgcacacttggctgagtaattaaccaaagtgaggatgatttgtggtaccctctcctctgtcctgtgggatggccacagggcctccagatgtggtcagcatgcaccacagttggcaacaccagagaagattttgaagtgattcatagttgaatgttattttgtttagtaattatacactaacaaatgtgacggtgtgtaattagcacattaaatctctgatttcttgggttactgttgcttaggctgggacttagtcaaaagtgtgtccactggaaggagaactcgggcaaaggcctggccttggtgctgtggtgagagactcagaggagggttggcaagcggctggagcagggccttcgggaccgagaggtcgggttcagcctgcgaatgctgctctgaggacagctcctcagcctctctcacacggggggcctcaacgcaggggtgcctgtcccaggagtcacactggcctgcagggtcagactgcagagccaactggtcctgcctccagcctttgtctgctggtgcagcttttgctcatggacccttaactagtgtggccccgagcaggttaccgagtatgttggtgctccacaaaatgaccacggaagtggctccctgcagaagagctatgggtcttgaacaaggtgaggggtgtgaatgcttggcctgggtctacaacatactaaaatcactagccccacttaatggagcctgactgccggtgcttccatttctggatgactgtctgggcctcaacattgcccccaagtagttgtgtggccagactgttgaggtgtgaagtcagatgttaacaagcctagctgccctcctgtgccctctctcacagccctctgcaggctctgagtcagccccaccagcacaagcgtgtcactgagaagcccctggtgggcttcccagactgcctgggagtgaggaggccagccttgaatcagaggctgtaagaaggcagggctgagattcctggctgtcagtttgacaaaagtgttaatagggtcactgagttactgaaaatgtctggtctgatcacgtggctggagattctgtgggctcctttggagaagccacaatatttgcaagtcagtcccacccttccctgtgaggctgagttaggtaattgtctgctctttctcaggagattgttagggttgtctgacaacaggatgtttataccgcacagccttaaaggtcaaatttgcatgaaagtgtcttgtctcctgttctctcttcactgggtctgggagttctgttccagctgtcagtactagattgaaagttttcagtggtctgcactctgactaaacgtggtccagtcaggacaggtgcatccttggtgtggcctccacctgagaagctgagcaggtgctgtgttgtatctggactacagcctcatttggcagcatcagagacctcgtgtgatgctacacttgacagcagtatttccagaacaggctactcagaaacctttctcaaaattgaagacccagaaagcacgccagaccaggcatatagctcaagtggagtacctgtctggcttgccagaggcccaggagaaaaagaaaagaaactataggacaatcccacagtttgacatttgagtgtagaggctgttagacctgagatcaggcaagaggagacaaccctagaggtccactgtcatcccccgcctctgcatcttttaaaatttaaaatacaaaggcatgagatatgagcctctgccacaggactggctaggggctggagaccctcgggcatcttcatgcagtatgcagtaagacgtaagtttgcttctctgggaaccttgggtggaagtggaaccatcttgttagggactgttctgtccaaaggtgaatttgctggaagctttgagggagcctcaaatcttacaacttcctctcagagcgggtctgttcacttgtgactctggaacctcagagaaggaaggggctcaggtgagggtctggtgggacactgctcagcttctgtgtctgggactgtactcaggacattcccggtgaggaaaggtgccatctttggggacttggaacctctgattccagttcctctgatgacctagaaccaggacactgaatattggagcattcccggccttgggcagtgtgggcgtattggccacaaccgtctaaggaagggatgcctggctctggcaggcacaggagacagtgcagtgctgagcagcagctgtggacttcccaggagcagagatgttttgtagacctgaagtctccacaggccacaggactttggctgagtgccaagtctagctaccctgtggtccctaaagggtgtgggtgaggcagcccctgggcacctctcacatgcagaggttgcccaccgtctttctctacccttccttcctgtggtctcacctgcctgtcacctgttgaacctaaaccacagctattggaatggatctcactaacagccagagtctgcgacactgtcaagtggctgttaggaatgagtctgtctcatattttagaaacttacatcttgtgccaggggatttgaggacagttgtttacatgctgtttaaataaaaaaattaagtataatgcctccattttaaacattagatataatatgtgaattttttctagcctaacacttaaagattattcccataatttaaatttttagcatttacctttgtaaacttaaacaagaattgttatgttaactgtagttttaaatcctaaaataagatggataatataaaataaaaaataaaaatagagtaaaaacctgttaggcagacatagaagaaatattgactacagtgttaatatttgggctaagttgaattcaaggcagaaaggttttttgagtcgcaattatttcagtgtgcacacagtctgtagatggtagaatcgccactagcctgtgtgacctggctggtgctaaggtagacagagggagaaccacagggcatgatggtctctacttgatccctactgcaggggtaggaggcagcaggtcatatggtggatactgacttattgtggagaaagatctgagagttttgcatcttaatctgaaggcagccaggaagaagtgtctcttctgctctgggcataggacctcaaagcccacccccacagtgatgcactttctccaacaaggccacacctactggagcaaggccacacctcctaatagtaatacttcccatggggcaagcatattcagaccaccacagtccccagtggtgtgctcattcaatctgcatatctgctttcaggggaccccttggagtggcctccagatgccaacagtatgaatctcagcaatcccttcttgtattgtttggttgcttgctttactgtgagcgtatacttttctagagacaaaattctttgaaaatatgcaatatgtgttatgtggtgttagcagtcagctaccaaaatgtagtttcatctagaaaccctggctcagtagtccacagtggggaatttcatttataagtttgttgttcgggtgtctgaaggcaaggtctcactgtgtagctcaggctggctcatgatcttcctgctacagcatcacaagtgctgaaatgacaggcacgagtcagtaatccatcgccagcttacctgcaggttttcctgtgcagtatcactttgtaagttttacacacacacacacacacacacacacacacacaccattacagaaaggaaaatgaacctactataacccttcgtaaacataaaaactttcaggatagttttgcacccaaacctaattatccagttgttgacggtattaagatgtgtatagatggcccctgtgatccagtggtcattatgataattgcactcatgttcagccggcccccttgagcactgctctgggttctgcagggtaggagcataattgagttatgcagaagcagacactgctcagtagaaactgcctcgagatagatagggatttatttgctaagtccggtccatcggtggcctgcttggaaatgcctggaggggggatgggaactgcctcttcccttgaagacgcccctgggggttagtgagtgacaggatccacagcagtaagtacgagtaagtcacttggcatcaaaaaaaccaaagcaatggagctttactgaaactgctgccttggggaggctgctccaaacatgttacgtcatctagctcacaacccagtgtgacagctattcctacatgaggaagctgagacccagagacagaacggttcttgcccagggttcctctcatgtcttcagaaagacactggggttccagctaaggtagtcctactgctacctgggttgttgtgttgttttggttttgtaaaaggattgctgtgtagcccaggctgacctcatctctgtcttctctgcctcctgggggctggggttataggtgtgctttgctgcactcagctctcctggggccttgtgcctctagtatcagagacataacaaatacagttggattaaggactcagagttgggaattaaagagtggctgtgccttgctatggctccagagtgtcaggaacataagatgattctgccgtaagatctggaccatgaagaatgcctcttaggagccccacctgagagatgcagagctgagagcaacagtcaggaggctcccagaggattctgctcacagggcaggaggcctttgcacaggaatcctcagttacagagtcaagaggggatgggtagccacaaggaataagtatccattctgcaggaaagccaccccatttcagatgtacagagagcagaggcaccaggctgccatggtcatagatgctggagggaaagaagtgtctgctcttgggtcattgggtcaggtcagtcagggagcagggcttgagtcagggccacaggaggctggtgtcacatgtcggggctgcagatggaccacactctgcctggcaggcttcccgtcctttctaagaggcattggtggtacctcagccctcaggctgctctcctctccacagctggataaccagccccactctgggcttgtctggttgcacagatacagacattaagcggaaggcacgaggagtgtgttcatgatctgggacacgtgcttataatttgtgcagatatgcaagaagaaagctcagatgtgggttgggagtgaggctcttgcctgccgtgcacaaggccctgggttccatccttacctctgtttttttgtttttttttaaagtgtggaaggtgggagttgtnnnnnnnnnnnnnnnnnnnncagagttcagttgatagcatgactttttccagagaaacagcatctgctggccagcccctgaacaccatgctgagtagcccggtgcttgcaaatttgtaagctctcagcgttctggatgctgaagcatgattcagggctagcctgggctaaatagccaacccctgtctcaaaagaaaaaaatgtactcgaacctgtgagtaggcatgtttacacatgcacatgtttcttactagaatgtataggtgtataattaagggagcagttatgtcagaggccagagttgcctcccttcaggtctccattaaaaggaaagaacatggttgccaagaggcctcaggttggccatttgctgctggttggtttactttcttggcttggtaagctgccaccagaagttcctgaagaaagcagagtgagcattgagctgggcttgggctccagcgaggacactgttgtcagtggctccccctggaccagagcttgctggtgacaggcagtaggaggggatgctaagaagccgtgtcactgcagactctcctactgccgtggcatcgtggcatcatggcattggagggctctgcaggaacactcaacctgggcaaggcagcaggcacttgtttcctatttgaccaggaaagttacagggcccaggctgctgtgacagcggcggaagtggacctgccctgggcctgggtccctcagcctgtgggggcggcgctgtcaggaaaatgggattttctcagcacttcattgtgttgaagcaattagttaaaatagttaacatgttctttgctagaggcagtaacaaacaggcttaaatatgcaggttcagtcatcctgcgagccaccatgaggttctagctgtctttcagagtcttgagtcagatagatataactatttcctttcttttccttttcctctttttctttcctttcctttccttttccttttccttttctttcctttccttttcctttttcttttctttcctttcctttccttttctttcctttccttttcttttcttttctttctctttgtttcagatgctggccagaacctaagtatgtgttttgctgtaagggactttggcttccttccttcccctctggctcccctcccgagtgtggctccccgtcatgctggcttggctcagatggcatgtctgttttcctctcccgttctcctcctggcagctgctatgatttatccgtttcctgccctgggatttttcttagattctaataaagttgtcctctttaaatcagaagaagaaaaacaaatacactttaaaaaaaggaaaaggggggaaaggaagaaatgtagggtttcccacgtatacttcaggatacatgcatttccctctctcccagactggacatcctggcccagtggtgaccctcttcggtgtgaccaagagtacccagtgagagaggggtgcccgtctcttgaggaatgcccctgacactcccagccagctcttagtggccatgtatattgctgtgacagagtactctgcataactagggaagaatatgcatctgagctcatagcttcagaggtttcggtacagagagcttggctccggtgattctagggccatggtgagacagaaaaccatgtcccagggagtgcgtggcaggggctgctggcctcatggcagacaggaagttaagaagagagagacaggaaggagccagggcagagaaaggaatgatgagacatacccccgaaatctattcctccagctaggcctcaacttccctcctcccttttaccactgtccagtaataatatcacactgtgctgggcagtggtggcgcacgcctttaatcccagcacttgggaggcagaggcaggcggatttcttagttcgaggccagcctggtctacagagtgagtttcaggacagccagagctacagagaaactctgtcttgaaaaaccaaaaaccaaaaaacaaaaacaaaaataatatcacactgtgaacccatcaagggattcatccattgatgatctcgaaccccttaggagccccaaagcccattagctggcagccagtccgtaacagaggttggccacagctggcaggaacagaagtcatgggtcgttgacaccagccatgttggcatcattagttacatggcacagttgtcgggtgccttttctttgtgggcaccgagctgcaagctgggcctctccaagaggagagcacagcctgcgaggcctcatcccaggcgcccaaggcccgaggaagcgcactcagatgggaagggcagctgtgtactttcactggctggcttccacgatgctagccagatcccggcagcagggagttagttgatggccgggcaggttgggcttaatttttctcagtgaggtttcttttcctatactgagatccatgaggtgaggtaatataaagaaaagtttatttagctcatatctcaagctttgttctccacctgatgactttatctcctcttaatcatctcccagaggccctgactaagtctctattactccatacctctctgtggggattgaattttggcacacgaacccttgaggggtgatcttcacttgtatccgtggaaaagtggtggactcagagaggcatcttatagaagatccagaacaccccagtgcctttttgtgtcaattctaactcccaaagggtgacagcattcactagttttttatttccctcattgaccctgttctcagtcctgcagtggccatatggacaaaaagagcctggatccatagcaacagagggtgtgtccagaaggaagtgcctgtgtgtttgagatgctgagaaaagaagcaggagacagtagacgctgagcagagccgcctggtttcccttacgaggatcctggtgaccagctatgctgttcggctattgaagttctggactcttcctgtgccagtcatactcgttgcctgcccttgttctttagataaatgagccgcctgttgctgagcatggccaccaggtgtggcagtgttgtttaatatttaatgagtgggagatgaagtgactgggctctaccacaggtgatgagcagttgctaattggcggtaattacagtgtccatctctgttccccacgggcatcctagaactaggttctggggtagggaatatggcctgcatcagcagacagcagcctgctgcatccccgtgtttaccttcagagtttctttagcctgtcttaatatttaaaaatgttaaattcttaatattaaaattgttttttaaagcctgtttaaaaagccaggtcttcccttgggctaagtgtttgaatccttcttgtactatgtgtctgtgagcattgtgaagtcatgattctcaggaaaacctacatttctttcttttccttccttccttccttcctttcttccttccttccttccttatttaaaaaaagacaactttattagaatttaagaaaaattccagggcaggaaacagataaatcatagctgttgccaggaggagaacggagaggaaaacagacatgccatttgagctaagccagtgtggagtggagccacactcgggaggggagcctgagggaaagaggaaggaagcccaaagcaccttacagcaaaatgcatccgtaggctctggccagcatctgaaacggagagagaggaaagggaagactgcccctgtctcgtacctgcaactcgaggaggatccccgcccgcccgccctgtatgcacacttccatgggcagtgcaagcttcagcctgccgaggcttacagaactggctgcctgctgcttctggacttggcagagtctagactggaaagcagcttgccccctctgtgtgtcttcatgtcttcactagaaagttcacttagctgaatgagttgccaaggagaccaatctttcctggtccccaccttatctccacctgacctcctcccaccagccccaccctgttgtggagggaagaacatgaatgaactagaacttggcttcagctcctgcttttacaggtatgatgactgccttattaaataaacagcactgcgatttcatgagaaccagtggtggctaggcataaaggaaggagtgtgccccaatttcatccgcaatgaaagcagacaccccaaggccctccctgaggcttgggccaggagtggctttaggaaaatgagcagcttcaaactcgggggaccagcatctcttcccgtagccgagcaatgagctcaactcagagccacgggatggggagtcaggaaagaatggcgtggggagcttgggcttcgctagcaagtgtttacccacccgcactagccctaagtgcacctccacagcccagaggaaggatgctgtcgggcccagccatggctgcttgctctctcaatgtggtgtcctctagaatgccaccaagcaaacctaggcacaggaggacaaacaacgcttgtgagagcgatcagtcttcagggcctcccttcttcctagaaccgggtggttaccttcatccttacagtctgtgtcacatgtaggaggtcacctcgtcctcacagttcacgtgacatgaattaaggtggaaacaggtgagaaatgagtggaatccacctgtttagatcccagcacagaggcagtgtgtagggaaacccagctactttgtcgggctagtacagaatctacctattgcttaaagataaaaataaataaataaaagacacaacttgattttttaggggtgttactatgggaaatacacattagaacaggcaaaagaagatatttgcactttgaaattagaaaatatttcaaattcacaacagcttggaggctgagggtatagctcagtgattgagcgtttgtctagcatgtgcaaggccctggggtctatccccagcaccagcaaaaataatggtgtgacagttattttcactgtcaccttgacacggtctagaatcccgtgagaagggagtgagcacgggcctggtcagatcagattggcctgtaggtgagtctgtggtgcgggtggtcctgattactgtgttaatggacataagaggacccagcttacaacgggcagcacccaccgttctttacccgaggcatcctggactgcatatgtgtggaaaggggctcagaagaataggagtgcactcgttcttcctctctgctcttgatgtggatgtggctcgccggccgatcaacctcttgctctgacttctgcgtgattataacctgggactataagccaaacaaaccctttctcccctacattgcttttttgtgttcttattttatcatggcaagagaaacaaaaccagacatgtcctcatcatacttgtccccgttgtcttcgttgtcgtcgtcatcatcatcgttgtctggtggttttgagtcctaaagttgttctttagtactaaagttatgaacattttaaaagcaaggcttaggctccagtggccccggccagcttgctctgctgcttggcccaccgtgagtagtggtgaaaggcagagagctttagtcaatcggccacagtggacagaggaacaagtaaagagatccagtgatctccctgtgtatccttaggggtactgacctgaaattcaggtttaaacaggaaaagatttagagcaagtggcaagaggtccacatagttgggctgtcctggcttaggtctggttctggttccgagaggtagtccctatcattacttgaagggctcaatccagtttctgcaagacggtttctgcttcaggatgcatcttcaccctggtgggttccccctctgctgaggtgcaggtgggggcaggcctgcccttggaggttgtgttcttccaggaaaagaatgcctccctactctggagaggttaaggcaatgacttgtctctgtgcctttagccaaagtcaaggagacagacagacaccaagcgaaggcagagatgcaggctttgattcttcgtgtgggcccaagtgaggcgtcagtgctttttagcaaaagtagcttctcagtgcctgtctcaggaggtcacgtcagaagtcggtcatgtcacctcacgtacgtgagtcatgttgcctcatgatgctttcatagagtgatgtacgcatgcatagaggggagcatgactggggttcagtgctcacctagctagcgttcacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacaaaagatgagttacagaaggatgtagatagtaagttcaaagcagtgtttcattctctaagctcagtataagttcaaagccacagttgcacatggccttgccttatcatagtgcacacctctggcctcatccttgaacctgacctagaatgaatgtttctccttgatcacaaatctgtcccagcctatttccctttctagtgtaattgtaaaagctcattgcattccttattatgcagcctttacttattttgtgaggagggggcacattctattcttgattctaactttattacatctgtctggcaaaataactaaaaccatctccttaaacttttttcctaaaattatttgaatcaaatcaggaatcctataaagtcactaattcatttaaacagcataaatcaacatcttcatgttgatctgcaggaaatctgcccaagagggtgggctatctctgaggaagtagtgacaccaggctctaggcagtgagggtctcccggtgtccactcacaccaagccacataagtgaggactgtggcagtgacaaataggagagtgcacatcagtagcaagaagcagtcagtcctgggacgaggtccctgggactgtgcctcaccagagctcacccatcggctgagcaggacggtgggccagctccagagagctcacttccccactacagctcttcctgcatgccatccaccagtgacccacaaccactgtaactccagttccagagaatcaagcatcttctggcctccaagggtaccatatgtggggaacagacaagaaaaacacacaaacaacttaaaagcaaatcttcaaaacaaaaaaaccccacaaaggatgaggtgtggtggcacacacccttaatcccagcactcaggaggcaaaggcaggcggatctcctggttcaagactaacctggtctacatgacaagttctaagccagctggagttctgtgtggtaagaccacacctaaccagagacccttttaattaaacttgccatgtagcagaaggaaggcttgacttttgagtttgttgtttgttctctctctctctctctctctctctctctgtgtgtgtgtgtgtgtgtgtgtgtgtgtgtgtgtgtgtgtgtaggagtcccttggcctatgacatcacatatcctgtgatttgggttaaaatccgtacctgggattttcagtcagttctgtaattgaagcatacactgtaagttaatctgtactattggctattatattagtgactattccggactcagaaaagcccgcagtgttcgtcactgccccacaggggtcttattttgtggcccagggtagcctggagcttattctgtagctgcaggctgacttgaatatgaagtaatatcctggcttcagtcttctgagatgcgttccttccaactcacagcatacagtggaggtgtgtgctccagctgtcttgatggttggcaagtgtgagctctgggcagtgaagaacactcccaggcttttgtgagtcctgaatagccagccattaacaccattctgaggcccagggctggttggtgtctttctttcgttccttccctacagacactaagagtgtgtctgtatgctccatgccctagcatcatcaaggacttagcttgaagcaagtgtgaagtgcttcacattcataatacattgaggaaagcaaggcctgctgaaattactaatgcataatgaggtgttggaggttaacacgtctatccagggtgaagcatggtcctccgcatccctagcatctccagcctcttgtgctgtcccattagcacagctgatcctctggaactggatacagatggttgcaagctgccgtgtgtgtgctgggagtcaaatgttggtcttcttcaagagcagcaagtgctcttaactactgagccaaacctccagcccctattttaattaattaatttatatttttatgacaggctcactgtgtagccctcactgcccagaactcagagacccacctcctctgcctccagagtgctaggatgaaagacatgtgctgccactgcccggcttaactgtgggcttcttggttctattgctgaaaaaataaacaaagcatagacagaatgtacattggcaagctgtgtcaactcttaagcttatttaaggcatcctggcaagatggaatgtgaccacatattcccaagggtcagaggctaggaagaggaaaactcaagaaacatgccctttccatggaaagcgtcgggttgagatggccacaggctgtgcgtgttgtgatggtgtgatatgggggggcggctctcatgacctcaggtgtcattcagcaatatgtgccgcctccacacacacacacacacacacacacacacacacacacacacacaccccgccgtcagtgtttgctttctcagnnnnnnnnnnnnnnnnnnnntcaagcatcttctggcctccagggtaccatatgtggggaacagacaagaaaaacacacaaacaacttaaaagcaaatcttcaaaacaaaaaaaccccacaaaggatgaggtgtggtggcacacacccttaatcccagcactcaggaggcaaaggcaggcggatctcctggttcaagactaacctggtctacatgacaagttctaagccagctggagttctgtgtggtaagaccacacctgaccagagacccttttaactaaacttgccatgtagcagaaggaaggcttgacttttgagtttgttgtttgttctctctctctctctctctctctgtgtgtgtgtgtgtgtgtgtgtgtactttaccaatcaggctggctctcttgacttttttttttttcaaatcagagttcacataattcctcttggcacagtgaggcaattgagtccttggcctatgacatcacataacctgtgatttgggttaaaatccgtacctggaattttcagtcagttctgtgattgaagcatacactgtaagttaatctgtgctattggctattatattagtgactattcaggactcagaaaagcccgcagtgttcgtcactgccccacaggggtcttattttgtggcccagggtagcctggagcttattctgtagctgcaggctgacttgaatataaagtaatatcctggcttcagtcttctgagatgcgttccttccaactcacagcatacagtggaggtgtgtgctccagctgtcttgatggttggcgagtgtgagctctgggcagtgaagaacactcccaggcttttgtgagtcctgaatagccactaacacgattctgatacattgaggaaagcaaggcctgctgaaattactaatgcataatgaggtgttggaggttagcacgtctatccagcgtgaagcatggtcctccgcatccctagcatctccagcctcttgtgctgtcccattagcacagctgatcctctggaactggatacagatggttgcaagctgccgtgtgtgtgtgtgtgtgtgtgtgtgtgctgggagtcaaatgttggtcttcttcaagagcagcaagtgctcttaactactgagccaaacctccagcccctattttaattaattaatttatatttttatgacaggctcactgtgtagccctcactgcccagaactcagagatccacctcctctgcctccagagtgctaggatgaaagacatgtgctgccactgcccggcttaactgtgggcttcttggttctattgctgaaaaaataaacaaagcatagacagaatgtacattggcaagctgtgtcaactcttaagcttatttaaggcatcctggcaagatggaatgtgaccacatattcccaagggtcagaggctaggaagaggaaaactcaagaaacatgccctttccatggaaagcgtcgggttgagatggccacaggctgtgcgtgttgtgatggtgtgatatggtggcggctctcatgacctcaggtgtcattcagcaatatgtcccgcctccacacacacacacacacacacacacacacacacacacacacacaccccgccgtcagtgtttgctttctcagtgtggttatggaacccgtgagccagtgcctgttctccctaagctttgccaattaaggattcagagaaataaaagttatcatcagaaggcacctgccttcacgtgccatctggggaagtgaggaacgctaagcaaccagctgcctgcatactgtggtgctggatggccggctccacagagccttgccttatcaactaggaagtcaggaagggccttgtagagaagctaacctgaaaggtggcagtaggagtgccgaggaggccatgagctgaagagagcggagcggcacctcgtcagggtcgcttgccgggaaggctcatctgggaaggtgctctcaggactcctcccactcgccagaaaactttatacaagttcacgttgaaaatgaagccagaggtgagggactcgaaaagaaaaaagttagtgtttttatgaatcatttaaattacaggctgaccctgtgtactctgcaattgagaagcaaaggcagaagggtcactgcagttttgaggctagcctgatctacatcaagttctaagccggccaagaacctgtcttaaaagtaaaatagtaataaaataaaatatatactgagagaagttgacagttttatgaaaattattctctgtaatgcatggtttactggtgggtggctgggttctccctacacatctgttctacaccagcctgtggcctcgtaactcttggttggttgtgggaaggtgtagtctcgaaaaaggcccttagagagaattgtggacatctgaccagaatttagtaagtgagtggtttgttaagggcttaatctgcgtgtgactctgaaacagatgagatgcaggcacattttattctataagaatccagtggtcttctgcatacctgaagtgacggcttggctcttgagtagtatcatagtaccgtttgctaatgctgggggaatactgagtggctgacgtgcacgcatgctctgagatactcagccagccttgtatgtacatgacccccaccgtcatcaccactggcctcttcttcaacccagagaagctgtcagcctcacactggcggttaaagctttctaaactcaggaccctggactgtcgtgtggagctgtctttgggtccagtccagctttattgcccaccagcctgacaatgtttctgcgtctctgttgtcgtattaaaaatgaagtgaaagatgtcagcatcttagtaagtgctcactgaagaagtcctggttacaattgcagcgaccacatcactgccattgtaggcatgtcactcagagggaggaatggaaggaacttagagaaaaatcaagaggctgcccttactgcgggtctttgggcagatgcagttgctatgtttgggcagccagaagtctctcccccatcccatacctgcctctgccgccatcacgcagacctggcctccctgtctgctgctttttctcacccccttttctcccagaccagggcctggcatgtgagtgttgctgcccagaaagtatttgtccattgagtgccttcagaagggttggttgtgactggtgctgtcaatcatgccaagcctgtgatgtcagcagcggccagctgtggggcacacacgcccttttcactgtttaaaggatacctaaccactgtccacctcacccatcttaattcacagtaaaaatcggaggctacgagtgtctcccggccatgtgggttaagcatcgttgtgactgacagcccccactctctcctttcagatgttcctcctgcggatcaagagaagctttttatccagaagctacgccagtgttgtgtcctctttgactttgtctctgacccactgagtgacctgaagtggaaggaagtaaagcgcgctgcgctgagcgagatggtggagtatatcacccacaaccggaacgtgatcacggagcccatttaccccgaggccgtccacatggtgagtgacagcgctcacagcacggccccaagatttggagtatcccaaacacaaaccaagccctcccactcccaccctgcagggtggtggtgagggttaagcgaatgcaaacagctcctctgcctgtcaggagatgtcatctgttcttcccgggagttctttggcttgactttttaacacctccctgttggtgccctcgtgtagttcagaagtaagtgccctgcccacccgtgtgccctcagcaaagagcagatgcccagggtagcaatgcccagggtggtgagcggcaggctcttgctcctccctctactccagctctcacgctgtggacatcgacagttctggaactgtaaggagctgtactgagtatcttcaaagctttgtttgttctggggtggccattatagtcagtcctggagcttcatccgtggcttaagtcaggagtgtagcttcattttcttctatggttattaaatttgttcttatatcagatattaagatccatttcctccattcattgaagataaaagtattgaaattaactttcctttaaaattaaatctctctctctcagtacctattaaacttactaataggtcagttacagtatggagtttttctgtttttaaacagtcctggcagccagtatggccgaatttatactctttaatccaagaaggaagattctgccttgtttgggccaaatgcctacccttcagccaagtgtaggagacggcttgactcagcttctcatttgtcttccctggagcgcctgagacggacgctctagagacttcttttatgggctgtcctcactcctactcctgttacagagttccctagctagagtctctgtctctgttggaactctgtcccctcctgagcattatggcctccctggggggtgggtgatcaggtggctcccagaagaatttgacacacattttctgaatttgcactgtgggctgggcactcttaggagagaaggaacagattctgacagggatgaagccagccagcactttgttgacttgaaacggcatgattcagaccatgctggtactgggggaaagcaagctgaggctgcagggctgagggtgtggcttccgctccttaccatgtgcacgaggagagtaacagacccagagaggagagtaacagacgactcaagctgtcagatgtcgtgtgtgtgtgtgtgtgtctgtgtgtgtctgtgtgtgtctgtgtgtctgtgtatatcagtatgtgtctctgtgtgtgtatctgtgcatgtgtatatatatgtctctttgtatgtgtttacctgtctatatcagcatgtgtctgtgtgtgtgtctgtattcttgtatggactgatgatatattaattattttctcagactccctgacactggggaaggtactggtggttggtagtctgttcatggtgtgtcttgtgctcatcttagtgaatcaagaatcaagagaggggccgagcagtggtggctcatgccttttaatcctagcacttgggaggcagaggcaggaggatttctgagttcaatgccannnnnnnnnnnnnnnnnnnnatagtgactcacaaccgtctataatgggatctggtgccctcttctggtgtgggtgaagatagcgacagtgcctatgttttacatacataaaacaaataaattaaaaaaaaaaaaacaaaaaaaacaagagagctccagccagcctggcccttccaaggcctgctgcctgggacccgtttgtaccagacacacacacacacacccacttcaaaagttccacctcttccaaaacagtgccttctgccgagaatcaggcattcagacacgtgcccatgggagacatttcaagcccagagtagcagacagcaacaatgaaaagtgcagtgaaggctgagtgggttggggctggagtggctgtcgtgagacacagcaacacatgtgggattcaggaagcctaccaaggcctccatccaagacctccatcccggtgggcccctctttgggtcaattctaatgagaagcttagcagccctcagccccagcctgtggccacgctcacggcactttgcccatgctcagcagctacctgctgctgtttcttctgtgtggagtgcatgcaattgtgtttttagagacattaatttccactaactgaagaatccacagcactgtagctgtacaaacatcacctatttgactggaatgctgtgtggcttcttaatggctttcaagacattatttatcttaaagttcaccccttacctaaggaatttgtagttttgatacttctaatgtttctctcaaaaggaaatcttattctgctcccttaccactgcctgcacagggcaacctttaacctgctttctctctgatttattagaatggctcacaggctgtggtccagctggtccagtgatggcctttttccaatggaaagtccaaggatccagtagctgtttggttcataagtgtgatgcctccactggttttggtatatgttggcatcccaaagaagtaggctctaatgcctatgaggaaatggacttcaccactgagactgagagcaagcaggcagagagcaagcttccttttccatgtctttatataggctgccatcaaaacacgaggcccagatgagaggtggctcttcccacctcagaagatctggagtaaaggtggatcttctctcctcaaaagatccagatttaaatcaggtctttccactccaaatgattaattaagaagaaaatttcccacaggtgtacctaacctcttgagttttagttccagaggtggtcagcttgaccaccaagaatagcatcacagctcttccagcctagtttctcaggcttgagatagaactagccaattctcataatgtgtatttagacataattcctagtctaacttctggctagtttctcgcacagcagaccctcgtggataggatggtaaaatgtcctttgggatccatggatcctgattccataaaggttaaggagaactcctatcttacaaagcagctgacatcagaggcccaggttgaccaagcccctcagtcagtcaacagagtttcgagggaaggagtgaggcttaaagagagaaaagacaattcaacaacattgtagcatgactccagcaagtactgaagcaagtttattttttcccagcttgcttttgtaccattctaagtacatgcaaagaataaggtcagttcttggtcaaggacaaaccaggcataaacaaaggtcccctagtcactgtattcggggacttatcaagatgatcaagataaaaggagtagctgggcagtggtggtgcacgcctttaatcccagcacttgggaggcagaagcaggcagatttctgagtttgaggccagcctggtctacagagtgagttccaggacagccagggctgcacaacacagagaaatcctgtctcaaaaaacaaaacaaaacaaaaaagaaaaaagaaaaaaaaaaaagatgcaaggagtatgtatgttcctcagctgtctttttcctgagcttacttccttgtcttagcccaatgtcagatcttcttgccagtttccttgaagcagccccaagagctttccacctctcccccttttttatttcataaacaagacagcctctgtcttaggttgttctgacaagaatgccttccttacccatcattgaaaatgtattaaccaaggcaatacatttctttctcaggttagtaaggctctgtgcagaatcttcctgtcattgactacaagcctgttaaactagtggctctgtctggtaatccatttcaagccatgcatttttggctaccaaaatgttgatgttgttaaaggcaagttttatcaaaatggacaggcataagagtattctcaggacaagaagggccaagatgatcaaactatataagccatttgtagagcttgatcaagatgaataattttatcagcagtatccacagcatcaaagctcagcggcacagcattcttgttaagttcataatctcgatatgcaaagttaaaacatccagagaggtgttagaattacgccacataccctgcaagtgtctttgcgttttctcccacttatagtgactgtcattgtaatttttagaagtgacacaaatccattggtatttagcgtgacacttgagatggcttcttactcttaaactctcaacctcctctccaataatttgagtagaattataaagaaatcagtctgtgttccaaacacctatctaagtcttcttgagtactcagagcattcgtgttgtcttttgctaagtgattaacaaaagtggctgtcttaacttcttgcatcagaacaatggcagaagcagtggtgctggctgttactgtgatcagagctgctgtgccagcaggaatcaagccgccaaccactgccctcttgcttctgctccctccagtatttgtatgctttttttttcagaataccaaggtcctgtcatactcacaggcaataaagcgaaagctggttgataggccaccatcacagacatgccagatttcaacacagtaacacaattagaaagtgtacaatcaatacagcttacattaaataccatagaagaaatgaaagtagttttaacatgatcaactaataaaatattaggagacttaacacatgcacgaacacttgttcaaaatccagatcctgccccaactttgtctatttttaatgtaacttcatagagagctgcagctaacttccaaatgtaccattaaaaatgacctgagtctgattgccaaagacctatggacatctccttttgtccaatgtttgattcattccctgcccaatcaataatttgcctattattggaaacactaaaccacattggtagtttattataacattcttcctatctaacagttttgttaaatgccagttccacattctgagtgggttcagatccacaaggttgtatctcgtgaagatcggggcagatccctcataatacttaggcatgcccatctctatgctttgggttacagttttaaagatattcttctttcagttttctagtcttgacaatacaaaaggatgtagcaaaggtgggtccagcatgtatgcccagtacagcttcttaggcaccatcatcagggcgctaagcaagctcacggtcagcatctttctttgtccgagcatcagcatatctcaccaatcgctctggaagccactacactctttcagcatcctgagaaaaaaccacaaacatgccctcttccccactttaatgcccattcaggaccatgctgtatgctagttaagtggatccttccattttactaaagcatatgtagtggaagtgagaggatgccaaaaatgcttagcagctgaacgtctacgaacatccaaattttaaaaatttaagataaaaagaacatgatttaaatacttttgtgatgtatagggatataattcccccttttttattttgtgagattttgttttaaagttccgtgggcccactccacagtaccttgtccttgaggattataaggaatcccagtaatatgggtaatgttaaattgtcgacaaaaagcctcaagtgcatggctgcagtagccagttctgttttaatctgatttggaacacccagtatagaaaaacaacacaggcaatgactaattacgtttttagttatttctcctgttaaagcagctgcaacaagaaaacttaagaaggtttcaatagtcacatgtacatattttaattttccaaaatcagaaacatgagtaacatccatttgccataattgattaggtacgagttctcgagaattaacaccattgtgtggtacaggaagaaactgaggacattcagaacaagtctttacaatttgacttgcacattctctagaaataccagattgttgtctcaagctattactgttttaataatgtaaagaatgagattgtttggctaattattctgtgcaaggcctgtaatcagcctgaaatacaaatctgctgtggcgttgctctcactaaggggtctgggcaatccagtatgagctcttaaatgtcctataaagtaagaagtagtatattcccttatattgaattggatttgcataaataattgtaaaatttgagaattagcagtatctacaaaaggaacattttcaggcaattgcaaagcatgagctacatattggctatcagtatacaaattaaaagcttgatttttcaacatctcaaaaacagtggcttcagcacatgattagattatttgtgctgaaggggggaaaactcaagagaataaacatgtgattcaattccatataccgtcttcccatcagatgagctgtctgtaaatacagcaagcacactctccatgggctgcacacacagatctacaggaaatacaaaaacacacagaggcaaattgtaacaacttgtcttttggataatgattatcaattttgcctaaaaagtttgcacatgcaataggccaactatcaccagtattctgcaataaccaatttaattgctgtttggaataagggataaatatttcatccagttctttcccaaaaaactttcgtaatccagtcctacaattctgtattaacagctttctttggagaaagatgaatccacattaatggtcccttttgccaaaggatgctgtgggtgcaaacagccaacagttgaccatcgcctgtgtactgtatctgttgctgagtactggctccctctccttcctgcacagccgtccgtgctcatcagcagttgttggagagagttgggattgggtcctcctgcagaaggtcaagcagaggtttaacttctccaggtggctgagatgagggcttagccacctgacatctcctaacagcttttgaaaatcatttaaagtgggtaaatgatcttttcttatttggattttctgtgttacagtttgtttaggatataactgatatcccaaatattgaaattgcctttgaatctgttttggagcaacaaccaatcctcgagactttaaagcttgttatagaagagccaaggcttacagtaaaactcttcagaaggatcagctactacaacatcatccatataatgaataacatacacagaaagattcaaagtcctaaccttttgtattgaagcagcaacaaatttttgacataaagtaagaccattagccattccttgaggcaaaactttccaatgatattgctccatgggttctttaaaattacaagcaggctcactaaatgcaagccttttagggtcttttaaatctataatagttgatacatatttttttggaatggcagctggagtcagtaagccaggctgtaatgctcccataagttccatagttccattgacctttggcaaatcttgcagtcatctccacttgcccgaattgtcttcataattacaaatgtgggtgagttccggggggttagaacctggagcttgtgactggactgtaaactgccaatctccccttagctttatgcatatttaactatttaatataaaaagtttcttttgcaatatcagagcattaccataattttggaaggcaagaccaattcttaacagtgtaaacaatccagtctctctaaaatcaataccaagtgcattattttcatgttacaaagtttggctgccagttcttgtaaatgaatgtgcgacagtgcagctttcaatttttaatacctcattaaagaaacattgttttaaatcctatcttttataagtctgacttctagatcaaagaattacataaaatattattccaatttagaggcatctttagagccctgtttccctaggttggctcatgccatgtgttgttgctagaatgactccaaccctgagttaccagtttttgtttgtttggtgtttgtttgtttgtttgtttgtttgtttgtttcgagacagggtttctctgtgcagccctggctgttcctggaactcactttgtagaccaggctggcctcgaactcagaaatccacctgcctctgccttcccgagtgctgggattaaaggcgnnnnnnnnnnnnnnnnnnnntgggaagcagaggcaggtgaatttctgagttcgaggaacagcctggtctacaaagtgagttccaggacagccagggctacacagtagtaaaccctgcctcgaaaaaaccaaaaaacaaacaaacaaacaaacaaaaaacagtcagaaacaaacatgaagtggttatatacatttacatagttagactagacagacaaatttttcttactttttctagctgtaatttcatgggaggagcaccctgccacctgctgaacccaaatgttccagcagataaagttttaaccattttttcttttgaatatgaaacacaaagcaacagtcaggcaacaaaacaaagccacagacataaactgacagacatggacagactgacacaccgaggacaaacaatagacagagggaagagaactggatgtcccaccaaagggacccagatccaggactaggcatcccccagtgggagccagagaggaagcaagctatctcctgaactcctcttgtccctagcgtacctctaagcatttgtgcaaaaagcattttactagccctgtcccatttcacagactttactcactgctggcccagatttttgtattttcctttgtgtgagcttcctcttctgccatgcccttcactgaacccctcgtattcgagcctcaacattgagggcaccacctgaccaacccagctcagtcagtcagcaaggtctcaagggaaggagtgaggcttaaagagagaaaagacaattcaacaacattgtagcatgactccagcaagtactgaagcaagtttattttttcccagcctgcttttgtaccattctaagtacatgcaaagaataaggtcagttcttggtcaaggacaaaccaggcataaacaaaggtcccatggtcactatatttggggacttatcaagatgatcaagatacaaagagtatgtatgttcctcagctgtatttttcttgagcttacttccttgtcttagcccaatgtcagatcttcttgcgaatttccttgaagcagccccagggtctctggttccctggggatgccaagagctctccacagcaggtttcccggttccccggggatgccctgacacactcggtgttcgctgccacctaggttgctggcaggtgtacctgtcacagggtcagcagagactgcggcttccttctgggctcaggcctgggtcacagtgacgtggctgaatgtgctgagctcagggttgttggttgcatggacctgtcgccgttcgttcctttttatagaaaagaggagagagtttgagatcagccagcatgccaagtgcactgctcctcctgtgggaagacaaggtgaagagacagccccagcatttgtcactgtggctcctgcataaacgtggtggctggagatctgggcctgcagcattgcttctgctgtcacagtcaggtctgctgcccaaagactgacggagatggaaaagcagttggaagcactgccattttaaccattcctaccctaaatttcttaatttatgtaaaaatggagcagagcccttctgagagtaaattccctaagaggaaagttgaggtcctgaattgctgaattcatgggacactactttctctaaagccttggacacaggaagggaggccttgcgggcagaaagaggtctggctagggcactgtttggatagattggctggctcagcagcccttcgcagcacatggagctctggggttacccagacacctgtgctggatcactaaccagaacacagctcagtgtactcagtgagtcaggaaacatacactgcatcccttctgaactcccgaggcaccctgttacctgagggcgcttgcactgaaaatggtaatatggtctcagccctcccagagactgcctggacgtgtctgagggacaagaccagacagtagtagcagcagtcagagctgagagctgcacaggcagcctgaccactgttactgtctagaggatgagctgatccgcccagagtcagagagtggggcagggtggtgcccggcaggggccgtgctccaaggaccccaggagcaaaaagacttaggttgggtggagtgtggctagagtcctgaccctggaaacctaatggttgtgagagagtgcacactgccccttcactctggctgcctgctgagaacatgtaggaagagctttgccatggtgggtgggggtgtgctgtgggacaggctggctgacagacatgccccagcatgacagataggtagtggagtaagctacttagctgggacagctgagagaaatgggcaggtgtgggtggtgttagggtaggaacaagatgtggtttgatttgatttgagatgtgcagagagagaggctactgtccagttctaggtgcagatgccccagtcactattgtactgtgtgctcaaaggagagtgttggacatccgaggatagcccagacttgatccacagactctcagggacagctttctctctgccccatatcccatgctcagtatgaagctattctcttagacactctttattctcttgagctttcatgtgggtgctgggagttgaacctgggtcctttgtaagaacaagtgctcttaaccactgagccaaccctcaaactccttgtttctaattttcattcccagtctttgataccttgaactcaggtgttttttgtgacttggtttaatgtgagtgttgctttttgcagtaggacattaaactgcaagacttatttcatggagagttggttagattaggtgactgggatattaaaaacacacggtatgaagtgctgttttctatctgtggcatagaagtaaattcgtaagaataaaatcaaaatagcagacagaaagtgagtcatgaaacacagtgaagtgtcactcatctaacagaggctgagttgttggttacttatttaagtaggctctaaaaataaacctagaggaagacaggcccagcggttagctatacctgcctttgcatagtgtgaccttgggaattccactttgcccagtgttttggtaattctaaaatacttttacaatgattatgtaccacatttattatcatccaaactccacaaattaaaaacaaaactagactaaaatcaagcactgtgtaacactatgatagtgctgcccacgtaggactcctgttggtttccaggattgagttcgccccattattttaccactcaccccattaatctagtcactgttgcacacttgattacatactggttttcgggttttcctcaggatatactggaacaaacctgcagtgttctcccacccacatcccaggacaggcatctcatggaccctgggatggttgaatttggacacttgtcgctgcttcagtgaggaaagggcattgttcgggtgctgcgagcgtgcagtggggaaggaaagggtgtttagaactgaggaggagaggatagtcgccagcggcgtttccatatactttacagccctgcttcgagtgagggttaagtcacgcggccctctgtcgttctttgctttaccagcgttacaataacctgggttaaagactatgaataacagtgacgcgctgagattatctgcatcctttaaagagctctgctcttgcaattttgaaaaattcccctgtttgatggttttaaatagtaaaagaaatacatggttatttttataacaagtgaaacaaatttaaaaagaaaacaactctttcctcacgccacccttctcgctgctttaggcatgctcattcccaaccaacaaattcattctagttcttcttttttttttttttttcttttgcgaaatctgctgagaagccttggggaggatgagtgagttcaggtcgtaggtgatgtcacaggtgggctgaggagtgtggccagtgtgtcagtcagatgtgcggagttcgcttgttcagtgtatctcagtagagcttggatggttgagccccagagttgttaggttaaaaccttgcagtccctgtactcaggcggcacaaacaaggagatggcagcaagtttgaggctggtctgctcttcgtagcaagtctcaagccagcatggttgctaggtgttccttttgctcgtggagcagatcaaagagattcaaagaaccagagtggaggtgagccaggaactttggaggagcctctggcctagagagagttattctcacactgtctgccagccactcatctttctatatacctgtgccctggtctttgccagaacgtctgggaagtgggcttgtcccggtgtgactgttagagtctggtttctgttgctaagcaagtgttggcgattgatcttgttgggtgagtcagtggtcccctcaaactgctccctgtgctgttcattgtacaagcacccagcccgcttatccctcccccagttgatgcctttgggtggcttctggcgttggctgcaagctgttgtgtttgtaggtgagctttagactcagatgtgcatgaactttgtgcacactgcaatgggtttcgggccagcacgctagcacccaagaactctgtccttcatttagatgaagccagctctgactcatttctgtaattgctaatactgtggagccatggctaaaaaacccagaaagattttccttgtgttctttgttacaggtttacattctgatttaggtctgtggctcatttgtctgcaggctcttttagccgccctatcattgaagaggctgccaacctccatagaacagctttgcacagtagttgtacatcaattgactatattagtgagtctgtttctgtattccactgtgttctgccattggtctctgggactctgttctctgattactgtatattggatcccagagtcatgggatctggggctgcccgggctcgcgggtgctgtctcgttgctctctgctgttcctcggttcctgcctggctcctcccctgctgtcttcaggctccccggtctctcatctgtcagttccaccccgtagttcatgtctcaccctttgggcatcacccctggtagttggatttgtatcttttgtttatagcttctgtgtctatgcctcactttttgtctgctgatacccacctcagtcaggtcagttccaggtggatggcctattctgtcagtgtgcattgcctttccctgttttccacctatctggtcttcacctgtgtgaaactgtgcatttgtcctgttgagtcctgtatatttagttttttttttccttttaatgtttttgaggcatacttggagatgcaattaagaaatatggagacagtttgatccttttggttcttgttttaaccattaagcaggacctgagctgtgctagcctagagctaacaacttctccattgccaatccaaggcccagatggcgctgagtccaaggcaccaatggttgggagtcttcctggcctgcttgataaagtagccactctccccagcctcccctaatacagttatctttcaatgtccagggggattcatatatcaggggatgctcaagacctttatatgaggggtatcatgtctgcagaagcacgtctccctgtccactctcagttttctcctgctttaagtcatctctagagactacacctaaaacactgcaggtgctgtgtgatgactcattacctagaacacctcaggtgctatataatgcactgtattgtttagaagaccatgacttaaaaagagaagtctctatgttcagcagagatgcagcattttattgccttttttttttttaggggttctctgtatagccctggctgtcctggaactcactttgtagaccaggctggcctcgaactcagaaatccgcctgcctctgcctcccgagtgctgggattaaaggtgtgggattaaaccacgcccagctatgccaaatatttttgagacttgattgactgaatccagggacatgaaacctacgggtaaaatgtcaactgtactgggtcctcactaatccttgtgtgtgttttcatggcccctggtagttttctcacatcaaatagctacatgatgttgtgctaatcaacgacaggacctttccagtttcagaactccctcctctgtgggactgactcagccttgcaagttcacattgcccctcctgctgggctctacagcctgggagtgtcctggtggtcattacaggctcccttcatctcttccatctcctgggatcagaaggatgtagtgccatgaatttttacctagtgagtttggtctttaggacagtagaataagcccatccctatgacacttagctatggcctcagctgagtcagccatgggcacagggtagtaggattaaaggcagtcatgtaagtgatggttccatggcctttctcacttccttacattgtgtgggaggtagggcatattgatgggatattctgaaggcttcctaactccctcacactttatgccaataaaaatatccatctgctgctagacagagcaaatgtgttaaaaaactgatcttagaatccaggtgtaactgctcactagaccgcacttacagcttcatgttaaaattggtcagcatcaaacatgtcgggattcagcatccagaatgtacttaaaaccattggccatgggaaataactcaggattcgtttcttgttccacctttgttctactttgctttcctacaggactgggaattaatctggggcctgtgcctgacagaggagtcccctgccaagccgctacatactcagcaaacacttggtgtggtttggttttctgttctgttttgttagaaacagagtctcttatagcccatgctggctgcgtagccaggaatggccctgaatttatgacgccgcggcctccaccttccacgtgctaggttacaagcctgtgctctgttttatgatgtgccagggaggagcccgtgccttcctgcctgccaagcaagcaggctgccagctgagctcagctccaaccctcccactgttggacactgttatttctaagcagatactaattgacctgccttacgagctattacttgtcatggtttctttactcttaaaaatgttaaataaattcacacagtaaaatggctgtcccatttcatcattatcagaagtaagatagtgtcacacacttagttgtacaatagctataaaatactatgaattgttagaacagttgttaaaagaattgcaactacatccccattatttaatatcctataaagattataaatttttatttccctgatattttcaaccatatgttagaacatgtaagttgggcatctggagtgatggttaagagccctcactgctcttacagaggacccagagtcaatacccaacaccaggagcctcacagccatctgtgactacagctctggagaaccagtgtcctcctctggccgccacaggcaagggcacactgtgtgcaatgcacacacccaggtacctctttatacacataaaatgaaatcttattttaaatactagaacacacagaataaatacttctaatctaaaaatccaaactgaatttttgagcaccaacataataccacaatggaaatgtttacagttgacctagacccactaaaaaaagttgtatgcatttaatggggaaaatttgttttaacttacctccaggttatatgtttaaggaacaaattaaacctgaatccgatccccaaaataactcacatatatatgtgtgtgtatgtatgtatgtgtgtgtatgtatatacatgtatatgtatatagtatgtgtgtatgtatatgtatggatatacacacacacacacacacatacatactagtgcaaacaattctggtagcaagcatttcagataagagacattcatccactgggcggtggtggcgcatgcctttaatcccagcacttgggaggcagaggcaggcggatttctgagttcgaggccaacctggtctacaaaagtgagttccaggtcagccagggctacacagagaaaccctgtctcgaaaaaaccaaaaactcacatatatgtgtgtgtatgtgtgtgtgtgtgtgtgtgtgtgtgtgtatgtgtgtgtatatgtatatatgtgtatatgtatgtatgtatgtatatacatacacacacacacacacatacatactaatgcaaacaattctggtagcaagcatttcagacattcatccgctgggcggtggtggcgcacgtctttaatcccagcactcgggaggcagaggcaggcggatttctgagttggaggccagcctggtctacagagtgagttccaggacagccagggctacacagagaaaccctgtctagaaaagaccaggggaaaaaaagagagagagagacattcatcaatatttgaacagactgtaaaaatgaaaagctattcaaatgtaagaattttaaggatgggtttttaaatgccatgtgcaggcatctatttggcgggaaatggcggtgtttgaaagcagttctggctctgcctcgctcccctggagagctactgagtgaatgtcgtagggcccgggttgggagtgaaagcctagcatgtccccaccatccaggtgcacttgaggtgagcactccagagaagcaccgtgcaggagctgagagtagggacagcagtgagaactgcattgcgttacagctgagaggcaaaggttgaaccgcctttggcaggttttttgtacttagttccgttagtaaggtgaccgatgtgcacttttccagaggacctgctctgtgcgagtttctgagtgtctgctagagggctggctaaatacattcaccaagtttatccaagatttgtctcaccgtatgtgtgagactgcatgcagggctggggaggtagctctttggtaaagtgcctgccatctatcctctatgaaaaagcccgacacagcagcatgcatgtgtgatgcccttgctggaaaggtagctatctcctggagctcacagaccagccagtgtacccatgtcattgaactccaggtgacacctgctggcacacaacaaaccgatcaattcaatttgaaaatttctctgtgggttccctgtaggagatggccttggtgaagaaggttctgtcgcgctgctgcagctgtccatagagccttttatccctttctgtgctttctctgaaggccgcctagccagatgactagctcacagcgccgaatgtcttcatgtctgtgtttatggcatcgttccatccatacagcttctcgttgttgatgttgctgcccttggttttttattttggtttttgtgtcttggggcccacctttgctgataggtctgggcccctgctttacaagtatacaacatataaacaaatggtgacttgaagacttctcagaaatgtgtctcttcgcactctgactcttagaacccggtaccccagtgctgtctgtggaaggaagtgtttggagatagccatcatttggcccttggcctcccagatagacatcatgctcgctaggacagcgggaaccggaagtgagggagcggtgggtcagaacaaaccaaagagctgagaaatgaatactctcccagtgtctctggaatgagaatcattgttctatttgacaccgtccctttacatcacagctacgtaagtggtcacagacccactcattggtgatggctgatacaggtacagagaagctgcacagggctgctggactgtaagagtcttctttgtaaattgtttttcaggctgctttggcatttatttagttagttagttagttttagtttttcgagacagtgtttctctgtgtagccctggctgtcctggaactcactctgtagaccaggctggcctcaaactcagaaatccacctgcctctgcctcccgagtgctgggactaaaggcgtggccacccggcttggcttatatttaaaacagagaataagaccctttgagaaagatccccggggctgtcgtagtgaaaagcgagagtgtcggttctttctggtattacagtcgtgcgtggcacaggtggagccttgtggattagcacaaacacatgcgcacttgtgagcccgctcctactgtctccaggaaagacatttgggacatgatgagcaatggcatgagccagaatgctttgcagatgttctctgtgaccctcagagcagcctggtgtgaagagagggtttgcccttttcagagacggcacattgagaccctggcagaatgcccattcctgtcttgactctagatgagaaaaggtcacagtgtcgtgctgccctcccacatgcgacccgctcctgctttgtgtctgtatctccattattctctgaatatatgcatccatttacaagattatgacaggctggcacactgcgcagcacctcaggcttccggcccttcatccggccttggtcccatcgctccagcaccacaggtcccaggagcatggaggtcacatgagtgccattgctttcctcacccgtgtccttctacaaatttggctcctgaagtttttatatttaaacatggcacccgattagaaacaccagtaaagtttggggtaccagactatatgttcgcctctgtctccccctaccccagcactagctctaataaacctttgggggggggcagtgtattgtgattcactaacgaagtgtctgggagctccaggtgtcaggtttccttacacaggaactcctgggatgacaatgatagaagctgttgtctttcttcattgtccaagacatcacagttctgctccttaaatactcctggggtgggttgcacagctcgcatcatctttggttgtagaatcacacccagcttggagctctaatctgagggcctcctctcatctcctcttcctggggataacctgggaagagcgctctctctctctctctctctctctctctctctctctctctctctctctctctctctgcctgggaacagttgcttgttttctcatcgatgcttgtagccgcttccagtgtgttggtccttcctgtgtggtgtgtccatgcctgcggggcagtgttcagcatctcttaagatcttcctctgaatccccaacctcctctacagatgcggaccctcctgggtctccacataccctactctgcttctatgatggcacccgccagagcctgcaacttatgcttgtcagagagcaaagagccatctcctattttctttaaggccccttacttagctcttctccatctgaggagacaggcagatcagacagaggactcggttctattctaactttcatctcccaatacagtcacagcctgggaaggtacaggaggcccagggagtctctgctgctgacagggtcagttctgccactgtagggcttccctggaaggcactgatggtccacccaggctgtgcgtgactgagctcatcccatctccttgcctcatccttgagcttcgaaggtgtgttccctcaggaagccctctgccctgatcccccatctactgagaaatgtcctgtgcacctgcttctctccatggcttcccatccattgtttgggaggccccacagagccccatgcacattttctggatcccagagggctcctgtccccagaggccaggagttgacactcatactctatgtgggcactcaggcgtggcgcataggcctgcctccctcctgaggcatacattgtttctgtatctctggccatcgttttctcccttgcacgcctcctcttctgtctctgccttcttcatagaagctgcacagctgctcctagctttgatgccggtgacatcacaagaaatgcccggattgcaagctaggtagtagtgacagtaaagaagaaagactcgttactataattctgactctgagaaggctgttcttgcagagggcgtgggttcagttcccagcacccacctcatggcttgaagccatgcataacctcggctctggggcatctagcagcctcttcatgcttccacgggcaccagtcagacatgcagtacacagaccatgaaaataaatctctaagaaggacaaggaggaagaagaagaggaggaggaaacccagggaagtgccaggtgctcatttgccttctaggctcaactgcaaggctcagcagcgtcccaagaggttgtcctagagctgcccttcccatttatgtctgatatttgggtttgcatttttaacaatgtgggacaaggacttttttttggggggggggggttgagacagggtttctctgtgcctggctgtcctggaactcactttgtagaccaggctggcctcgaactcagaaatccgcctgcctctgcctcccgagtcctgggattaaaggtgtgcgccaccaggcccaacggacaaggactttttgattacctataaactggaactgtcatttgatggctgtatagttgtcataagataataggtcacatgtaaacaataaaaacaaaaataaaataaaacaaaaaaaaaacaaccctaaattaatgccttagaagctttgatgtttccatcactggccagtcaaagtgttttgtgcgggtccagtcagaccaagtgctctgctcaaccgacccctggatacacagccagactgtgcactgtgaagtctccctgtgttctcaagccgtcctgtttccgaagcgatctccggctgcctgagcagtccctcgtctgcctcgtgcttccgtggttgttaggaggccagcgctgagctgttttctcagtcttgcttctttagtcttctgtggcctttatcatcttgtcctcttctcatttttcccttccccactcactagatgtaacgtctcatatgtcagcgcgaacctctaagcagcctctggggtcagctgtcttgacggtttgacagttgagggtcagagtgccggtagcagtcagttggatggtcccctgccaggaaaggtctgtttcaagcctcaagtttgatcctgtctcctttgggcgaccaacacatcttttgaattttaagaaaagtagaaaaacagcaacaaccaccaacttaagagtgggaagcatctgtcactaggattattcagtgtttcttggattgttcttggtaatactcgagggtcctggttgtgatcgtggaatatgtgggttttagtttgcagttaacatgttccgaaccttgccaccttcctccaatcccacgggagcagaattcgacccagaagaggatgaaccaacgttagaagcagcctggcctcatctgcaggtactggacttggcaccagctcggataggatggagtgtgatggcgtgtgctgggtgagagggcccagggccactagctgatagccaggggcttctgatcttctcaaggagtctctggtctgaaaagttttagtggaggagagagggggaaagaagggagaagtaggaaaagattgattaaataagtttgtgagttattgataggctgattttatggacccattacacaagccagagaagtagactgatttgtgtgcccttagtgatgatggcaattttactgatggcactgagttcaggctctgtcctagttagagtctctattgctgtgatgaaacaccatgacccaaagcaggttggggaggagagggcttatttggcttacacttccacatcactgttcattatcaaaggaagtcaggaccagaactcaaaacagagcaggaacctggtgtcaggaggtgatgcagaggccatagagggtgctgcttactggcttgcttccatgatttagtcagcctgctttctcatcgaaccaagccctccagccctgaggtggctccaccgcgatgggctggcccttcctcatcaatcagcaattaagaaaatgcactacaggcttgctcacagcgttctcaatcaaggctcgctcctcttagatgactgcagtgggtgtcaagttaatataaaactgcccagcacaggtttagagcgtttcccaggcgtgctcctggctttcggtgcctgggtcctaggctccttgctgatacctggacgatgcacggccactgttatgaggctagcaggagcaaagcatttctgcatgtctgcatttctgcatgtccttggtgagggaggaaacagagggaggaagcaaagtgagaaagaagcctgggaaggagccagatgccccacctgcaaagcccctggcttccacacagcccgggatagactgtcctgctatccagcccactgggctgtttatttacaaagggaaccacagtggttgtggctcagtggctgtgctttggtgttcctctctcaggcaatcctaaagttcttgtccacttagaactccatgattcatgtagacggcagactgcaggctccaccctcaagtctggtcatggtcccaggggtagcagctaagccatgaaaagcactgtgtgccatttaagaaatagtctgtggttctcactaaataaaagaattccaactgcagttataattatgctaagccacagaattcagcgttaattttgaatgcatgtgtggtttttcttaagtccagtgttttgagcagataaagaatgaattagagaggtgataaagaatgagttagagagttgtgcgtgagcctgatgaagtgccatgtaacttgactcactgttgttttcttcttcttcctagcttgtttatgaatttttcttaagatttttagagtctccagatttccaacccaatatagcaaagaaatatattgatcagaagtttgtattgcaggtaagttcccagccaggcgttcttcggcagccttaaggacagcatggccactgtcactaagtgccgttttatttttcttaaagcttctagagctgtttgacagcgaggatcctcgggagagagattttctaaaaaccaccctgcacagaatctatgggaagttcttaggcctgcgtgcttacatcaggaaacagatcaataatatattttataggtaagtcccccgtgtggttctcatccacccttgctgctgtcacatcaaagatgcggagggaaactgagtcatgtgctcatgtccccaccacgccaccgctcatgctacacacacacacacacacacacacacacccatgtcttactgcattccctacccttgctgggttcctacagagttgtccagttgctcacaatgtagatgcttctgtcccaggcacctgcttgctaccttgttattcctgctcagttccaggcaagacaggaaggaggaggaggaggcggcaaggaagtcggcagcctttgccttcgaggatctgggaagtagatgaacagtttgagggccagccaaacacagagaggagagcctggcagctggcagacaagacagctttcctatctatgcccagacttgggccttcaggatctaagaatgaccacagacctgcctgtccccacaacccccagctcagaaaggacaaatacattggtggctgtgaccccagctgtcttatctctacctgcctctcccccatccctgtctcatctctgaccacgcctcatgactctttaagttctaatatcccaggtgagcatgcaggtctatacctataataacacggctccggaggccgaggcaggaagattgccacagcttcatctacatagaggccctagtgagccagggctccattcacgtggtccatgtcactgctgctgtctggttaacatgtgcagccatcctaagttatatctgtgcttccagggtctggcctccccagactgtgcagccctgtgttaccctaggctgcactgttgcctaccttgccttgatccgtcagatctccttcctcaagaagtccacatgggctgacatggttcctgctccccaggggccgcctcggtgacaccagctttgtatgcacccacagtgagacagagtgggtgctggaggaagagtctgtgtagctctttcataggaaggtctccttatgtcactcctggctagcctgtcactcactggactaggatggcttcaaactcagagctcctgcttctgctagaactgagggtgtgaggcacctgcccagcctgggctgtgtagctctttctgactagtacctggaaggccgactaagtaagccgattactcagtaattgttggcttcttccattggctcctgctgtgacatctgactctagaggagccgaaaagtaacaaatgttggcagtgatggaaatgtgacatccgtctgatgtaaaataaataagcctcacagtctagctgtgggccagacctgagccctcggccctcacggcagcgctcacagcagtgcaccggcctgccagaccctgcttcagctcccagcagtgactgacagtggcccagaaaggggagctgagagtgaggctggcgcctgtgtggccctctggcctttccaggcctggggtttcccaggatcttttgcctggtggcacatggcaatcttggggccctcattgtgtggcttccctttgagcctttccaggctccccataatacacgatatttctctggtggaacccagcccagccctggcttgctgacgagtcggagaatgacgtccactcctggttttcacttcttgttgctctgcttcctcacaatgtcatcactcagctgacgtcattgtctacatacaatgggtacagcttagattccagtctcttagtcccaaaatccaggccttgcctgtagagttgtttctccaggactagcgagcggttttgatcaggcagcagaagcacagatgtgaaactcgtgcactgtgggtgggtgcggatgggcctcctgcctccgagatcgtcccttgagtgctgaccgctcggctgcttattcagaataagtccgcgtgactcagttctcacaagggactggtgctgccacatggtgtttccggtcatcttttctagagtttcttgatacatacactcaaaagcaaacactgccaagactctaactgacctgggtctttttattgctgtttggtgtaaaaagagtcagaaagctcaagagcggctcccagatcatagaaatgcagcacagtgtgtgttcaaatccccgacccagaagtccacacacacaaaaatttgaatattttgagcactaatgtgataccacagtggaaaattacacacttgccttatgtgatgggtcatagttaattcaggaatggccagggactcctgcctacagacccagctgttcaggatgcttaggcggaacgatcatttgagcctaatagttatcagcttgaactgcataaagaaacctgtctctattttcttgcttaaaaaatttttgtcatacttaacataaaaatgtttccagctctgtgtaaagagtaattgaataggataattgaatttttggtttcagcttgggtgatatcccaaggtatatcttatacatatgcagatgtgaatctgaatgacccctgaccctgtaaactgctggtccagagcaatcagggtaagggattctcagcctgtgcccgtatctgtaaggaagtgcagttggatcggtttgcttctactttctgaagcattaagctgaggttccagtctgtcaattctcatagactctgtcaattctgttagtgtgagccaacagtgactcccgtgccgcctttccaaggtggtaaacagcaggctagcacactagcatgctccacgctcgccaggccagagagcactcaggccttcccttgctgccccacccagtgccaaagcttaaatcagcacctgttactcctctcagttctgaccttgacctgccctcagcagaactggtgtcatctagggcacaaaggtcctgagtggcttctcagtactgtgcatctctctctgtccacatggtctctctgatcttacttggagccttgagtttgggtttttggggtttttttttaagatatatatatatatatatatatatatatatatatatatatacataagtacactgtagctgtcttcagacaccacagaagagggcatgatctgagatctcattacgggtgattgtgagctaccatgtggttgctgggatttgaactcaggacctccagaagagcagtcagtgctcttacctgctgagccgtctcaccagccctgttttatttcttagtagcctgactaaccttgaatagacactaattctcctgcctccgacttcccactgttgtaactggaggcatgggctgcccctttgggctctagtgctacttctctgagcactaactgcctccaggagggaatcgggagaagctgccagtctcctcacgactgacctggaaatgagtgcctcctacttccatgctaggcagggcacaggacagttcaactccacaggaagggcatggatcccacccatggtaggtgcgggacacagcatatgggagactgctctaagcagttagaagtgcttagaactatgacccttccataaatggtattaatgcggccggcatcctcctgtaatacccaggaaggaagagaagcgtggcctggcagtcctgtgagctatgtgcaaggtgctgcaccagctacagagttagctgtcttttacatacttgaggtgaactctgtgaggaggagacagtcaggttgggttttactacggtaagtcacttccctacactgccctgtacagactggctgaccgccagctctgtgcgcaagggacaggaagagggcagcaggaagcaggtgggtcacacgttctttgggaggttttccctgtgtagccctggctgtcctggaactccctctgtacactaagctggcctcaaattcagagatccccctgcctctgcctccggagtgatgggatcaaaggcgtgtgccagccctccccagctgggacaccacaaccatgcctctggcaatacccatcccctcccagctgtcccatcagactatagccaacttgaggcttctgggtgtggctgctagcagccttggaacctcccacatgctgtctggcctactagcctatctcacctggattcacagactgtcctcctctcctccaccctcccaccctccacccctactgcatgcctcaccttgataagtctgtcagaggcctcctggggcttagtgtgagtagagccatctgagaggcctggccatctgagaatacagaaatgtctcaaccttcgcctcagacttcttcaggtctggatacttaacctcttctggtcgctagccaatttgtctcaggatactgggatttgggccagaaaccagtaagcagcttctatgggaggtgctccctctgatgggcgagggtctcctccaccatcgcgtggcctaactgtactgcgctgtattgtggaccaccagccgtcaagcagccgggttcagtctccatggactcctgggggtggacattctcctgttcccggttcttgttcccagttcacttaacagacgtgtttaagtagcacgcagatgccaggcttggtcttagcaccaggaacacattcacaggaagtccttgtccctgtctggagggagacgagctgacacagagagtggggcgcatgcttcaagagctccctagatacctgtgtcgggtgtgatgggcagagactgcacggaggccccgaggagaagcgggctgcatggggaggcggtgctgaggaagtaggctcagagctggtgggagagacagtatggcgctcagagaggagcttccagccatgggggaggcaggggaggagtgctaggtatcgggctctaaaactgagtaagacatcaccttatgttgacgttggcaggcgaataggatcgaaggctggacagatgtaaacacaaccaggtagagcgcagtgcagactgcattgtctcaatctgctggttgaaacacaggtgttggcttcctggatacctgaaatttttcagaataaaatatagaagaaatctgagctgcacagactttctgccctcagggtatccgccgccaggatttgagggttttgtggactcggaaaacagctgagcagctagctgtccctccaaggtgccagagctgctggccccagctcctccccagctttctctccagtctaacgccgggtgccttgtgtgttgcaggtttatctatgagacagagcatcacaatggcatagcggagttactggagatcctgggaaggtaaggcgctgccccggcaatgagtagctgaagctagagtttgactttgctcatctcttctgacccctgccccagagcatagccttgtcagccaggtcctgaaagaatggatgtaaggagactgtaaggagaaggaaggaagggtgataaacttgcaccaaataacaacgcgcttccatttctgtggctccacaggcagagccctctcacacacctcagtctctgacctcagaaactatgcaatttcaatgtactttttctcaagtagtgttaaaagcagttagagaagaaggctgatattataagcatatttgaagaatatgtatttgaggggttgaataaatgctaatatttcaaattggttcattttgttggcctttcatatgtatagtataattcaatttctatcattttaatcagagtaaagtttttgcttattatcataaattaaaaaaacaaaaacaaaaagcctgtaaatataagataagattccctgactcactgtttccctaaagatttccttggagctcagaggtcacctggacagtgtcactccagtgcctctagggggtccatgtgcacttgaagctgagtgttctgagttgccctgaagtgaagttatcccatgtatacagaatgtggtggctccctccagcctctaaccctgtagtctgggtccctcccccacaccctcccacaccacacatgtgcgcgcgcgcacacacacacacacatatacacagaaactgtttagtctggcccctcccaagttgctgctttcgatgtgatttgaagagtgctggacctaggctggctctgtccctcgcagcatggctcccttagtatggctaagggcttgcctccgcagttccatgagcttgggcaagtcccttctgttaaacaggaggaaagctcgggtccctgctgctgttgccctctgccgtgtgtcaggatggtgtgagccgtgttaagtgtgactctaccacactgtctcttcagtcctgcctccagcactgggctcatccaggatcccacacagatgtccgccccacgcttggtcctagaggaccaggtcaccactgctctgacgctccctagctcgctcggagaaacaggttcactttgcctagtcaggaagccacgtgcagaagccagctcatgctcagtttgaggtccttccatggtgtgcctttcctacagaatgacatcacccggcctgcacaccgggaggggacgggactctggttcacgctaggataatgatctggaattgtgcccaagaatgtcgaagccttaaaggaaagtgctgggtgggaggacctggaactgggtgtcccgtcccccccagctgtttaacccactgcagctttaggggtgtccgtttaacccactgcagctttaggggtgtctgtctgcctccagaagctcctgcagcccagctccctctaggctgggacttgtggcccatagcagaaaagccaaaaatggccttgctcccaggctggagggccgtttgtggttgctcctgtcgctatcctctctattctgaagtaaacgttttgcccattggcttttcatgctgagaacaaaagctaaaagaaaacatgactcctgattatgatctggaatgtgtaaatactcaaactgaattctctcttcacagtataattaatggatttgccttaccactgaaggaggaacacaagattttcctgctgaaggtgttgctgcccttgcacaaagtgaagtccctgagtgtctaccatccccaggtaaggccagctgagcacagctgcccacctctgcagcggtccagccatgtctgagagtgcctccgttcccacagcactgtactgcatcgaaaacgggcttctggcagtatttcagagtctggggacagagagtccttgtaagaaaaaacggtgggagatggcttagttgtataatcgcttgccatcaagtgtgaggaccacggttgagaccccagaactcatttaaatggcagagagatgtggcagcccacctgtgctcccaacctcagacggtagaggcagaatcccaggagcaagctggctagccatctagcaatgtagctagctcctggttcaggtgagagacattacctcagtggtacaggctggaaagcatcaaggaaaaccccagtgtcagcttctcagctccacgggtattcatacatgtggacatttatgaccacacacatttatgcacacaaaaaagaaaattcagggcaatctctggaatgtagattgtacagaaacttggggagccagctttgaaaggaggcttctaacagtggtgatctaaacctactgccttagagacaaaagccgatggccacagccaatggcgtgctctgacaccttgtagagccaactgcaagtctcagggtgtagtcacgctgccaccttagtcagttgcagcctctgactcatttctgtctgcttgcattggatctgctctcccagagacagaacttagctatgctggggctcgaggaggtggccaccctcagttgcagcccacaatcccctgcacggctgggcacagaccagggagccattatgcattaagaacacatgggcagggagctggagagttggctcagcactgactgcatttgcagaggacccaggttcatttcccagcacccacaaggcctgctccagtgaagccctttctggttgtgcacaaagttacccacacacgtaaacaaaataacaaaatagtaacaaaatactttatttccacactcacacacacaaacacacacacacagagcacatgggggacgggggctggagccatggcttaccagttaggagcactgactgcttttcctaaggacccaggttcaattcccaacacccaaatagcagctcatagctgtctgcaactccaggatgtgacgccatcacggacttacatgcaggcaaagcaccagtgcacataaagtaaagattattttttaagaaagcgcatggaagggctgtgggcatcataggacaggcagtacttgcttgtcatgtgcaaggtctcagcttccatccccaacaaagatttgtatcgagacgtagagctcataactgtaatcccagcactcaggagtccgaggcagaaaatcatgagtttgaggcccgcgtgcactgtatgtaacaggacctcgtttaaaaattaaacaagagtccattctgacccgatgcactgtcctcctgttcgcacattttctgtctggcattgccaggtaacaggtctgcttgtcttgtatcatatccatcttgagcagtaataattcataaaggagcttggcgtgggggacatctaatctcagcgccctgagactgaggcaggaggctggcaggaactttgggctacatataaatgttatctcaaagggcaaataaagagagtgcagagatttctggtaggactctgcactacaactttccaggtattacattacttgtctattctcatcttctaaagacacacacacacacacacacacacacaactataaaatctgtcacaaagagatcggggaagaattatccagtgagcatccgtcccaaaggtatctccctgaaactgtcgctcagccacagcaggcagtttcgcaggggagggtggttgagggtcattctagaagggagcttccatgctgatgacatctgacactctctcccctccctttcagctggcgtactgtgtcgtgcagtttttagagaaggacagcaccctcactgaaccagtaagtgctcgatctggactgtgaccctcactgtgtccctgtatttcgccacattgcctctcagtcggccctgtcaccttcagtggcaacactgtcggaagctcgtcccactcctgggttggaggctcagctcagctgtggtggtctgatgacgagttccttcgccgcagtgaaggttatgtataataagcttgccaccttgtctcacactgtcccacagtccttggaacatggcccctgagcagctgtggccaccagcctggccccgttgagccctccacactgggcagcaagtgctctgactcgggcacagggttgcagcaagagtagaaatcccttgcactctagaggagagtggagatgctcctggaaggttaatctaagttagtgttgttttacaatcactgaacagcaaatggagactagactactgccttttggtttagatttctaatgtgtgtgtactgtgtgtgtgtgtgttttatctttattaaatttttaaaaattgctttgcacctccacacacacacacacacacacaaatcagtcactaaatataggcatggttggcaacgtcattcctgactaaggtgaggcagtgtaagcagctgaatccacttctaaaggagcctgggctgcagtccgtagcccatgcagctcatgcggtcctggcatacagttcacgccacactcagtggctcaggaggctgaggtggacaggtgactgtgagtgtgaggtctgcctgggaagaggaagagctggctagagcaacactggtgacaaagagcacttgttgccctttagaggttcccggcacccaggtggtgactcacagcgggcggtagctgcagctccagggcatcagacaccctctcccacctcggcaggcattcccatgcaagagcgcactggcatggtcacacaggtttctccccacacctcacaaagaaaagaaatcccacccgctcccaccaccccttttacattcagaagtcaagaaagagaggcgtgggagaaagctacactgagttttctccctcgggttttctttgtgtgtgcttttcctatgctgatgactgaagaactcaccgctcagcgcttgtgtgccttagtccgtgttcgctcgcctcaggcgggatcctcccacccgaagcatctctgccatctgggccctgtcccagcctgaccccgggcctgcttagcccggattgactctctttcctcatctgtgtgagcagagcatgaactcaggtgacacttgtaaaggtttctgccccactgatgcagtgtaatgacagataggcaggtcggtaaggggtgagcttaactgcgggagacaagacagaatgccgctgtcccgtaaacataggatgccagtcgcaggcagggctgtgcacaaacaagccagaagtcccacacacccagtgtggtgtgtccaccccgagctgttgtttgtagctcctgttgacagatgacatctgctgacagatgataatatgatatcactgtccagctgcagaaagcagagctgattttcaatatactcaaagcatttggactctcacctggtacatttcttcctttgaaatttacattttataaaaatgcaaaggccactgtgtctgacttagaagtaagcaattcgttttatgttttggttggttggttggtttggtttttgagacagggtttctctgtgtagacctagctgtcctggaactctctctgtagacaaggttgatctcaaactcagagatttctggtctctgcttcccaagtgctgggactaaaggtgtgcacctctgctgccagctctgaagacttaagatggaggtgtggactggaaaggagtatgtgtactccgcacacaggaacctcacatgccaccccagggctccaggttgccatgtggattgctttaaatacaagtcgtggcagttactgcaatcagattcccaccaataaaggacttatcaggaagactgagtccagcttgaggcttgagagggcagcagagctgacagctgcaggaccacgtagcttaggcgcttagacttcagacagatcaggaccgagggacgaaggactccagctgcctttctccgttcttaatcattgcttcatccaggactccacctcctgggctgatgccaccaacacagggcaggccttccctttagttaatcctctcagcagaggctcagaggatgaacccttgggtgtgtctcattaatgccttaggcgactcttaatccaatcaaactgacagtggaaattgcccatcactgtgttccgcttaaaaggctgccatctgtaaagagcatttgctgaccctgtaattgatatttttcacggactccaaagtttcctgggcacactaggcatagatactgttttctttgttgccaggctagaggctcatgggagattttacacaactgtgtctcctttcatccgcctgtctccctctgctaatgggatgacccacgtgtcttggcagtcacggctttgcccctaggtacaccaggacaggctcgccaggactcagggcagggtcactgatgtgtttcccctcttccccgttcagggagcatgcgctgagcctggagcctggcgctggtgttgtctggcattagcacacgcaggcatgcacacctttggcagagtcctgcccttctcacacgcagaccggaaaactgggtgctgctcacagtagctcaaagatcagaaagagtccagtgtgaacctggttcagaaactggctttcccatcaaggcagtccatattggctgtgcagcccctacatgactttaaaaacccactgaccgctggagggccagtgtgggtcaagagtaattcctgtcttccatattaaccatggttctgattcaaagtagatactcaagaaatgcctggttgacttaatagtcggagggaaatcattaagtggtagactttagaaatgtgttctcttaagactttaaagagtgtgtttgtgaaagtcttaccagccttgcctagcctagcaccccatatgtagactagacaggcctcaaactcacagagatctgcctaactcttcctcctaaggtctaggatcaaagacatacaacaccacgcccagctcaagatagttgtagatttttgttagattctaaaattaggaggacttgtaaaatgaaatttgaagttttataatagataggtaatagaaaaaaaaatgtccaggaacctaaatacccagagcaccaaagcagaattattgtatatgactatttctcagatacccgccctgccttcacctttgtaataactggaagtgacaagtgagtgacaaacagctctaaagggcagcacacactcctcaacagttttggtcccaaaatgggagcagagatgctagctctacaccctgtcaccactgtcatctgtggtggagagggaggtgctgccagcagcctgggactatatgcacgcacccacacacgcacagagtccattagtaatactgtgaaaaggcatttcaggatgagtcagtgacacaaagacagtaagtttcagccgggcatggtggcgcatgcctttaatttcagcacttgggaggcagaggtaggcggatttctgagttcggagccagcctggtctacaaagtgagttccaggactatacagagaaaaaaaaaaaaaaaaaagacagtaagtttctcaaactgagagaaatggacatttatgctttatagttaattgcgggtgttgagagagaaaagtcagtcacaacttcagttgctttaagagaaatacacctataaattcatgtgtttgaatgcttggctcatagggagtggcactgttaggaggtgtggccttattggaggaaatgtcactgtggagatgggctttgaagtgtcagatactcaggctaataaacctaacagggcagtctcctgctgcagccttggatcaggttgtagaactctaagctccttctccagcaccatgtctgcatgtgctgccgtgcttcttgcctctgagactgtaattccaccccaaggaaatgttctcctgtataggagttgcagtggtcatggtatctcttcatagcaataaaccctaagacaccaaccaaggcaagggttccaacttcccaggagaattgcacttgcctctctatacagtacacacacacacacacacacacacacgagagagagagagagagagagagagagagagagagagagagagagagagattgatttagattctgtcctaattacattgttcaaaggatataacttataacagtgtttaaagattgtaaaagtttaggtgggggaggtggcacatatttcaattccagcattcaggaagccaacagaggcaggcagatttcttgattttgaaaccagccagccaacctacatagtgagttccaggacagcaagggttacacagagaaaccctgtctcaagaaaccaaatattttgtataatatttttttttctttatcttgaatttctttctgtgggtcatcaaggtagctcagtggataaaggtttcgatgctaagactgacaacatgggttcagttcctggggcccatgcggtgaaaggagacacccagtctctgccagctccttctgacgccacacacataaacacacaggaaataagtaggtgtgatagaaaagaaaaaaaaaagaatttcctttacaagtgaaatcctaaggtaggctttatgaagttcattgtattaaagaagagtgctgatccctcaaatccagacctcaaacctccagacttcaagtaggcatagtctgttgttagcttccatgtttgaagtctttaggcaaaggagtgttctctatagacagccttggctttgtaagttctgttcaggtttcttaaatcttcaaccaatgggaaactcaagctaagtcccaaaacgagggtttcctttctcctgtctcttcacgtttcatctttccatctcgcctcacagacaaggcctcacactgcttcagagaaacaagtgactcctgtgcacaggtgcgtgcacaggtgtgtgtgcacaggtgtgtgagcaggcaggtgtgtgaacagatgtatgtttgcaggtgtgtgcacaggtgtgtgagcacaggtgtgtaagcaggggtgtgaacacaggtgtgtgagcaggggtgtgtaagcacaggtgtgtgagcaggggtgtgtaagcacaggtgtatgcacacatgtgcccttatgaagataggcctgctggtgctcattgcactttttagaaaataatggctaaactctaaaactgtagttcatctttgttgagccaagtcaagtatcttgtgcgggtgtagtttggtaagatattttgaaagcatagaggagcatcttcctaagttgcccagcaggcactccttgtagctttctgacttaggcaaagagagtaacgtgcagtagccacagagtagggaagcactgtgaatttataatctgactccctgggcctcagacaaggtagcactgcgctcagtggaagcttgggctgccatgtgcttcctcctgaccaagcactctccaggactcatccttgggctctgggtgatcacacagggggggcatcgggaaccccgctcaggtccaacaccttcagtgcatgcgggcttacatctgtgagattgacaacatgcttttgatgtgttttaacaaagttgtaaactgtgtgtgacaagcagtcagttaccttgagaggtgcagtatgcattcgtctgaaggttgctagcagtgtctacactggctgcttccactctagagcactccactgctcttccatcagaggggatggatcacattaaagtatataaaactagactgttttgttttggttttggctttttgtttgtttttcgagacagggtttctctgtgtagccctggctgtcctggagctcactctgtagaccaggctggccttgaactcagaaatccgcctgcctctgcctcccaagtgctgggattaaaggtgtgcgccaccactgcccagcaaaactagactgctaatgagagaaaaggcgtggggatgattctcaccgtttccgtctcacgtgtctcatgcttggcagtggggacgtcattttcctctagagcagcagttctcagccttcctgatgctgcagctgttttgcatagtccctgtggctgtggtgaccccaaaccttaaactttttcattgctacttcataactgtaactttgttactgctatgaattgtaatgtaagtatctgatatgcaggagatctgatgtgcgacccctgtgggggtcgtgacccacaggttgagaaccggtgccctagggtgtcttggcgtcctgtgagatcactttgtttgctgttactgttttgtaggtggtaatggcacttctcaaatactggccaaagactcacagtccaaaagaagtaatgttcttaaatgaattagaagaaattttagatgtaattgaaccatcagagtttgtgaagatcatggagcctcttttccgacagttagccaaatgtgtttccagccctcacttccaggtatgtgggtccgggtgccgggggtgggggccaggtgctcctgtcaaaatgactttctctacatgaagctgtttgtgctctggtcctgctgtgatcgactggtggaattcaaatttttttttatttaacatatacttcagaattagatgctaaaattttaaccagatggggtgactcattcctgtaatcctagtacttaggatgctaaggcaggaggattgctacaaattgagaccagcctgggctatagagagactcggtacccaaaaataaagtataatcttagttctgggtagttttacttctggcccctatgctgctcactgaaaccactcttctcagcctctgtgattgacagcattgtccctgcaaagctctgcattcaggtgatgtgctgttaggttcataggaccctaatttctcataattgagttatccaaatcaatgaatacctcaacaattaaaaacctttaactctgaaaatctctctcttcataaggtgcttcctttctgacatataaagttgtatctctttacatctttaaaaagttaagggctggagagatggctcagcagttaagagcactgactgctcttccagaggtcctgagttcaaatcccagcaaccacatggtggctcacaaccacccagaatgagatctgatgccctcttctggtgcatctgaagacagctacagtgtaactagttataataataaataactctttaaaaaaaaaaagttactatttctccctggcagtagagggcaatatgcctttaattccagcatttagaatatttctgaatattttttttaatttttattttttttactactaaaatccagtttggaaagctagtgtccattacccactttctactctcaagttctctgagctgccttggctgtgtctccttccagggacaccttctgctgtgtccagctgatgtgatggtcagcagaactttgtggccctggaagcgatgactgcttagccaccatgaaactagctgagcaacccaggactgcgtgaagagaccagcagtcccgggagactgctctcagtgtcgaggccctcccatgcaaagcctttccagagttatgaaggaagccatgggaccagcagacctaaaacaaggaagcctgacagctctgctggggacaaggctgggtttgcttctgctgagaaggaacccctggacaggcttcccactgcattcattatagccctgggaagcctgagctgttgttattttaaacatccatgggcaatttactagaaccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggattaacggattaacgggcttccaaacgctgactctgcacccttagcttagtgctgctcacacccctatcagagagcctgctttgtagagtggacagaggctaacacaaaaccatagatgacccaagtgcagagtaagtgactagagtgttggccttcacatccctgccctactgttttcctccaaggctcagggaagccccagaagagacagggttgtaggagccagaagtcgggggggggggggggcgggggcagctgtggagctgtgtattctggacacaacagttgtggctgctacacaagaccattctagccagtgttccaggatgggtgcatggctcacaaaggcctacttctaggtgaaaagttcgacactcaacagttgctggaagaagcctttggttgggttttttgggttgtttttttttttttttttttaagattgatttattattatatctaagtacactgtagctctcttcagatgcaccagaagagggcgtcagatctcattaaggatggttgtggttgctgagatttgaactcgggaccttcggaagaacagtcggtgcttttaaccactgagccgtctctccagccccggtttgggttttttgagatggggtttctctgtgtggtcttgactgtcctggaacttgctttgtagcccaaactgacctcgtgtcatgatcctcctgcctcagattcagagtgctaagattactggtgtgtgctactatgtgtcaaatttgataaaatttcatgtggaagaacaagcccaggtaggaaggacgcctgcaaggcattgaccgtgttttccggggaagcaaaggcgagtgagccaggcctgctctccccgcctgtgcacactgtgcctttccccatgagccaagggtagagtgtacagggacagccaaggtctccccagagaagcagaggcacctctgacagggattgtgactaaaggattctaaaccttggaaaccagcccagcacaggtcatccaccgccgagactcttcactctttcctgtaggggcctccccgataagtccagtccccattgactcggatcagttctaaaaccttccagaaatatgtggccagctctttcttaatatttagatgttttccctgtgccttttctgttttaaattttctcactccctggccatcttggtcgcttctcttctggaagttgtcctgcgcctaaggcaaggccatggtggctgcggaggagacagcatctgaggtgtcagtcacctctcaactccaagttgttgtgaaagtgcaaagggcccagcctagtggatcagcagataggcacctgctgccaatcctgacagtccacacacgcatgaaacaaactatgtatgttttagaaagataagtcaaaagtgtacatgggtactacgtgtgctggtgcaagctgactctgaaggcgagcagacaggacagagtgaagttgtttatcctcacgaggggcccaacgctgaagagatctgaatggaataccatgctacattggtcagaaccagcgcctgccagtacggcggcaggcagcacggctgaactggggcaagcatgcaggagtgctgagtgctcaggttgtcgccgagcgtgacattaatcagctgagagaacagttaatcccagaactgaggcagaaggatcacaaactctaggccaggctggctactgttctcaagaaaaacaaaactgtgttaaaaactaaaacactttgtaatttgagccttcagttcaagcaccctgtctcctgttttcttaccagggttgaaacaaccctcgtaatatccaaaaatatttatggatacctaaatgttctctctggactctgagttcaaggtctgcctgggcgacgttttgagttccaggccagctatggcagcacagtaagaccctggctcaaaacagaaaggagtgaaaaaagacgacatgacgtttgccgagcaagcctgggtggcctgacctcaggatgcagaacccgcgtgaggttgggaggagagaaccgaatcagttgacctttaacctctatgcacatcatagcacatgctcacatgcgtgcacacaggataaattaaaattcagggccagcacagtggctcagcgggtgaaggcactcgccaccaaacctgacagtgagttggatccctaggacccatagcgaaaggagagagccagctctcatgctgccctcgctcggggctgcgagggtttgccccaccacagcatagacacagaataaagagatctcctaaaaaattacaggtaaggaattggccaggcataattgcacatgcctgtagctcccatacttcgggggcagagacaggaagattatcaattgtacattgacttaaactacataggttttttaaaaaaaaaaaaaaaagcaaaaatgaaagcaaagaaagtcttgaactcttaagcaaaaattacctgtcattcatggtggtgctcacccttacttattcccagtgcgtggaaggctctggtgggtgagagactcggtgtgagcagtagtaaggcatcctaaaactgcgtgtgtgtgtgtgtgtgtgtgtgtgtgtgatgtgtgtgtgtgtgtgtgataggcatgggtggagacaagtgtatactgcaggatgtgtgtgtggaggagttggctgtcttcgaccgtgtgggtcccaggcatcaaactaaggtcattaggcttggtcacaagcacctgcacctcgagccatctccatagccctttttaaaaaagaaaaagcaaagacagatgtacgctgtatttctgtctgtgttcttttacccatttgcaaagcttacctctcctcactttctctgaagagctgctaatcctggctcctgaaccctccaccgccagctccttcctcacccactcactcaaggcttccggtggcagtcttgctcagctctgaagctctgcaggtggccactacgccacatgctggctgtgcttagggactactgtactgggacaggactgaccacgctcccttctgtatgtttgtgaactgacggttcttcaggccgtacctgtgtgtgcccattgactaaaggacaacagtcagggcagaggcgtgggcagctgcagatttggctgggggggggggggctgtgagtgcttttcctggcttttcacctttctgcattgggaacatgggactaatcgaaaggagtcctagctctacagttcacccaaagcaagggccggctcacaggccccaagatgtggctctgcgatcttggaaactcctgaccctcttgctgtccttgctctcagcatctctcacacggggtctgcctctgatacagcctccatgcttacagacaaccctcttgcccaaacatcatttgtcatttctagaaaatcagttatcgtctccgttttctacttccagccaagctccgcctgtgtccacactaagtggatggtgcgcacacaagaaacctccttcagatagggcaagcaggagtgagtggggagggacgccgctgcagagaggtggcccgtcagtgtgttcattgcacaaacctgaggacctgagtgagtgagtgtgcatcacctggccacacctgtaagccagcactcaggagtcagagacaggagagtccctgccagccagtcaagttccatgagaagccctgtcttgaaagctaagatgttaagccatttaggagcacgcgaagtgtcaacctctggcctcctcatgtgtgtgttcatttacacatgcatacaccactgcctggtgcatccatgcacacgcgcatctctttcaccgagtgtcagcatccagcctggggtctcacgaatgtttattgaataaatggagaagcgaatgccagcgtgtcctcttgatacctaagttctcattttgcctcttcattgactgctcttcagtgtcacaacctagactgttagaattgacggcattggtgataattgtgtgatccagtataacttgctgtattcacaggtctcgcagtgggagtgtttgccttgtacctctgtacgggtcaccaacacctgtgcacccctgtcttgcaggtggccgagcgggcgctctattactggaacaacgagtacatcatgagtttaatcagtgacaacgcagcgaagattctgcccatcatgtttccgtccttataccgcaactcaaagacccactggaacaagtaggaactggaggacgctagctcctggtcacctttaaatagtgcatgccttgctgtgactgcggttatgcctcagctttttagatgaacagccgtttctttgtgacttttgttgttttgtttggggtggtggtgtttggtttgatacgtagtttctctgtgtagccctggctgtcctggaactcactctgcagaccaggctggcctcgaactcagagatccgcctgcctctgcctcctcagtgctggggttacaggtgtgggactgccacacccagctcattatgagtttttcagttaagcctcagtgtggattgtccctgtgacctctgtggttgttttgtctcctcaaccccatttcacgccagcttagggcctgtgtctgagcaccttccaggccgctcgtggagcctcaaaggtcactgcagagttcatcggactcagtcctgcaggaacgcaatccttaggtggcccttcaagtcccatgacatatcagaggagtccatcactaaactcgatggccaccctactgtgggcactacctagagtgtgaaagagaagaacgggtgtcttaaatggcctgaggactgtcccccctcctttcatttcacttcagaggaaaaggaagtcagttcacccatggagagctctctgacaccctgcaaggaactccccatgggtgccagatgggttgaaagctgagcttgtactccgctttagccaaatgtggatgccattgcatccctctcctccgaggagcatccgaagcagtctctgtcactgcctcctgagtaacttactcagagttcttctcaggactccacgttttctattctgtcttcaggcaaagtggctttgcctgctgttagctaggaaggtggacttcctggcctgacaggtgcctagaagccctgactggagaaacaactgaatcagaactagcaacttgtattagagccaagtgagcttattgtggggaggtaggacctcagaagtaagggagacaggggctcaagaggagggagggaggtgtgacaggaggcagggaacgatgaagaggacccggtgtgggcgtctcactctggcatttgctctgcaggacaatacacggcttgatatacaacgccctgaaactcttcatggagatgaaccaaaaactcttcgatgactgcactcagcagttcaaagcagagaaactcaagtaagtggctcctcgcccagcttcctgagtattgcgcagcctctgtctgtcctgcagagttactctaactttgagcttgtaaaacaaccctgctctgctctggcttaggaaacccgtcaccaaaaggcatgtgtctgaagccagggtccttgcccttccactgcccaagtcgcctttatctttttcagaggctgtgtctcccctgaagctgtgctctgtccctaggctgggtgcatagtcatgtgattcattagttatgaaaggtcactctgggggctggcaagatggttcagtgggtacaagtctgatgacctgagctagatcctgtgtaaaaatggatgggaagaagagactccacagagctgtcctcaccctcctcagagctgttctctgccctcatgccatctcacagccagaaaataagaatacagtttatagccgggcgtggtggcgcacgcctttaatcccagcacttgggaggcagaggcaggcagatctatgagttcgaggccagcctggtctacagagtgagttccaggacagccagggccacacagagagaccctgtctcaaaaaccaaaaaaggaagaaaaaaaaaaacttacttaagtaagtcacttattagaccaggcatagcaacacaagtccataaccccaactccagaggctgaggcaggaggattgctacagattcaaagccaggcttgggtatatagtgagaccctatctatttaaagaaaaaggaaacaaagaaggaaaaaaccctactcttcctaacccagtgtgaaccattggcagattttatttttaactagccacttaaaagtggttatggtggacgaactataggatgtgtgtttagctaccaccatttccccaatttttagatgctctgttagttgtgactgcatgtcaagctctgttttggttcctggtaatacagcaatggttgtaacaaaagtccttggcataacagggcaggtggcgtaccctgggtaaagtacagaaggcgtgtcttcaatgcacagggtggcagagccacagggagccacgccagaccagggcacagcccccggagcagagttagtgtgatagaagtctctaagaagccacctctcccatggtgcctcctccactcctagagagtgatggtgtttcagaagttgcctgtggtagtacattttgagggtttaaaaaaaataataatgaatgaaaaaatcagtgcatctaatgatggaattagaagcaaccctggttccccttggaatactgtcacctcggggtaccagctctggcctccttggctcctctgcagacttgtctgcacagtgggtatagactgtagtaggcaggcagccaagctgggaacattggaccaacttggaggggatgggggagggagggctatgtttaaagtcttgttaaatttttaatttttaggtgtctttagtctcactcttggctagtttttaggtttcttttcacgttacacgtgttgagagccgtggtgtgagacgtgaggaggaccagagagcacaggaaaacgtgactgtggcacgggtgtccccctgctttcgccccctaacctgcctgcgtgcgactcttctctaatacaagtgatgttttcttgtttttcagagagaagctaaaaatgaaagagcgagaagaagcatgggttaaaatagaaaatctagccaaagcgaatccccaggtactaaaaaagagagtaactcgggagtgttgaggctttgcgtgaatgtctgagatagggcctggctccaccccaggaagggaggccaacgtcactaacactgtatgtgcaaatgtccgcaataaaacactttccaactttgtaacttcctcttgtataagtacttatttgccacacgtaacttttaccacagaatcgatttttttctcttctttttaaaagtaagatgtgatgtggtaaagagaacaccaggatgtaacctctaagattgtaatgtcctttcttgctcgaatgtcatagatgctgtcacttgaaccgtgttcctccgttttattctcatacatgagagggatgggggggaggcagatgaagaatgctgaaaactaactgaattctgccctgctcacactaactgttcctctaccctagccgatgcagtgtgctcccgcaaggcgaagccaggcagatggtcgtgtctgtcagagctgcaggtgactcagcagcctctgtccagggttggcttttaggctggcagagcctgggacagctttgcagccatagctcttttggtgttgcctccgctggtccgaatgatcagttattggggtgttgcctccgctggtccgaatgatcagttattggggtgttgcctctgctgctccgaatgatcaatgttatggggtggtttcttttctccttgtnnnnnnnnnnnnnnnnnnnnaatatcttactaaacagtgtatttctttttggttgagaagtgtgtattaagtgtgtacataaattattatgtaagttggatgtgggtttttttaatctttgtcatttaataaaaacaatatatgaagatatcagtgtgtattttcctatgagacagcattctagcctgcatccctttgaagaaaggatacttaatgacagtctgttgcggatctgcggttccacctaaaacaagtagctcacatttccctggcagcactttacatgctatagagaagttcttctaaggcttgtagcttaattacagagatctgcacgtatggacagggcttatgtggagagtgggcagaagcaccggcagttgttttaaaactcggcaaaagcctgtgtgggcagggttaggtgactcagccttgctggcattgcactggtggccttgctttgtttggaactttgtttgtttgtttgtttgtttgtttttaatctggccggtggagagccttggaaggcttgctttgcctagaaaatggaaatactctgttgaaaactgcacagagctcccacttacaaatgaagagcgttacggggtcagcactggggtcgccactgccttgcaacaaagctttctggtttatcccttttgatcgctcttacaacctgttgatgatggctgtggtgggtttggcattggagctttggtgaccttcattcccactgtcctcaccgccccccccccccatcactgtgtgaaccatctgtgacagtcaagagtctcgtccacatgccccatgacacgctgtctctaaaatggaaaatacttcatgtgataagacttcagagctggaaatacaccttagaactcattctcttgagagaaaaagccttctctagtttctacttagtacttggcattacatgactcagtgtggcggtagttatctgaggttttaaggggtctccagatcatgtcagccttggtgagagtgcgcatgcacttcactatccagaggaaggttaccagtgattcactgtgctcactagtgtctaaggagatgtgttcccagagcaagtctcatttttacagtccaagcaagtgtcttcatctgctcagagcgaatggaggaaggatcaggaagttggtagaaggcatgttttggcagttatagccactttcctgggtttccatgccacgtgatttgtgtggaaatctaaagcactggttatatccagcacgtatctgtttctcctaacccactaaactgactctagggcatctaactgcgtgcgtgcgtgcgtgtgtgcgtgcgtgtatgcacaggtttctctctgtctctgtccatctctatccatctctgtctctctctctctctctgtctcacacacacacacacacacacacacacacacacacacacacacacacacaccctgctgtcccctgggatattgtgtgagtgaaaaacaattctctgaggtacaggtgtacctgggctgtggtggggatgaagccccaggtccacacctcatgtggagacctgtacactcttgccctcctatgagctgctgcctgttgaaaggccgtgccagctggaagttcatctgccatgaggcagcacagcccgtgggcatggggtcctttccacttgtgtacagctgtgtggaaactctggctttatcccggagtcctaagatggcacatttgctttagaacaacacagcagaccttcattcctctctgtccctccccacgtgactttgaggacaaggtgctgtgtatcctgaagcaacagtggagatttctggccgaattggatttcggaaggaggtgtggctcatgtctgtagggagggtcagaaagaaatggcactgagatgaggcgaggaccagtgagagtacagagggaggcctgacccgacagctgtcactcagtttgcatttgaggcaatggcccaagacccaggtgggttagaaaataccagagagactcagggctggccctgcagtagctgtggtaacactggagagagggcagacactgtctgtctacctttatccctccacatgtatggaaggcgcagagtgacccaggcagacttgcagtttagaaagctcttcagttatgtcaacagcagcatggtgtgctggaaaggccaggcgcacggggagctgacccttgggacatgtgggaagaggctgccgagatagcaggtagtgccaggttacagccagtacccagcctggagggtaaggcgagcagaacacgtggttagtgaccaggaagcggcttgttaaagaactaagaacaggaaccagacgaggctgagcggaggagctgctggccaggaggggtaagtctaaacacaagactctgcttcccctccaggcttggggcttcctggcagcacctatatgacaagggaagaactgggcatgacccccaagctgtagcagacactctgtccctccctgacctcacacacaaagagggagcaggagctgtggctttgtccctctgctcacaaagcctgaagtcagtggttcaagcaggtggaaggctacctgccgttacaccctgcctgatgcacccagatcatagggaacagagagcacaacggagaggttagggaagctgagcacagggtcccaagacccagcaggcctgacaccagggcctcgttagagggatcctagcagtagaccaggctgccttaggtggccttaggctattgggctatgttgaaaggtttacggtcttaggaaaatactggggacatggaatgaagggaagaatttgtgggcagctaccccaaggtggatgtgaaggagggtgacagcttctgctatggacagtcccccttgagtgttttggcccagagatacaaagggctataagctggctatctagagatgaactcaagaggacgtagaagtgatcatggggccggctagcagagggtcagtcccacagtccagactgcaggagggtgagtccctttctagcagcctacaggcagcagcccacgggcttcatcagcgggcaagcaggcaagcgtgtctcccactacgtggctttttgtagaagagggactcagagaagttcagtgggccagcagcccatgcaggatgagggccctgagtgcagacccagctcctaacggacagtgactccatactttgcattgcagtatgcagtgtatagtcaagccagcgccgtgagcattccggtcgcaatggagacagatgggcctcagtttgaagatgtgcagatgctgaaaaagacagtgagcgacgaggctcgtcaggtaaaaggtgcattgagcacagcagggcaaagcccgctacagatgtgcttgacgggtccgtcacgttccgctgagccatcggattgctaggaaagttcttagcaattaagtgtgtgcccgaagtttgttgctttacttatcttagcaacagaaacccaactcctagctgttgtacgttagcttgagcaagagcaaagctttgcaatagcatctcacccttcactttccccttgcagccctctcgctcctgctgtgatccacagacgctttcccttagttcttcatagcaggtgctatgccccgcacctcccaggatacccaaggtgggaagtttggcttccttcagggcccaggggcccaatggcaggccagggctgtgccagcaacagttccaataacactgcactcagtgcaacggttgagagcatttttaaccagagatctctttctaccaaattgagaaaatacacaggaaggtttaaagacggtgatccgctgagctccttggtgtccctctgggcatgctccctgttccgagcacgtgtaagcaacgccctgaatggacctggagatgatggccattctgactcgtagcctttagccccctttgaccaatgccagagtccctagacattagtactcagattctaggatgtggacggggatcccttattgctgccttctgcccgtggcgtcctgtggagctcagttaaacacacagaaggattctctaatctatttgtttgaatcagataacccatcacctgactaaaacaggacggagcattaccaagagcgggcactctagccagctgagcctccccccagccacacctgcagaatgtctgcagaaccagaaccttctgaactgggctgtggtcccagtatagcacacagaagcactccaaggcctggaatgaagagaggctgcatctcttcgtaattgctgccgacagtgctctggacggccgtgtctcgtgtgtaaataacataagcagggatgatggtggctgtttcttttccccattgcagcatggttgtctgatttggagtcctagactgcctgtcagagtgcagagcaaggaaggcccagcccctgaacttgccatgttcatcctcaggccctccgtttaaatggaatgttgtttaaatggataaatgagtgcactagaagtgcaatggagaagctcagtggccacctactaacctactgacctactgacctactgacttactgtcagcaattagttgaactccacactttgctcctaatgtttttttctttgcaatgactcgagctcatctgggcgtggctactcaggcctgtaatcccagagctccagaagccgcagcaggagaattgtgagctgatggccattctgggccacacagtgagaccctcctggaaaaaagtaaggaagaaagaggcagccagtgggagagagggatagacaagaagggaaacccatgtgttttcctgtgttctaaccaggcagttttcctccacgatttctttgtgactttaacaggaattaaggtcatctttttttattcccccctcccccgcattccttgactgaggggaagcctcctacctgcgaatttgtgaccttttactcaattttaagacactcgggccatagaaaatttagaagttgaagacttgtgaggcatttaccacacactgagtatttgaaggttcaaaggaatttttcctttgctgcatccttcagctttggtcactactcgccataactttcgccctgtgctttacaaggtcagcaattggaacaagaacacaaaccaaagtcaccttacacctttaaaatgcttcaaaaagcaggctttggtgttggagggctctggagccaaggggcctcccagctgttgttcacccaccgtgggcgacaggtccctttctaagcagccttggcagggttgccatgagaggctcccatgacacatctgctctctgtctgtgtgactctcgagatgacatcagctggttaaagtttctgtaattgacattactaagttgtcagccgtgcaccttgagagctctgtggctggagcctgtatggaggcaggagatgcctggcactgggaagtcagttcttcccagagtaacttatccattagaatccagcaggctttttctcccttaaagtggcaagcctgggatatagctcagttgctagagtgcttgcctagtgtgcgggaagacctgactatcccagcccagcataagccctgcgtgctgatgccctcctgaagcctcagtgctgatttcaggtgaaggcaggaaaaccaagacgtcaaggtcatctctgcctatatagcaagttcagaggtcaccccgggctcaaaaaccaagcgattctgaagttctatggagtggagacagagcaggaggtcctaagtttaaaaccagctagactacctagtaacgattagcctgtttttgaaaaagaagaagaaactaaaatacctgtctgaaaagaaaagaagaagaagagggggaaacagaaatgagttgctgaggaaacacagaggacctagaataattgaaacatctgaaaaagataacactgctcagtgtccagtgcctgtgggttaaaccactgagccagtgcgcagctgagtctcactgtctagatggaggtgtttctgagctgtaggctcataggtaatgtctgaagtgataaactcctctttgcttgagaacatttggaattgggctcctgatattcttggttgtatgacagcagaacataccaagccccagatgcggtggcccaggcctgtggtcctggcattctggaagctgaggcaggattgtgcacgtgtaaggctagcccagtctacccagcaagaccccagctcgaaaagcaaataaagctatagctaaaaaactacggtctgggctttggcggcgtgaacactttctgtggccctcagacaggacaggacaggtcaggacagattgggaggtcctgctgggacctggggacaagagactaatgccaagaaaggatctgggttgatgcagcgggggaggggtagagagattcagtagcatatttgcccgttagaaccactgtttggattccgtttgtggaacttgtgtaaccctgtatggaataccctccccaccccacccccaaaaagtgtgtgagtcccctgtgactgacggtgataacagagccgtttgaaacgtttacacttttcatttttaacagttggtcgggagaaaagccatgacagccacgcaagtcaggaaggtgtagagacggactgggcagctcaggtactccttggagaatgcatagagtatgcttacggctttgtatctacaaagcgtgctggggtcccatggcgaacatgaagtattttccctcgtctccatgatatcacagcgtgtgatgggcaagacagctaaagtagtgttgatcggttcagcctccaattaagttctaaagtttgaactcagtgccttttcaagtgaaggaggcacgagccattgtgcaccagaccttgtcccctgtaggacctctggcactggctgtttgcaccagagcgcctaggctcctgtgtctcacacagcgctggctcagccagcgctcccctgctccctcgcccacccacccctgcccacatgctgccagcacagcctctccctaagtcttactcatcctagaccaccatctgcatgatgtctcactcgtcctgcctcctgtctccttcgttgctcctctgtgctttctcttctcgctgcctcctgcatctgtctgcatctcgctgcatctgtctgcagggctaagcagagaggcccctcatgtgtgtccagaatctcccatcagttcactttccacagtttgccttcactggtcgcagctccaaggacttgcctatagcccctcggttaaggggtcttctttctgacacggcggtgtcataggtcattatacattttgtgtgttttaaaacgttggtttgcaccatgacggacataaaaattcagggtagaattttacctgagtttctaatgggttcaagacaaagcactttgagggtgccagctgtggtggtgcacaccccaaatctcagcacttggtaggctgaggcaagggggtgacgaatgtgaaactaccatggccttcagtgaatgcactcttacaggtgtggtgagcagtggccgcccgtatggggactgtgaggtctgccatctcccactggtctaggcaggaaaatggaaaagcttgcctttgccacgttgactttccaggttccagtgacagctctggaaacagtcctggtgtggtacactaagcccactgctgctgttcatgattacaggcagacagacccacagaccaaaactctgaaacacaggcttccgtgtgtggctcggcaggtgcttgagtttccacaaagcatgcgtaaaccagacatctgcacacagagcagccgttcacacgggtttcttctgtgtcacatgatgggtttcgaaccatggggtttctctaggttacaccacaaaggtttactctgttggttggagacgctgagtggaaaggaaaaccattggggttaagcagtgtaggtctgaaagccccgctggccaccagtgaatgtctcgtggcgcattgcctgtggacagctaaggtgttttggtgtttccgagtgctggttctagcacggcagccttcctgagagatgagtgggtgctcagcccagacaccccttcctggccacattctttacagatgtagttagttaaatccccaggtgtgctgcctggtgttcataacccagcacctggggggctaaggccgaaggactgccatgagggcaaggccagcctgggctacataatgagatcctgtctcaaaacatgtacatatgtgcacatgagcgcacacagtctaaatcctgctaaagtgagattcctaaacttcagaaagagaatggaaaagaaaaggaatgttttatttcttagactcaatattagaaacttccaagtcaaataacttttctgagtacatttttttttccagctgtgtgacacatttaacacctggtattgcaaaaaaaaaaaaaaaaaaaaaaaacttttagaatttcttgtagacattttagctctcttacagttttaaatctagtttgtttctcattctgttttcccttttttaaaaaacagtgtcttctttctgaaatgtctaacagacatggggtcatgaagtgatattggtgatgtcttgtgagagagggaggtacttaggggagtctaacacctggagaattctgcaaacactagcattgtagaagcccacagctagccctgcccacgagctgtaccctggtcattacacagtgcttagggttgagtgaatgactaagaatggcctcctccttgtggccgctgaggctgtagcacatctgtgacccttgtttcccctgtgttttcctctaactgctaacccagaagtgcactccctcctcggttagcctagtgcatagccaactgcgttgcatttgtgattccaggcacagaaggagctgaagaaggatcgtcccctcgtgcgccgcaagtccgagctgcctcaggacccccacaccgagaaagccttggaagctcactgcagagccagtgagctgctctcccaggacgggcgctagcgtctggagcagcacgccgagctgggcctgtcggttctcttctggatgctgtagaaaagacatactgtgtgtgccataccagtcagttacactcaatgtcaaagcttcctctgaccccgttctgtaggcaataatgcacgtccgcctcagctcgagattaggagttcaaacaatggtggcttctctggccctgctggccaagcagggggctgggggagtcggtgacagtgtcatcaccatgttgtcaccaccccagcacagccctgagtgagatccaaagtcagagctgtaggaaagcaccctgactgtcaccttctcgtacccagtagaccctgtggtcctctgaaatagggattctgtggtaggtaacaccgatgctgtggcaaatcaaacgcacatggtaaaaggtgtctcctccctttacaaccctgacgctgtccccacgcttgctgtgccagccgcccgtggtggttggttaggtctctcagagatggctcctcgctttcccgttctagctgcctgccgggaaagaggccaacttttgcgctggggccgtccacagtgtttctttcctttggttaatggcacggtcaccatgtcctgcttaccttaatgtctaccgaaagccatatttcatagtctgtggtagaggccagggttccacctcagcgcaagggagggttctgagaagtgcttcctcagcccaccttgaggagaaccgccacgttggaatgacgtgttcatgttagttgcagaatcagtttttcacctacttacacatgatccttcaacaaggctctcgagtggataaagatcacaggatctaagaattccacattggtagaaagtgacagtaaactcagccccttggcctagtgcagcctgcagctgcctgtggcctgactgcgggccgcactgtgtgggcgccctcagtgagcctttctttctgttggaaaaagcacatgtcaccaagctcgcgaggaaaggcgcggtgcccgcgttcgcaccagtctccacatgctgctccggccttcacagaattcttgcatggattaagcttctgttttagatgggatagcacgaggagatacatccttaaacttagtgctttgtcttcttgtcctctcagggtggccagtattttgacttatttatcctgctcgaaagctgcttgaaatgtgtgctgctctctgaacagtggcgagtcttctcttgtctccagcatatatataactcagtgttacatgtcttgatgcataagataggttaaaaaaaaaagaagaagaagaaaaatggggcttcttttaaaacctgattttaatcgtggtctcagggatccgtgaaaaagttgtgaaatcagacattgctctctcgcggccttggaggcgggtcccacggggaagaagggcatgtgcagggagggagagccagcacggctagtcaaaaaggcggccccagctgagggtgaacaggttggccgcttgggtgagaacacttcctgagaaacttgacaagtacctatccactttaccattatgaaatctataattaaaaaaaaaaagttgagatgccttctccttttgagggaaaaagggtgcttttattgtataaagcagtgtctctgtgttttgatagcccactgtttgaactctcgtctttagctggtagagtctcagatatccctgacgtgtggggcattccgagtgtggtgagaggtcccaagaggctcctttgccctgcgtgaagagcatgctatcagtgtacgggtgattgtgcaaagctcagcgcgggggagcatcttctgctctaggttttatttctgctctttattgaagacaaacattcgccaataaagaaaagggaaaaaaatgttttgagagaaactaattttctttggcaaaagtattacttaaatttttggcctattaaggttcccctagttagtactcggattccccatgctaattgttcagcttgtatgttgttaagacactgttgattctgtaccagactggtttcaaaacaaaaaaagtaccacgttgaaaataaactggtgactgtttttcttcatatggctctagtttggcaccttcactctttccaaaacgtgtctgtgcgccagagatgtcacagttcaagtgtctttctagtgtggctttgtatggcttcctttgaacattgtacatacattgtatctttgttttatggtaataagtaataaaaaatgtagacttcgtattttgtacaaaatgtcctatgtacagaataaaaaaaagttcatagaaacagcaaaaataggttaagtggcacagttatttttctttagaaaatatctgtaactttatgctttagtgaaacgttaagtaccaacatattttttaacattttgtaattcaaaacttttttgttttgacattgtttatgaagaaagacttcatgcacttgccatttaatatgctcttttatctaattttaaagaactctttaaaatggtgtattatatggactaaataaagaacatgtgaattttatcgctctatgaaactaaatttagccatggcgttgggcagtctggttccgactcgctgttactgtcaggtcagggaccagccactccaggggcactggcttgaggtgggaagcaggtgtctgccctgtgtccccctaatgagcatcagctgtgcgttagctcctggtctaggtccttctcagaagccgatcctgaaagccaccatacgacctcaggcgtggagatacgcagttttgatctcagcactcggaaggcagaggcaggcagagctctgtgagttcgaggccagcctggtctacagagtgagctcccaggacagcagccagggctgcgcagagaaaccctgtctcggaaagagagaaaaggaaagggcagaagcagcttttggtgggcagcacttgctttccgacaaggcagtgtggacacaaatccagaggtgagaaactgaaccgagttctaccttgatggccaactaagagagcagggcagacaggcatgctgggaggagagctgagagccttgctggcccttcactctcctcacagcattgttctggaagcctgtggaaaagaaagtgagaggatcctcgctgtggctgtgcttggtccatgtttctgcagccagggtatcctctgggtcagtgaccctggccctatcacatgtctctgcatgtccggcccttctggtgcgagctgtgcagtggaggccttggagcttcctgagggccttggctctgaggctcgttggttacaagtgtttgaggaaaagacccctaccacaagcatctacctcactggttagaagacatcaggtctggggtagtgactaggagtactgcttcctcaggctgggtggaaactccctgagattcctcggcctcccctcttgaaactggagaaaatcagcacatttggtaacagcccacagcacagggattcttggccagaggtgggctgtgactgatagccaccagagccacacagaagctctgtgtctccatccctgagagctggagtcaccaagtcaggggtggtggccaagagtcctcgacaccaccttcaaagtccaggtgccacaaagatggtgagctgtggaagcgcccactaaatcgtgagctggtgtatgaacactccgggcagagggtagggtgggcaggacctctcagcgaactctcagtgaggcctcagcatccaggagaggtgtgggcacaggacggcatggaatcagcacctcagacgtctgtttttgtttttgtttttttttcaagacagggtttctctatgtagccctggctgtcctggaactaactctgtagaccaggctggcctcgaactcagaaatccgcctgcctctgcctcccgagtgctgggattaaaggcgtgcgccaccacactgggccagatgtccgttcttgcctctcacagtgcttcagggatattgttgctgtgtaaacttatgcaaagtcttggaaaaccaacacattagcccctgttctcattgactttgtgttgctaatactaacatgaaacataaaaatcaccagaaattccactcccagttaaatgtttgttagagatgattcgttgggagagaaatgggttccactaccagaaagctgaaattcacccttcagttaacattggcttctttgcaaggggggtgggggggtgttttgaggtttggcttaagaaggacgcattgtaaggagagagagaggttggcctacaccagggaagctacatacccttccctgcctcagcccactgtctccttcatggctttttgcaaacaacagcattatgtttttagggattttattgtggtttgattttgagacagggtcttgctnnnnnnnnnnnnnnnnnnnncttaggctgttctgaactcactacatagcccagactggcttcagacatgcagcagtcctcttgccttagccccccaggttagcacgttctctgaagaaccttgtgagtggtggtaagtgggaaactggaatttgttgggcattgtggcccgcacttggaactctggcatgtgggaggcaggggcaaggagggtcagaagttcaagaccagactgggctatgtgagactctgtctcaaaataaaagaaacttagaatacagctttttctctccctaatgtcttcctggtcatatccagttcaaggccaaatcagcctgtgttgtgcttgtgggaaacacaccaaatacaagctgggttgagctagagctttccaatgtgtaattttagaaactgatatctaacagaccagttattagatgggtcctgacccatcttttcaattctgtaatgaaagcaggtgggaacaaacttttctgctgctccttcagacaatgtgatgagggaaaaggaaaaaaacaatgtaaaggcacaaggaaccccaggagccaggctgaggaccaggggaccttccactcatacatcagtggttctcagccttcccaatgctgtgaccctttaatacagtgacccccaaccataaaattatttttgttgctacttcataactgtaattttgctactgttgtgtttttcaatggtcttaggcaacccctgtcattcaacccccagaggttgagaaccattgccacgctgtgagagcgaattcccagtcttgacatgactaagtcggcttcatctctctctccaggatgtatcttgtaggaagatgtagcccttaaactaatgataacttcagaggcatctggaagccagtaggaccagttctgagccccctgctcagatatgctgatataattaccttcaggagccctaatttccaaccttgtttgggagatttgagccaaagcttccactccaacaaggataattggactcccgttaaggcatgattggaatgagaacatttaaaagcctgtaaggtgactccactgagcactgcccagggaacattgccagagaagactgtccatcttctaagcaggaaataagactgagacccaagcctcctgaaaatcaaaatgttgataccacacagcccacaaagtcactccgaagccatgtgctgctgttgctgctgagctgaagcaaggactagcttgtacaataagtgttgggaggcgggggtggagaaagttagtcaaggatttactgtgtacccttggctggcctcgaacacaggtatctgcctgcttctgcctcccaagtgctgagattaaaagtgtgtgccaccacaccaggcaacaaacagtacatgttcttcctgacttcagcgccatcagatcccaggcgactccatggtgaatacatgtgctagagaactgtaagacaaaggcctactgtataagcccatcaccacagccccgctgctagaggaacacactggccaactgcagtgagcctgttctcacgagcaaccttatctgcaacccagagctgtggaagtctggcttaaaagactcataggttctggaagtccccatgcacccttaggcataagatactcctagaacgccttagcaagctgaggcaatcgaatattatctgtattagggtttagggcagcagctgaagagccatggtacaatcaacaggcagatgcccaggctgaggaaatgggcttggcttgggtgtcagctgccttctgctcacctctggccttcagcactggcaggagtgtgcggaggctcacctggaggactgtacccctgggaagctcatttgtgtcttcacggttagttacatatagtctggtcttagtatccatcccttccaggagcagagctgacactaaaccgccgccatcccaccaccaccacccagaccatattatcagcatggtatacccatcatggccctggtccccaaaagaacaaaaagcattcttaattaggcaggataaccatggcatagctgctacctttgagagctggagacaaaagccagtcccctttggggaaaagttaacctgtctcccagcagctcacaagaggaacagagtgcagggaggtctgtgaacttggtccacgagtgacagagtagtgcaccaccggtctcattggccgtatgcacactgtcttgacctgaagctcttctcactatacagccccaggcaaagaatccagagcctgtggtcagctttgcagcccatctgagaatgtggaaacctctagaaatgagactgaatggctactgaggagggctgaagggcacagccccagacagcgctgtcctagcccagaaggaaacaggcacctgaatgggcagaagtgcttgtgaacagggctgatgacctgacttcagtccctacctacatcctacactgtggctggagagaaaccaactcatgcaaattgccctgtgaccccaacatgcatgtgaaacacagaccacacacacatacacacacctatgctcatacagacaaaatcattaacctttacaaattttaaattacccattccagggctggagtggtggcttactgagtattggctgttcttccagaagacctgggtttgattcccagcacccacatggtggctcacagctatcaataactgcagttgtgatgctctcttccgacctccacagccaccaaaacacacacacacacacacacacacgaagggaaggagcaggcaaaatacccatacacataaaagtcgaatgttaaaatgatgcagttcatggtgttttactatggactgcgacagactggttgggggggggggggttgaggaactgttccacatgaagaatggactctcacctcagggaactgaacactaacattaaagaaactggcacagtgggtgaaactgaccccaagggctatgaacagagctgagctggttcccattgagaaggtggagggagtggctgagttaggatgtaggagcagctgatttgtgggctctgtggaattatactggggaaaaggcaactgttcgtgcatctgttttagaagttaaggtgaagccgggcgtggtggcgcacgcctttaatcccaacactcgggaggcagaggccagcctggtctacagagttccaggacagccagggctctacagagaaaccctgcctcgaaaaaacaaacaaaaaaaaaccaccaacaacaaaaaagttaaggtgacaaactccacacgcagacatagggccaagagcgtgtggccatgtagcagggtaacccaggtgctgctgcagcggcacagaggtcagcagcaagtgcctgaaaaccaagagtgaggacccaggcaacacgggaatgtgcgaagcagtgtggaggggaacaaggaaaggggatttcacatcttactagagatgcctgtgtgtttagcaggaaatggtctatgtggtagagatgcctgtgtgtctagcaggaaacggtctatgtagagtttgctaatgttaccagagaagtcagtgtcaaaacctgggccctaagcagccttaaaaagctaggcttgcccgctcattttcagtaggatagatagttaaagagacttgttgggaaaagcagacgagattaaattcaatgtggtcacattaggaagcaaacaaatgagctctgctgactcccgaaccgtcaagtctacctttggagtactaactggaaggcgagatttagagagaagacaagaggtatgtataaactaagcaatcctggttaactctagtcccacacatcattggcaaaactccagtgtggtctgtaaggtggtctcaagttgaaactgtgtaaagtctcttcctaagagacaagttcctcctctggctagcacctacttatcattaactgtcagcttggtacatctcagagtcacttgagaaacgagcgtacattgggcaactgtcattattggttgttctgtaaatccgtctgtgaagagttggcctgattgggaactgaaggttaaagggaccaccgcatggccaggtggctctgggttaaaagtgagttagttcgaggctggccttgtcctcagaacaagttctaggacctgtcctcacctccccccggaaaaaaaaaaaaaaagcctaaataaaaactttaaagcaagttagtgacccaccaagcaggtatcttctatggctttctcgctaggcttctgctctgatttcccttcatgaagggatacaagacttaaactcagaacatcagtacaattcttacaagggttggccttgagcggggacatggggagctggtccactgaaatagaagggaagcttttaaaaaatatatgatttattattatttctgagtataccgtagctgtcttcagacacaccagaagaatgcatcagatcccattacagatggttgtgagccaccacgtggttgctgggaattaaactcaggacttctggaaaagcagtcactgttcttaaccactgagccatctctccagcctgcagaagggagtttgtttgttttgctgttgtctttaaagatggtgggagatttgagctttctgagcaacttagttaaaagatgaggtcatgaattacaaatgaaagcaatggcattctctcccagtttcaggagtatggaagatcccagccctcccaacaacagtataccacccccctaggaaagaggtttttctttaaatggtgagtgacaagggcctcatcttccatgggatgccacctgccacaggtgacagcctggagtctacagaaagtagctgcatttctgtttcctgtgacaggctccctctacaccatgagaaggcatcaaacgggatacactgcattaaactacactgctctgcagaactatggctggaggaagcaccactggcttaggcgatggtactccaccgcttcccagctggctggctgcacgtagctggagggcaaggagctggctgaaagtagacacccataacagaaattctacctccacctacatgccaaaagagacataggcatgccgtgtaggtgtgaggaatattcccgaggaggatgcaaagccagcagaggcaggtaagcaggggctcccactggcagtgtcgccatcctatgcagatctcagggccacaagtcaatgcttctggaaggacaggaaagtaaccccagtagcaggtgaggaagggtgggtcacttcagtttactgttggtggcttgcagatttgtaggacccttaaaaatgcaactgaaagttttaaaaggtaagtgttgaaaacattttgagacagtcttaccaaaaatcctactacccagccccctgaatgctggcattagaaacacgttccaccctgcagggtgtcatgtattttgactctgcaattctgcttcaaaaatttagccatcagcaaaattcacctagtctgagcagtaaggccagctactcccggccgcactgttttccatgctgaaaaacagaaaccaggaattatcctcacctgcctgaagtgttgctagatgcaaatgtgagcagagaagtgagaaaaccccagcacacgctctcactccttaagattttatttttttaaatgtgtttgtttctgtatgtggatttgtacatatgagtgcaagtgcccacggaagcaagagggtgttcggtcccctggggctagggttataaatagtctgtccctaacgtgggactctaaactcggattgtccggaagaactgtacatggacctaactgctgagcggtctccataaaatatggccaaattgaaactagaaaggttctggcactcattccaaattcgaattcatcctcaccccaggactaacttttcctgccggcccaacaccttcttctcaaacattccacactgcagccaagagggagcttgcaaaaacatccctccaaccagtcaccccaggatagcccgtgagccctctacaagcaatgtccctattaccctacttatcgctgtaccttcagtctggcaccgtgtgggacactcaaaactgcgtctgatggacgcaatgtacagataaatgtgggatcagcgagaacagcaagatccaagtggagaggcaatcaaatgtgggtacgtgtgtgtaaggtggacgtgctgacatacgccttccatgccagcactggaaaggtggaggcaggagcatcagagttgggactcagcacggctacccggcatccaaaccaaagagcaagcggatggcagcaggtaccccgtaggaatgagacaaagcgcatgcagaaaacggagaagagttcaaagtcaacaggatatcagctcagcacagctgcaccagaacacggcagcaggacaagggcggccccgggaaggtctctgccatctcggcagggcggagatctccgcaaggcgcagcctccacggcgcacgtgactggatgagtcaccgcggccaggaagccgcacgaaacctcggttcggcagctcgaacgcaggctgacttaggacaaggcagcgacgtctagaggaagccgcagagggggccgcgtcccttggcgggaggggagtgagggccgcggacggcccggaccccaagcttagacgcttggcccacggcacacaggacagggagaccgaccacctttacctagacgctggcgcagggaaatgacgcagcgcatcgaccaatcgggaactgcctgactctgaatctcgcgatgttcacgggaggaaaatgagccaatcgcaatgccccttcttccaggccgcggtgattggcttgaggactcacatgatcgttcgaggccgcacgtgaccgctcccctggcgacacgtgatcgacctgccactctgcagaagtggcttctggatagcagcaaacaggcgtccgtggaactgaacggcaggtcctgggttacagcccccgtcactttccacttgatgggcggggttggtgaccagggtcccatgtgacccccgtcatggaaccccgagacgcgaccgtagcgtggataggacagggccaacctgtcccctgtagcagctctgagaactgaagtaggtgggaggctggggatgccgagagattaacgaaagaaaccagtaagcagggtcaggaaactcgtcccacctaagtggcgtgtaccggacacgtggtaacgtaaagaggtagaggtgcttgctatgtaaataactatggaggaccagaactcacatagatgaggacgactttgagcaccccgtctttcccactaccactcactgggtgcctctttctttccttctttctctaatttactcataagacagggtctcgccttggctagccttattgtctgtctgtctgtctgtctataaaacagagtctcttcttggctgacctggaactcactgtgtagaccctaaactcaagagatgtccctgcctctgccctaagaataaaggcgtgcacttcctggcttgacttctgtctccctctctcctttctttgtagtaaactgcctgtctccgactctgtccctgagtcttactgttctagggctcaaaaatctggaaatttgtgctgattccctccagggtcatagccatgcctgttccaaggaagccctagcgatgtctgtttcccactgcttcctgcccaagatactggtaaccctggaaggtagccctggtgtgggggtgctgtcagaagcatggacacaattctctctctccatgatgttagaatttcctgaataataaattggcagtctgcatcccttgtattgatgtaatttgttgagtagttttgttctcactctcttaataaataataactcttgggtcacacattacacctcacaatgcaatgtaaattacagaatggctattcaaggttagagttcacagaggccttcctggaggcagaggcagatagctgctacaatatttgctggtttggtttgcttggttttgttcgtttgattttccaagatagggtttctgtgtagctttggctgtcctggaattcattctagaccaggctagcctcaaatccacagagacctacctgcctctgcctcccaagtgttggggttaagggactataccaccaccatctggcacaaatacag

SEQ ID NO: 134 - DNA, 3940 bp, Mus musculus
taaactaaaatggaggctggtttcttgccttaaggagtacagcgcccttcccgctggagcctagatgttgacatgtaataaagcgggcagcgggatggtggtggatgcggccagctccaacgggcctttccagcccgtggcccttctccacattcgagatgttcctcctgcggatcaagagaagctttttatccagaagctacgccagtgttgtgtcctctttgactttgtctctgacccactgagtgacctgaagtggaaggaagtaaagcgcgctgcgctgagcgagatggtggagtatatcacccacaaccggaacgtgatcacggagcccatttaccccgaggccgtccacatgcttgtttatgaatttttcttaagatttttagagtctccagatttccaacccaatatagcaaagaaatatattgatcagaagtttgtattgcagcttctagagctgtttgacagcgaggatcctcgggagagagattttctaaaaaccaccctgcacagaatctatgggaagttcttaggcctgcgtgcttacatcaggaaacagatcaataatatattttataggtttatctatgagacagagcatcacaatggcatagcggagttactggagatcctgggaagtataattaatggatttgccttaccactgaaggaggaacacaagattttcctgctgaaggtgttgctgcccttgcacaaagtgaagtccctgagtgtctaccatccccagctggcgtactgtgtcgtgcagtttttagagaaggacagcaccctcactgaaccagtggtaatggcacttctcaaatactggccaaagactcacagtccaaaagaagtaatgttcttaaatgaattagaagaaattttagatgtaattgaaccatcagagtttgtgaagatcatggagcctcttttccgacagttagccaaatgtgtttccagccctcacttccaggtggccgagcgggcgctctattactggaacaacgagtacatcatgagtttaatcagtgacaacgcagcgaagattctgcccatcatgtttccgtccttataccgcaactcaaagacccactggaacaagacaatacacggcttgatatacaacgccctgaaactcttcatggagatgaaccaaaaactcttcgatgactgcactcagcagttcaaagcagagaaactcaaagagaagctaaaaatgaaagagcgagaagaagcatgggttaaaatagaaaatctagccaaagcgaatccccaggcacagaaggagctgaagaaggatcgtcccctcgtgcgccgcaagtccgagctgcctcaggacccccacaccgagaaagccttggaagctcactgcagagccagtgagctgctctcccaggacgggcgctagcgtctggagcagcacgccgagctgggcctgtcggttctcttctggatgctgtagaaaagacatactgtgtgtgccataccagtcagttacactcaatgtcaaagcttcctctgaccccgttctgtaggcaataatgcacgtccgcctcagctcgagattaggagttcaaacaatggtggcttctctggccctgctggccaagcagggggctgggggagtcggtgacagtgtcatcaccatgttgtcaccaccccagcacagccctgagtgagatccaaagtcagagctgtaggaaagcaccctgactgtcaccttctcgtacccagtagaccctgtggtcctctgaaatagggattctgtggtaggtaacaccgatgctgtggcaaatcaaacgcacatggtaaaaggtgtctcctccctttacaaccctgacgctgtccccacgcttgctgtgccagccgcccgtggtggttggttaggtctctcagagatggctcctcgctttcccgttctagctgcctgccgggaaagaggccaacttttgcgctggggccgtccacagtgtttctttcctttggttaatggcacggtcaccatgtcctgcttaccttaatgtctaccgaaagccatatttcatagtctgtggtagaggccagggttccacctcagcgcaagggagggttctgagaagtgcttcctcagcccaccttgaggagaaccgccacgttggaatgacgtgttcatgttagttgcagaatcagtttttcacctacttacacatgatccttcaacaaggctctcgagtggataaagatcacaggatctaagaattccacattggtagaaagtgacagtaaactcagccccttggcctagtgcagcctgcagctgcctgtggcctgactgcgggccgcactgtgtgggcgccctcagtgagcctttctttctgttggaaaaagcacatgtcaccaagctcgcgaggaaaggcgcggtgcccgcgttcgcaccagtctccacatgctgctccggccttcacagaattcttgcatggattaagcttctgttttagatgggatagcacgaggagatacatccttaaacttagtgctttgtcttcttgtcctctcagggtggccagtattttgacttatttatcctgctcgaaagctgcttgaaatgtgtgctgctctctgaacagtggcgagtcttctcttgtctccagcatatatataactcagtgttacatgtcttgatgcataagataggttaaaaaaaaaagaagaagaagaaaaatggggcttcttttaaaacctgattttaatcgtggtctcagggatccgtgaaaaagttgtgaaatcagacattgctctctcgcggccttggaggcgggtcccacggggaagaagggcatgtgcagggagggagagccagcacggctagtcaaaaaggcggccccagctgagggtgaacaggttggccgcttgggtgagaacacttcctgagaaacttgacaagtacctatccactttaccattatgaaatctataattaaaaaaaaaaagttgagatgccttctccttttgagggaaaaagggtgcttttattgtataaagcagtgtctctgtgttttgatagcccactgtttgaactctcgtctttagctggtagagtctcagatatccctgacgtgtggggcattccgagtgtggtgagaggtcccaagaggctcctttgccctgcgtgaagagcatgctatcagtgtacgggtgattgtgcaaagctcagcgcgggggagcatcttctgctctaggttttatttctgctctttattgaagacaaacattcgccaataaagaaaagggaaaaaaatgttttgagagaaactaattttctttggcaaaagtattacttaaatttttggcctattaaggttcccctagttagtactcggattccccatgctaattgttcagcttgtatgttgttaagacactgttgattctgtaccagactggtttcaaaacaaaaaaagtaccacgttgaaaataaactggtgactgtttttcttcatatggctctagtttggcaccttcactctttccaaaacgtgtctgtgcgccagagatgtcacagttcaagtgtctttctagtgtggctttgtatggcttcctttgaacattgtacatacattgtatctttgttttatggtaataagtaataaaaaatgtagacttcgtattttgtacaaaatgtcctatgtacagaataaaaaaaagttcatagaaacagcaaaaataggttaagtggcacagttatttttctttagaaaatatctgtaactttatgctttagtgaaacgttaagtaccaacatattttttaacattttgtaattcaaaacttttttgttttgacattgtttatgaagaaagacttcatgcacttgccatttaatatgctcttttatctaattttaaagaactctttaaaatggtgtattatatggactaaataaagaacatgtgaattt

SEQ ID NO: 135 - protein, 448 aa, Mus musculus
MLTCNKAGSGMVVDAASSNGPFQPVALLHIRDVPPADQEKLFIQKLRQCCVLFDFVSDPLSDLKWKEVKRAALSEMVEYITHNRNVITEPIYPEAVHMLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQAQKELKKDRPLVRRKSELPQDPHTEKALEAHCRASELLSQDGR

SEQ ID NO: 136 - DNA, 186391 bp, Homo sapiens
  misc_feature (1)...(186391): n = A,T,C or G
ccaatataatgagggttgtacataaacagccaacaactaacatcatacttaatggtgaaagactgaaagtttttcctctaggattagaaatgaggtaaagatgcttattttgccactgttattcaacatagcactggaagtcctacacagaacaattaaacaagaaaaagaaatcaaggcatccaaattggaaaggaagaagtaaaattgtttccacttgcagatgataagattacacacacacacacacacacacacacacacacagacacacacacaaacacataaaacaaatcctgttagaactaatcaatgagttcagcaaagttgcaggataccaaatcaacccacaaaatcagttgtgtttcttacactaaaaatgaagaatccaaaagggaaattaagaaaacaattccatttacaacagcataaaaagaataaaattatcaggaataaacttaaccaaggaggcaaaagacttgtacactggaaactacaaaatgttgctgaaaaaaattaaagacaactaaatggaaatacatcctgtgttcatgagtttggaaggcttaatagttaaggtgttcatgctacccaatgtgacctatatatttaatgcaattcataccaaaattctaatggcagtttttgcagaggaaaactccaccttaaaattcatatggaatctaaagggatgctgaatagccacaacagtcttggaaaagaagaccaaagttggaggactcacacttcctgatttcaaaacatactacagacatcaaaacagtgtggtactgggataaagacagatatatagaccaatgtaatagaatagagagcacagaaacaaaatgtcaaatgatttttgaaaaaggtgccaagaccaatcaatggggaaaggacagtctcttcaacaaatggtgctgtgaaaattggatatgcaatgcaaaagaatgaagttggacccttaccctataccatacacaaaaatcaactcaaaatgaaccaaagacctaaatatgggagctaaaactgtaaaactcttagaagaaaacataggggaaaagcctcatgacattggatttggcaatgatttcttggatttgacaccaaaagcacaggtaacaaaagtaaaaatagataaattggactacatcaaaatttaaaattcctgtaaatcaaaggatataattaacagactgaaaggcaacctacagaataggagagaaaatatttgtagatcatatatctgataaggaattaatatccagaatatataaagaattactacaatacaacaacaacagcaggaagaaaaaacaaataacccaatttaaaaataggcaaaggacttgaatagacattcctccaaagaggatatacaagtggccaaaaagcatatgaaaagatgctcaacatcactaatcattatggaaatacaaatcaaaaccataatgagatatcatctcacacctattaggatggctactactgaaaaaacaaaacataacaagtgttggtgaggatgtggagaaaggggaaccttgtatatggttggtagcaatataaaatggtgcaggctctatagaaaataatatggaggctcctcaaaaaattaaaaatagaattaccatatgattgaagaattccacttctgggtatgatacggtttggctctgtgtctctacccaaatctcatgtaaaactgtaatccccacatgttggaggagggacctggtgggaggtgattgactcatggggttgtatttcccccttgttgttcttgtgatagtgagttctcacgagatctggttgtttaaaagtgtgtagcacctcccccttctctctctctctcctgccaccatgtgaagacgtgcttgcttccccttcacccttctgccatgattgtaagttttgtgaggtgcccccaccccccatagccatgccttctgtacagcctgcagaactgtgagtcaattaaatctattttctttataaattacccagtctcaggcagttctttatagtagtgtgagaataaactaatccagggttatatacccaaaagaattgaaagcagggtctcaaagacatatttgcacacccatgttaatagtatggaattagaccactacttctcctgctgaccttctcatcttttccacaccccccatccccgtttccctagtttataagacaggagaaaaaggagaaagcaaaaagttggaaagaaacagaagtaagataaatagctagatgaccttggcgctaccacctggccctggtggttaaaataataataataatattaacccctgaccaaaactacttgtgttagctgtaaattccagacattgtatgagaaagtactgtaaaacttttggttctgttagctgatgcatgtagcccccagtcacattgcccacgcttgcttgacctatcacgaccctttcacatgtaccccttagagttgtaagcccttaaaaaggccaggaatttctttttccaggagctcggctcttaagatgtaagtctgccaatgctcccagccaaataaacctcttccttctttaatctggtgtctgaggagttttgcctgtggcttgccctgctacaatagcagcattgttcacaatagccaagaggtggaagcatccaaagtgtccacctacagatgaatgaataaacaatacaatacatgaatattcatacaatggaatatcagccttaaaaaggaaggaaattctgacacatgctacaacatggatgaaccttgaggatattatgctaagtgaaataagccaatcgcaaaaggacaaatactgcataattccacatttgaggcacctggagtagtcagtcattgagacagaaagtagaatggtggttgccaggggctggagaggggcaatgaggagcggttcggttggaacagatatgagtttgggaagatgaaagttctgtaggtggatggtgatgatgtttgcacaacaatgtgaatgtatttaacatcttagaactgtacacttaaaaaggttaagatagtaaattttatgctgtatgtattttgtcataattttacaaaattaaaggcagtctcattagttctctgttataacttggatgccagttcatgcagaaaggcaatctcttcaggtctcgcaggatggagtagtgacctggaagagaatcctgctcactggagcagggcgctgctctcttttgaagatgcagtggaggttgtctctttctccacacaaagggcaggaaagacgacaatggcagggtgtggggggagaggcagtgaagtgcattcagcaaactgtggagttccatccagatcaagaaattctccttacatgaagtctgtggtacagttctggctttcatgcccactgtcttctgtgatgctcttggtaaccagcagagagggcagggcaggttgtgtcatatctgcttttcgtgagtttagacaggggttctccacctcagcactattatcttttgggccagaggattctgttgtgtgtggctgtcctgtgcattgttggatgtatagtggcatccctggcttctacccactagatgccagtagccctccctacccacccagttgtgacaaccaaaaatgtctccagacatcaccaatgacccctggggggcagaatcacccgtttcagaaccattaggttaaaagttttgagactcacacagagtctgcacaaacccaagtcttctaattccagatctcccattccaccatgacaccaagttattctccacctaaggcccccttgacagccactcctcacccttctcctccctagagcaggacatcaagggatgcctcgctgggctcgctgggcttcctggccctctggctcaagtgggtcagcaaaatgggagccactggtgagagagaggaggggagaagcaagagggtggggtgtgtcttcacctgtcctggcccccctccctgcacaccgatggggactatgacaatgagttggctacaccaggctctggcatgacctctgcctccccctgcccagtgaggcctgggaacaaggacagctcccacagccacagcccctgcctgcttcccactgcctcgtccctggtgtgacccttgcatgcctctgtgcatggacctttcattcatttatttccaattaaacacttctgactggctcatctgttccagcctgttaaaaccaatcaccccaaacttaggacaagaactaaaagtcagcacttgaacacgctgcagctgattatccacaccctcccttccagcaagctctctgctgctctattgaatacgtctcccctctctgaaagcccctaatcctgctcgctaatgctcttacggtgtgcttctcccaccaccttgggttaagttatttctgtcccatcttatctcctccactggacttagggatttgggaggaaaaaagaaagggattgtatttcactccatttatatgaaaatgaattattttgtgttgttttccatttttcttcaatacttggatacaaaattttattaagatatttttagaattattttgaactttcacagtttttagaataatctatgaaattttcagttttggaaactttcacagatttctttctaccttttggatctcattgggaaagtactccaggcactcgtggcattactctcagctgttggggactaactggctcacggcatttttcagagctctacaggggccaaacaagatgcccggcttagtctaataagctctctgggtgcccttgggcctgaaaatactaacttttgggtattttcttggactcctcagaaccgaatggcacctcacttcaaatcatggtccacttgttaaacttactgagtgcttgatacgtgcctagagtgtgatccgcactcttaatatatggataattaattcaaatgtaatctgacttaacatactctctactccaactctgcaggcaaatttgtagtggaaggagtctggtgcatgaataaatagatacaaattcagtacaaaatgcgtgtttcatgacattttcatggaaaggaagtgaggaaagttgggaggagtagatgtgatgaacatctagttttcggggaggcctcagggatgcctgaaaggaagtcactacccaatccaggtagccctgggccaggagaggtgaggaggaggggctgagcacctgggggagctagtgacacagacagaggagggcccataagcacaccacaaagctggagaaagacagcagttaaagaaaggcggcataaagtcagaaacaagtctgagatgcaacagtgtctcgctctgttacccaggctggagttcagcggcatgatcacggctcactgcagcctccatctgcagtgatggctcaagcaatcctcctgcctcagcttcctgagtggctgggaccacagacgcgtgccaccacgcccaggctgctcttgaacttctgggctcaagcaatcctcccgccttggcctcccaaagtgctgggattataggcgtgagccaccacacccagctagaattagtttcttcaaatgctaggcactgagtaacacagaatgcctaagacatgatcactgcccctaggaagctcagctgaatatccaagtatgcaagactgcctggatgcccagaaggcctaggaatgacatgaagaaacctaagcccacaagccggggtctgtgagagccaagagagaaggctttctgggcagggtgaccaaagctgcagcctggcaggcagggcagctctacaccagcctcagaggagcaggcagggcctactgtgctgcaggcatcttcacagagaagacgcaggaagggcttctgagggcagacgcagggaagggtgcggggctgattctcagtcaagggccatcttctctctgccctgctcatatgtgccactgatggtatccagagtgaagcagtgaacagtgtagggctgcggctggtggctgcagtgaggtcaaagacctcagtcctctgggaacctctctgatcctccagagacctcaggggcacaaataaagcaatccaacatacagagaagacagacatggaaaaagtatgtttgggtttttagagactgtattagtccattcttgcatcactatatacaaatacctgagattgggtaatttataaagaaaagaggtttaattggctcatggttctgcaggctgtacaggaagcctggtgttagcatctgctcagcttctggtgaagcctcagggagttttcgttcatggtggaaggcgaagggggagcaggcacttcacatggtgaaagcaggctcaaggtggggggaggtgccacatacttttaaataactaaatttcatgtgaactccaagcgagagctcacttatcaccaaggggatggcccaagccattcatgaggcatcttcctccgtgattcaaacacttcccagcaggcccacctcccatcggtgattacatttcaacatggatttgggtggggataaatatcctaactatatcagggaccatctcaaaaaagtgtcccagaggagcaggggttggaagaaaaggagttttgtgtgatgcgagcagtgccttcatgaacatggaatgtggggccatcctggaagaggtaaccctcagccacacacacacacacacacccacataatggctttatatcctatctcaatagcttgtcctgaatcccttcttttgggagcaggagctatatctatctttagcgttcctgtaaataccacagcacctaagacactgcatgaaacccagtgtgttctacgggtagtcggtaactaactgtccttaaagatggtcctccctaatgtgggcaaatgaagccagtccaatggccagtgacgtacacatgcagttgtacaggtaatggtgttgagtcagatttctctggttgctatggtttcaaggtcactggatgttaatcaggcagctttgcttgtaccctgtccctatgctttccctaaaactctaaactgacctgagaaacctctaacctgacatgcaactagtcctctatgctatatttccagttgccatcttggacacctctacctacattttgcggacacagcaacgtgtcccaaactggaatcttgttcccttgcaaacctgccctccacttgcatcccttcctcatcattcactgtgttgcccaaactacaagcatgagcattcgctttttatcctcgattctggctctctgtcgcgtcggcgatccttccccccgttgctgtggagatgcctccctggcacgcacctgaaccatagctggatgctgattgctctttctgcctcctgcttttacttccaccctcacctcctccacactcctgccaccgatgtcttctaaaatgcaaatgtgagtacatcactccccacttcagtatctgtcagtgaccctgaaatgcattcaaaaagaagtacaatatcttggcaaggtctaccagtcttaattcagcgtcgctgttccttcagtctcatctccggccataacaaaacgtcctgtgcagtgctctgtcatgcttccaagcctgacccccctcaccccagtcctgtagacttgtcacatgtcatgtccttctgattgctggttttttctatttccatgcaagcatgtgaactgcttgaggacaagggtagtgccttgttcaccatgaaatttctggcatcatgctttgcacatagtagttatccaacaaatgtgggtcgaatgaatgaattgtatgcaacaccggatcaggagatatgatacaaggatttgggtggcaaaggattgtctcagagatgcctctaagcctccctaagagttcatggccataaaccaatagtttcagagctactcctttttgatatggatatatcctggacttattaaattgacagcacatattttatttttaaaatgttattaagttaactaggggcatcgctctatcctcaaaattgttttggagacaccattaacccacttaaattattaataaaaaagccacttattccgcacaaatagttgagactgtcctgcttacctacagatattcgtctaagagccggcagacattcagatacccgcagacagaacttactttctggacctcccacaacattcctccctttagatcttttttttcttaccccgtctttcagctttctcattgcagaactgctgagaataatggaaaatgctttgcctggaaacttccaagaacaaaactccgggggctaagagaacgcgatgatttttaagctgccagttaagatgcagctccttcatcatcacaggtgaagcaccaatgcctctcgcacgtgaaatccgtacgctcctagagtcttactacctaatgcatttctgcaatctgggacgcctgtccttagcgtcttcaatagttttgggcacgaggtggaccgcggaagtattgtattgaaaagttaacgtttttcccttggacaccctctcctcacagctattaacaagctgagagaaatcaggtgactcccagtcatgcagaggtttcctcaccatttatgatcaagccaaattaaagaataaaaataaaatcctattggcgcagcggccaccaagtctttgaggcctcgcctcggtgggcggggccgacgccggaggagaggggctgcgcatgtgggcgtgacctcgcggaaggagctgcggagggcggggccgactggagaggggcggggctgtcgggtgggtgggacctcgcggcaaaagctgcggagggcgggaccaaccaggaaaggacgggactgtcgggtaggcgggaccttgcgggagaaactgcggagggcgggaccaaccagggaggggcgggctgtcggatgggcgggacctcgcgggaggagctgcggaaagctgagctggtgaggggaggggctggtcgaggggaggggctggtcgaggggaggggctggccgagggaaggggccggccgaggggaggggccggtcgaggggaggggccggtcaaggggagggcccggccaaggggaggggccggtcgaggggaggggccggtcgaggagaggggttggtcgaggggaagggctggccgaggggaggggctggccgagggaagaagaggggaggggacgggctggtcgaggggaggggaggggagggcaggggacgggctggtcgagagaaggggagggcaggggacggggtggtcgaggggaggggacggaggggaggggagtagagggagaggagggaaggggaggggagggaagggaggggaggcggggccagcggtgtcccgcgaaactgccgctcgctcggttcccgggcctccccgtgcgcctcagtgcaaagcgtgccaggcactcttactgcaacgagagccgcggcggtgagggggcaaggccaagaggccacggttcgcgtttcgccggctgcagaagttgttgccatacatttcaaatgtgcatttcctacgtctcacgctctgtcttgcgcctccacagcgggccacggccctgtcaccgcagtcgcagccacatgctccctcccctgagtcggctcagctctgctcagcggtcagccccgcgccaggaggccgcggcctgcctgaggccggctcgcagcgactcgggacggagggcgggggcgtgaacgggtcgcgcggagagggtggggggagcggggagcgttagggtacgtgggggcgcgtcgaccaatggcagggcgctgttgagtgcagcggggcggggccgggcgcgggggtggggcgagcggcgggcggggcggggcggccggccggggggtgggaggagaggggcggggcgggccggccgggggaggggcggagagacgccgccgctgccgccgccgccgccgccgccgccgccgtggctgccgcagcctctgggagtctggaaaaggggaagcgagagcaagcgaaagactcagtccccgggcggcggcggcggcggcggccgcgggggcgcgacggccggggcgggggcgctgctgctgcgggggcaggcggcggcaggggcggcggcggcggcggcggcccgctccagccatgccgaataaaaacaagaaggagaaagtgagtccgggcccggccgcgggacggagggagcagggagggactgccgggggagggcgcgacggcaccggggtcctgcgcccgggccccggctcagttccccgcctgacgccgcgggcttcgcgtccccgagggcggccgagccaggcatccccgggcttctctcggcctcatgcccggtgggggcggggagcccggggatcgcgccggagccgcggggcgcaggcccgggccgctgggaccttcgtgatgggccggggctgggcgtggagggagggcgcggcccggggagggggtcggaggggcgcccgtttccgacagcgcgccgtgggcttgggcgggcaggtgcggccgccgagggggttcgcagcctcgcaggctcccggaaaggagcttcagggatgggggctgtagacgcctggggagggacccctgtacgggggaaagggagcgagaagggaccccgctgagagctggtaaggaattctctgccgccccggagggacgctctggggctctcgaacactattattatcctgggtggcggcggcggtgagggctgcgagcaagggtgctgcgtttgcattcgggggggcgggtatgtttctgcttcaggtggagctctgtagcgtttcattatcaccccagaaatcctcactcatagggtttagggtgggagggtagaaagggatgtgatgtggatctcaaaatgccagaagcactgtataaaattggatttatctgttttctgcttgaagttttcaacctcaaatgcagataaaacgaaaagaatctgaatgggggttggggggcattgcactgttggaatcctaaacggtatgatatagaatttcctaatggtatgaattaaaaatatcagaagctgtagttgtataaatcacttttaaaactgcatttggcttatctgatgtttacctgtctaaaaagtgagaagactaattgactttgcttgatgtttaccaggaatcaccaaaagcagggaagagtggaaaaagttcaaaagaaggacaagacacagtagaatcagaggtaactgtcatcaaatattgactttgtattttatacacagcttttaacttcaggtagaaaaaccgagagtgataaagcctagaatcttctaaaatgtttccctatgtgaggttttttttttgtggtgtcttttataaccctcaattttagttgtttaggtatttactgttttgctttggaaaactattaatgattttatgaaaattgtgcttgcctatggggtttgtttgtgggtcttttggggttttttttgttttttatttttttgagacggggtctcactttgtcacgcaggctggagtgcagtggcgcaatctctgctcactgctaccccttgccgcccaggctcaagtgatcctcttacctcagcctcccaagtagctgggaccacaggaacatgccaccacacccaacaaatttttttttttttttaatagagtctcactctgtcacccaggctggagtgcagtggcgcgatcttggctcactgcaacctctgcctcccgagttcaagcaattctcctgcctcagcctcctgagtagctgggattacaggcacccgctaccacgcccggctaatttttgtatttttattagagacggggtttcaccaggttggtcaggccggtcttgaactcctgtcctcgtgacccgcccaccttggcctcctaaggtgctgggattacaggcctgagccaccgtgcccatcctggatctggtatttttaagttcatttcccacacctcaaacccagcaaccctcctgtatagattggtcttatgcagtctatggtgttgctatgttgcttttagctttagggtcatctccccaccgccacttccattgcaagctgccaggcaactcagtggttagttctttttcttccatcaccttgttttccttcaaaccacctctgctactgacgtcctgggctagctccctatttctgttgacggtcccttggcctctttctccaataatgttggtatttgaaaaaatttacctagttttggtattttattattgttcacattgtgtgtgtgtgtgtgtgtgtgtgtgggcgcgcgcacttgcgcgtcggccacttgtaaatttctttgcttcttggctttggcctcattgaggaacagctggaatgccaagtgagcattgcatctacttgaccaaggttgatgctgttccttcacaccgtgaagtgccttcagaggatttgcagagtcaccactttcctttgccttttcttccttgtgactaattgttgaactagagcacctagggccaagggtccaggagctgcgtggacccaggcagagccagtaggtccttttgaatccatgggtagcacataattgggttaatagagtgtcagttatccagaactggatcattgaagccccagtcttatcacaaatgacgtttatttgccagtgtcagacttcttcctgtaagccaaattagaatgagttcagttctgtctgggaaacacagttaactggcgatgatctgcagtggacttttttttagccctgcattctctcttttctatcatttggtgtattctgaacctccctcctcttcagcaggtggtttattccagcaaatctgttgccctccccaaagcaaaaagcagaaatccaaaagattccttaaatgtcaatagttaggatcatttgtgccagtctgtccctccctgtctttatagcagacaactgaggtttactgtgccatgctgggatttgacttgtttctttcttccctgtcacccttttgactaaattcatttcgatgaagatgaaatgtaggtgctttatgaaggtatatgctatatgccttttttttttttttttttggtcttttgatctttcattaaaactgctaagatttcttctccccagagctttcttgctaatgtgcctatatcctcttactttagctatattccttatacaaaggagcatcagtgtgtatatatcatttatttctatttttagtgggaagatcctggctgtaaggatgaataatgttaagtttaaacctgaaaaatctcagtagttcaaagataccaaaatcactactatgtgaaatgtgtgttttgaaagcagtttgccagccgtgtgagacctgcggtgtggcctgcagtgcctgagtatgatgccccacttgtctttttgtattttttctagtgctactgtctaagagctggagctacagagcttgaaattaccactgaaaacactgaaatgttgggcccttcactgcttcctcataaggataccagaggcaacctggcatattaagcttgacacttggcagatcactgtgtaaattgtttttcaggaatacaagttgggacacttctgttcatttgacctttgagttgacccttaaattttattattgttttttttcccctcagtcttcagctcactgcttcacttctagttccacccacttaccaaatatgattgactcatgcaggtgaattaaaccattattgcacactttttccctctcctctctctcagtattactcttaacttgaatattttaacctgaacaatttaaataggcttgacattcccatgctgctttcaagcctttttttttttttttttgagacagagtttcactcttgttccctggctggagtgcaatggcacagtctcggctcactgcaacctccacctcccgggttcaagtgatcctcttgcctcagcctcccaagtagctgggattacaggctcctgccaccatgcccagctaattttttttttttttttttttttttgtatttttagtagagacggagttttaccttgttggccaggctagtctcgaactcgtgacctcaggtgatccgtctgcctcagcatcccaaagtgctgggattacaggcgttagccaccatgcagcccctttcaagccttttaacatcatgtcaccttcacaatgagcagttgctcccattacccagtgaactcaccttctgatgggacagttaccctagttggggcttctcagccttgagagatgtgcagagcagggacctgtccagggcagagcagccagacagcgtggaaataatccaaacagagaaagcattcaagaacttggcctctggttgacttaacacactacttcaagtatatggcaggtctgtataataaactcctgcctgtctagtcttcagcctcatagaaagcaagaaagcaggtggcgtatgttgcagaacaattcttgggtagaacaaggggacatttgatggtttgggtttttcagtaagaaagatgaagtcctggagtatagggtagagtggtacagtggaaaatatttcagcttgggggttagaaaataaacatgccgattcttgctttgccataaatgatgtcacctaacttgtgtgaccctgttttctcatccctaaaatgatttgataagtttaagattaggctatttttaaatgtatggaagaaattgggtgttacccttcttgaaagacattttccctgcaagtatggcaggctgtatctttcagtgtaacaaagttctattaaaggtcataactgctgccctgtaacttttgccttattctagaaacttctactccttgaatgacatgtgttggtacatgtttcttctctttcagatagaatggttaattttgacttgttgcttctgcacacgtgtcctggaaataaaagtttcttcccactacttattgctgatttatttcataggaagtcttaaggaaagaggcaaaaaacgggctcatgggtcacttgaagttggaaaattctgtggagattgacaaaggagactcacttttgagcatctgttctcagtgtaaccttcaaatctgtggaaacataactaggcacattttatgattatttagaatgttaataaattgctctgagtttcctcaagtccattttgtaagatcagaccataggtgggtgttgtttcttttaagtgtgtgtactgtgtccaatgttacatttttagaagtgttcatgctttttgtaaagtgattcgttttaagcacattaaaggtcgtttgagtattgtcatgtattttacacctgcttcagcttagttttgtttgaaagtctctacagcaactcttacataatatctgttgctgaagagaaagaacaatcctctctccaactcgttagctagctttgccaccttctacctttagtaaattttttcctgttataatctgtccctttacattccagtgccaccactccctgatggtctagacctagggagactgacagtcgcctcaggtcgcataggtgctaggcggaagggtaatttttttagaaattaaaattgaaattttaaaaatatttaataatacacccattaaatgttaacaacattgttatgaaaaatatctttgcaagaaatactccttttcacagtctctgtagcaagagtttttacctgagtaaggaggaggacaaggacagtcattttgttcggcacaactcctccaaggagagcccctgacacccctgtaggctcacttctgagcttggggctttcgctagaacctcccatgccttagcttccatcagtctcttcccacctttttttccatacaaccctaagctgaacttgagtgaaagagaagaccaagagaagtaatactttaaaaatctttttgaaattcatatgtaatgattatggagtaaatggaatcatttgcttttaattgccacgtcttggctccctcttcccagcgcctccccatggtctttccttagagcccaggggcatcagaaagaggttctgcggggaggatccatccctggcagccgcagcctcagctcccgagctttggggttgttaggaggcagatgtcctgagcttgctgcccttgaggcttgagggagtggtgggttcttccttaggcagctcccttctctagcccccattcctgtcctacatcacaagctgcaaggtcggtagaccccaggtacctcctttgtgacctccactgctctagaccaagggttcccatctgaacacttgactgtggggcaagatattttgttgtggggctgcccagtggtcctctactttgtaggacattcaccagcatccctggccttacccctggatgccagtggcccactgcccccaccaactgtgacaaccaaaatgcatccagacattgtctggacattgtctaatgtctcctggaggatcaaatcgccccctgttgagccactgcactataaagacacctttccaaaatatgtacatttgcttacaaaccatgcctggcacatattcatctgagcattatatttcctttagaacagcagtgagtgctcacacagaagggagatcactcctttatactcttcacaattatcaagcaccccaaagagcttttatttagtgagttatatctatctaccgatatttttccttagaaattaaagctgaacgtttttaaatagttcatctaataataacagtaacacccattacatgttgacataaaaaacatttatgtggaaagaatttttttttttaatttgctgagaaaagtggcatggctctgtttttgctaatctgtttaacgtccggctccatcgaaggtagctgtctgcccctgcacgcaagctgttctgatttcgtatgtgtagcctgtgaaaaactccccataatgacgctttaaagggcaaatcacatcttcatgttatcataaaaaccgttttgaccttgtggacccctgaaagggtcaagggacacaccccagaccacactttgagaacccctcttttagaatgctctacccccattctctgctggccatctgaatcctttcatctttttttttttttttttgagacggagtcttgctctgtcacccaggctggagtgcagtggcgcaatctccgctcactgccagctccgcctcccggattcacaccattctcctgcctcagcctcccgagtagctgggactacaggcgcccgccaccacgcccggctcattttttgtatttttagtagagacagggtttcactgtgttagccaggatggtctcggtctcctgacctcatgatccacctgcctcggcctcccaaagtgctgggattacaggcgtgagccactgtgcccagcccctttcatctttttagctccaactcaagctcatctatccagaaacttcagcgaagctgtttctcaccatcttggactgtgtgtcttccatattttaaatgcttatagcaattacttactagaccagcggctggctgtatgcagttctgtgtcatgtacactgtgttagatgaccttcgttcccctgtgacttgccttcctagctagatgcagtccttgaaggcatcagttgagctcgagtcttctttgatcttgccatatatattagggcctagagtcaagaagtattgagttggtgggttttaaaagtactgaaaaggagaccttgaagtcagttaggttgctgatttttctgatactgtaaattagcaacaacaataaaaaacttgtttattaagaggcttatttatcacttttttgatccaataagggaactctaatgtagaatttttattcagtgtaattcattttaaataaataacagtatactaaagcagaagattatggtacttaggtttttttctaatgtcttgggaaaattttaaaaagtagagtattttggtttttttcttagttttcttttacatattcagtggaaaaaagtgtagtctcataagatcttggttaaaaggtcagtggtaaaaagtatagcctcataagatcttattttaattaaagcacttcaaaataagatttccatttaaatacagttatgcatcacttaatgagggggtacgttctgagagctgtgttgttaggcaatgttgttgttttgtaaacatgatggcatgtgcttaacacaaacctaggtggtagtctgctacacacctagggcatatggaatagcctgtcactccaggctacacacctgtacagcatgtcatttaactgaaccctgtaggcacctgtaacacaatggcaagaatttgtatatctaaacatagaaaagataccataaaaatatggtgttacaatctaaggcaccaccatcatttgtgcagtctgttgttatctgaaatgtcattatgtggcagtgactgtaaaggtttctctgtgatcttttatgctttgtgtttcttaatttattttgggaatgtttctcagtagagcatagctacatatatatttaatatgttttataagatagggtttgttttgagcatgtcttgttctgtgcgagcactgtgttgaggattgaggagataaagacctgttaggaactgaagtagtggctgtttccatcatttttgaagtgtagcacctgttgcttctggacatccagtgtacttgggagtaacttggcccccactcagttagatcttattgtccttgagtggatgggacaagatggaacccatttcatgtaaagagccacctggagctttgggtgagaaaatcagatgctttaaagcgtctagggagacacgggcttaccataaaattatggagttccagaaagcacattggaccctagggtgtgtatcatggttaaagccaatagataagatcagcattcctctccctcttcagtaaaagcttcgctacggtatatgcaattctagaaagagctcatcaagcaaatgatatgaaatctaaaattttccagttcaagaaagaagctcaaagttcctacattaaagcaacagcagggtgaatggcaacttatagccctgccatgtgatggtggaaaggtttccacctgcatccttagcggagctgagtgagtcagtctgccaccaacatgaaatgcggtgatgttttcctaaatcacagggaagattcatctggaatatttcaattcgaagatgggtctccagtgtttccttaaacactgggtacctgccaaagggcagggcacagcggtgtctggtttagcacagtgtcctctctaatcacctcacacgttcctatcagtatgttgttttaagcagagactctccagtgctcctgcagtgaaggaagtgctgcttcccaaatccaaacagcgttgtcatcttcatgttctccacctgggggagtgagagaacaagcctagaaattaagctctccagaaggggaaaaaaatgctttattaagggcatttggctttttcttcatctcgtgtgtgtgtgtgtgtgtgtgtgtgtgtgtgtgtgtgtgtgtgtgtatttttttgagacagagtctcaccctgtcgcccaggctggagtgcagtggtgcgatcttggctcaccacaacctccgcctcctgggttcaagctattctcctgcctcagcctcccaagtagctgggattacaggtgtgtgccaccacactatcttgtatatatttccttaatataagattgagcagctgggcacggtggctcatgcctgtaatcccagcactttgggaggcccaggcgggtggatcatgaggtcaggagtcaagaccagcctggccaagatggtgaaaccctatctctactaaaactacaaaaattagctgggcttggtggcaggcatctgtaatcccagctactcgggaggctgaggcataagaattgcttgaaaacctgggcggcagaggttgcagtgagctgagatcacaccactgcactccagcctgggtgacagagtgagactccatctcaacaacaacacaaaaatggcccccaagagattaatttcagataccctgcagcctgcaggtgttagctctgaccaagggctggcatggcccggtggtaatatcaaattactaaggggctctgaaggggttagacctgccctggccaagatgtttgttgtttgctgcatatggctattttaaatttaaatttaaattaatgaaaattaaaattatgtaaataattcagtccctcagttgcacgggccacatttcaagtgctcagtagccacatgtggccagcagctactctgttgaccagcagatgtggaacatttgcagcttcacagaaagttctgctggacagagctacttcagaccctaccagtattttccaaaataattcttatgggagtgtatttaatttaattgaacttattttgttacctatcaatcttcttaatatgaaatatcaaatttaaggttaaatttaaaggaagagaagacttatattggcaaaagagaaggaagtagataaaattaaggaaagaggagggcaagaagaagagggaatgcatggtgagacgagagggaggccctgtctactgcttggtctgtggttggcctacacctgatacccacacgagaaagactccattgcccataggagcgggacttggacagacccaagagcagtcacgaccttttgtcctcctagtctttctttatagacattttctcttatttatttatttattttgggttcaaaacacaaaatttattttgggttaaaaaataaagtaatgcggctgggtgcagtggctcacgcctgtaatcctggcactttgggaggccgagtcgggtggatcacctaagatcaggagttcgagaccagcctggccaaaatggtgaaaccgcatctctattaaaaattttttttaaaagccgagtgtggtggcatgcacctgcagtcccagctattcaggaggctgaggcaggagaatccctgaaacccaggaggcagaggttgcagtgagccaagattgcgccactgcactccagcctgggtgacagaatgcaactccgcctcaaaaaataaataagtaaaaaataaagtaatacggaaatcaaggttctcccttcaccttcctcccattctcagacctgcttcacagagcacagccactttgtcctgctgattatgaatggggccactgtccagaacacggaagctgtgcaatgtggcagaggctgggctctggagtcaggtcccccttctgtcccctggagggatcataccctctctcggtatcatgttcctgtttatcttggccgatttctctgacattgcggcttccctccaggggattccttcattctcagtcatccagcaggttcattctgagacctggcatgtgctgagcaccattgcgggtgcagagttcctgcactcgtggagtttgcctccagtgagggcacagaagtggagtgtggagctgcaggtgttttctgcggggcactagtgacattgggcgtgagagcgtctcacctttgcagagcaatggccctggggatctcaataccatgatgacaaccaaaaccactcacatagctccacacaccactggtggacaggaccctctggcagcccctctgctggagattgggaggctgcttcaggtggtcaaggatggtctcaccaagcagatgacatgaaaagtgaaatgtgaatgtcaagaaggaggccacagtgcaaagatctagggcaagatattcattcagccagaggcagcagctagtgcaaaggccccatggaggaagtgagtttgccgtgtccactgccaggtgttcagttgactaaggaaaagtgagggtaggcagagcaggagggatggaggtagggagccgagcacagacaaggtagggtaagatcttataaacagcctgcctagacagggttttgggattttggcagggagggggagttgttttggggttttgtttttagagacagggtctcactctgttgcccaggctggagtgcagtggtgcagtcctagctcactgcagccttgaactactgggctcaagcaatcctccctcctcagcctcccaagtggctgagatacaggtgcacaccaccatgctcagctgatatttggatttttttgtagagaaggggtctcactgtgtcagccaggctagtctgaaactcctggcctcaagcgatcctcctacctcggccttccgaagtgctgggattacagacatgaaccactgagtctggttgggctttgagtttttattctgagggtcatgggaagccactggggtgttttgagtagggaagtaagaggatcttcctagctgctatgtgggaacgaggggcaagagctgaacaaggagaccaactggaagactttgcttctcagatgaagggtttctttgttcacacaggcaaagatgaggcactggcacagctggctgtgggtgggcttgtcatctgaccacttgctttagaggccttggctgggagctggctcttgtgacttttggcccctagagactaaactgcagagaatttgctttgaggtgccagctcctacattagcagccttagtttttcctagacagactggtttctttggagaatccctttttcttgtcataaccactcagtttaccaatgttctgcagagaaggtgtgtggggataaggtggctatggagagatcagtattcagacctaacatcaatctccttttcagctgcatatctcactcctattctctgctatacccagtctctgagtgcgtggcctcggggggattctgtagggacagagcacctgctttctccctccagccccacgctgctttgtggttgccagatggaagttgcatctgttgaatattgctatgctgagatgcaccagtgactgcctccgcaaatctttttattactggaggtcgtaacttgcctcttccttcactctcacttgtaaggcaggctcaggaggtttgctgattgtgagtgcatcatcgaccttgatcagggaaatctgtcctgttttcctttatttcttcctctcatccagaaattgttgtcctggcacgagaatcagtaaacctttttctgtaaagggccagatagtaaatattcaaggcttcagggggcgcgtggtctctactgcaactacttaactctgctgttgcagcaagagagaagccacagacaacaggtggataaacagacgtgagtgtatgccagtaaaacttgatttacaaaaataaccaggaggccagatgtggttcatgggctgtggcttcccagccgcggcctactggaatccaaatcgggttcagcacttggagaagctgctagtattggtccctgggcctgtatctgaaaccagtactagccatggtctgtggaagaggtatcttttttgtttgactctattcaccatctaagagatactgagagatcagtgattcggccctgcccaactgaacaataaatatcttatatctagttgtgaattttgagaattgcagtgtttaaatgaagggaaagagctgcttgtttcatttggtaaatcccttatatgataaaacatctaggagagaggctttgtcacaaatccagttgcccattttgctgtttccatgaaatatttcaaagtagagaaactaatagacttccatgtatctgctgcacagattgccttttactcccaatatactggggtgctgttgcctggctgcacggaaggttgtggggtgtgagggcacttggacattcgggcttgctgtgtctctgttagaaactaatggggcgttgtccctgagcgtgagggacacctctggcatcttgtttcctctacctgaggaagtgcagccatgcttgttgggaagacttgggagaggaccatgtaccactgaggcaggtaacaccctttgcctctgtacctccctgtgggcctggcagtggggctgggcccagggccagcagtccacctaccctggctaggaacctgaactcctgcataatttcaaggcccttctgggcaacaccttgccttgccatgtggactggccacctcatctttccttgtctccagacacccccaccacctccttcccccagccagagactccagaatcccagatcctcacagcaagacacatcctcccccagggaccccgtgtctgttcagtggagaggctctgggaaggggagggaacgacttcctctttattcccgtagcttccatttgagtggccgacaagtgtctcaaatagcatttcagattgtgccccccccccactccacccccgccttcctcctagaaaatgcagctggtgctcgtgtgcagccactgttcagacacgtggaggccacagtgctcgcttggaaccctctgggaccaccgactttcagtggcttctactgaagggaagggccgactattttgatttgggtttgacagataatactgagtttgaaaaataatttcccatcattaagccagacatcaagaggccaaagtaaattctaggtcatctctcccctcactgagtgagttccctgtaaccagcattccagaagagggcgaaaggggaagaatcaagtcctttttttttagatgttgcccaaaccagatcgctaaacagtatcatacctttttactgcgatttcttatcattttaagatagatacccagtttttattttaggagtaaacacttaaactgaggaagcacacctgttgtttctcacttcctattcagccaacactaatgccttctctgtactgagaacagctgatcctcccaaagcgtgtgtgtctccctgtcttcgtggggcccttgctgttctcaccataagcccagaagactcaaggatgctcagcgggtcgtgcagccctctccaccacctattccagaaagtcctcctcaccctaaaaggaagccccattcccaccagcagtcactcctcactccccttcccccagcctctagcagctaccagtctgctctctgtagatgtgccgattctgaatagttcatagaaatggaatcatgcaatatttgtccttctgtgtctggcttcctttacttcgcagaatgctttcaaggtccatccatgttgtagcgtgcgtcatacctcattccctttttttttttttttttgagatggagtcttgctctgtcgcccaggctggagtgcaatggcgtgatctcggctcactgcaacctccacctcccgggttcaagcaattctcctgcctcagcctcccgagtagctgggactacaggtgcacaccaccatgcccagctaatttttgtatttttagtagagacagggtttcaccatgttggccaggatggtctcgagctcctgacctcgtgatccgcccgcctcggcctcccaaacgctcgttcctttttatagctaatattctattgtttggatatagcacatttcatttcatcagttgatggatatttgagttgtttctaccttttggctattgtgaataatgcgctgtgaacattgtgtaccgatttttgtttgaacacttgttttcagttcttttgggtatatgcctaggagtgagattgctgggtcatatggatggtcatttttgtttgtgtgtttaagacagagtctcgctctgttgcccaggctggagtatagtggcgccatctcagctcactgcaacctctaactcctgggttcaagcgattctcctgcctcagcctcccaagtagctgggattacaggcaagcaccaccatgcccggctaatttttgtattcttagtagggatggggtttcaccatgttggccaggctggtctcaaacttctgacctcaggtgatccacccatctcggcctcccaaggtgctgggattacaagcttgagccaccatacctggctttggatggtaattttatgtttaacttgccgaagaaccaccaaactgttttccatatcagctgccccattttacattctcaccagcaatatacaagggttccaattgtagttccacgtcctttatgacccttgttttttgttgagacagggtctcattctgtcacctagactggaatgcgatggtacaatgatggctcactgcagccttgaactcctgggctcaagctgtcctctcgcctcagcttcctgagtagctgggactacaggtgcatgccaccatacctggctatttttttttaatgtagaaaaggggtctcactatattgcccagactggtcttgaacttacgggcttaagcaatcctcctgcctcagcctcccaaagtgctggggttagaggcatgagccatggtgcctggccatgctaacaagttatttttcagtttgaaaaagaataggtatcccagcaggtgtgaagtagtatgtcattgtaattttcatttacatttacctaacatctaaaggtggtgagcatcttttcatgtgcttgtttggccatttgtatatcttttttggtgaaatgcctgttcaagtcctttgcccattttttaatcgggttttctttttgttattgagttgttagagttcttttcatattctggatactagacccttatataatttgcaaatatgttctcccattctgtgggttttttcactttcttgatagtatcctttgcacaaaaatgtttaatttttatgaagtctggtttatctgttttctttttagttgcttgcacccttggtgtcatagctaagaaaccattatcaaatccagggtcatgaagctttacctttgtattcttctaagagttgtgtggtttcagctcttctgtttaggtttgtgattcatgttgaaatcgtttttttcctgtggtgtgaggggggatccacctttattcttgtccatatggctctccagttgtcccagcatcatttgttaaagacgctgttctttccctggtgaatgggcttggctctcaattttattccatcaatctgtatgtctgtccttatgccagtatcatactaccttgagccagatgcacttttaaaagatccaaggctgggtgcggtggctcaccacacctgtaatcctagcacttttgggaggccacagcagattggattgcttgagcttaggagttcaagacctgcctggacaacatagtgagaccttgtctctacaaaaaatacaaaaattagccagatgtggtggtgagtgcctgtagactaagctactcaggaggctgagggaggagaatcatttgagcccagcaggttgaggttgcagtgagctgtggttgtgcaattgcactccagcctgagtgacagacagaccctgtctcaaaaaaattaaaaataaaaataaagtatctgaaaagacatacaaaactaggttttgtctgggaggacaagtagtttggtattgctggaacatcaagtgtgcatggaagtggttgtgtgaaggctggaattaaggacgtgagagacagtgactgtgtgaaggagacgcagcaagctccggagcctgcctgagtgttggcagataacggggacatgagatgtgtccatgctctcaacaagctcagaatctctttgtagaagcagacatgggattccaagcctgatggaagtgtaagggaacccccttaagaacactgaggagatggtggggcctggctgcgtgtatgagtggggaaaacattaaagagaatggcatttgagctagaactgaaggctgagtagatcaaaagctttgtgtgggggtgagagtttgggaacgggaagagggcatttcatgctgaagaaacaggcattgaaacagggcagggtcagagaacatttgagaatctgagagtggcccagcattcctgaaataaaggagagactcatctctcccatacattgagagatgagtcctggaaaaataagtgtgggggagacagcggctgagctcaaaccccatgctacggagtttgaactttctcccgcaggcagtggggagccactggcatcttgtgagcaggggaatggtctgatggacctttagaaaggtcagtccaataacagtatgaaaatatgattggaggcagctgtgctcaccactgtaccaccaacactgaaaatacgattgggagaaagatgagggaaggtgttctgattgtctggtctatagaggctggggttaatgcagggaggaataacgtgttcatttggactattttcacatacatagtagtcgagggaatcatatagggaagccccaggtccccattgcccagccttggccatcatccactgcaacccatcttgtcttatccaggcctcctcctccatatgcatggccctctcttcacactacattattttgaagcaaatctcagtcatcgtattttatttgtaagtcccacctgtggtatcctccaacaaggactccaagaaccagaacgtgattgcctcacctaaaaatattaactgcaattccttactctcaggagtaagcattaaatctcccctcccctcctccctttttcatttggttggtttgggtcctgaattgaattgagtcctgagatccaaatcaggtacacacattacactaggttgtgatatgtgctggttcctcctctcctttttctccttgcaatttaattgttaaatcaggttgttcccatacgtttgagagatatgatagtcaaccaagggtgattttgccccccaagggacatttggcaatgtttggagacgctcttagttgtcgccgcttggggggaggggctgcttgcatgtaacagggcccacagcagaggctcacctgggctgaagtgtggtggctcgactgcccggtgctgcgggaggacacctcctgccattcccccacgttccctggttccctgcgtccagatcgctttgcttttggttaacacactcctctctctcttgtattttcctaagaactggtggttagacctcagggcttgatcaggttcaggctggactttccggcattaaaaatacttcttaagtggcatatcacttagtccttggcacataagtggtggcagtttgttccgtttacgataaaattgcagaaagggaggattttgagaggcactggagcatggaattgctccggtgtgaggtgtaagggggaagttggggtccagcatttggctcaaccccagacccagagtccagggactgaggctggggcttggctgcagcactgactgggtgatttcaggcgctcaccccacagcctgagccttgctttcctctctgtaagctaaggatgcgccagctcggcctgaaccatggaatgcagcgtggggcagccgctccccagccttcctccctagccgtctccctccagctacaggtgccttgcggtgccgccactggaggagtctttgcaggtttatgggacatcagagcagggagggagccgggtgtcggggctgcggcagggtccccaccgggctgtccacgaaccagcgaaccagcggtgttggtggtgtctggtgcccaggaggagggcttgtttacagctgccgtatttcccgggaccctggcttctgtcctcagggaccccttcagaccttccccaccctccgaagcctcaacccgccctgcgcctcccggtggcacagcgaccttggcggctttggcccctgagccgctaggctgccaaggcgcgctgtgcgcgtggggccaggctcgacctcactcctgttgtcgctgcagacccgcgtgggctcccgccgggccctcctgccgccccccagcctccccgcccctgcccttgccagcctgcgccttcctgggcgcctgacgcacccctctgccccaaccacgttttctcaagagtgttgtctgtcccggccttccaaggagacccttagctcccgccggccgcctccggagcctccggcatgggccccaggccggggtcccgcctttgccccggcctccgctgcctcgccccggagcccggaggaggggagccggccacccggggaagaagcggaggacgccgatctggcctcctgcgttgcgcgctccaaccctctgcttggccgcccgcgaaccgcgctctcccgtttcctttccgtcccgtctcgggggcttcatcctccagccgtggccgtggccgtggccaggtgtaccggagcggcacccaggagcccgccctagcacccgctcccgctcccacctcgtctgcgcccacccgctctgggcagctgctcccaagggagcccctcgccctctctctctccttccctcattcccttcatccttctctccctgtgtgcctccttccctccctccctctctcccccttctctctttctccctctcccactccctctctccccaccctttcttcccctcccccctccccctcccccttcttcccctccccctccccatccctctctctcccctctctctttttccccctccccctccctctctttcctctttctctctccccctccccctccctctctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccctctctctccccccctttctccccattcccctccctctctcccccttcccctccctctctcccccttcccctccctctcccccttcccctccctctctccccttctctctctctttctccccttccctctctctcccctctgtctctttctccccccctttccactttctctctttctccccccttcccctccctctctctcccctctctctttctccccttccccctgcctctctttcccctttctctcttgttctcccccttcccctccctctctcctccctctcttttcctcctccccccttcccctccctctttctccccctctgccctctcccccttccccctcccctccctctccctctctctttctccccctccctctctgcccccctctctccctctcccccctcccttccccctccccctccccctcccctctctctttctcttcctccctctctcctcctctctttgtccctctccccctctctctttctccccctcttttctctctaccccctctttttccccctccccctctctctctcctcctctctctttctccccccttctccccctctccccctccccctccctctctccccatttctctttctcccctccccctctctctctcccccccctttctccccctctctttccccctccctctctcccactctctctccttctccccctctctgagcccaggttcttggtggcatctgctttgggcagctctgcagctccttcctcagggagatcacctcaccttcccagggacagacaatgtctcatgcggagaggccctgccctcctgagctgatgtcccatcggggaggaagatgccccctcagagttggtgggagcaccaggtcacggtgttgtggggcaggcagctggtggctgggctgggcagagcaggcagactggctcctctctctggtcttggccctgacgagagaatggagtggggcatggtggccaaaaggccaagggcccctttggaactgtgcccgagggctgacttattttctcaggggcagaagcctatcctcagtgtgtccccatggcagtcaagacccatggacttgcttcccagccccctaggctgggccaccttccatgcagccgaccttccagcgggggtcagaagccacgggggagccctgtcattggcctctacccaaggtcctcgctgtgagtgctgggctggcactatagtgaaataaaaaggagatggagaacattatctactggaacacgcacgtatgtgactgaacatctaaagccaggacagctcctaggagcagctcctccagactgtggaatcaatgccaggggcacccagagaaggcggagcagaaacctgtctaactgggggattctgtggaggagctggttatggaggggcttttagggaagaaagacccaggctttcatggcaaaagattgacagatgtcaagctcagagcccaagaaagtaccttttgaggaaaaagccacagactgagggagagaagggaaccgagacccctgcctcccaggtcagaggctgcctgctgttccgggcagtctgtcacatgagacagctctttccaggcattcctaagcaccttagtagaaagtaaagcagctcttattgcttatgaaaatttcattcaaggatgagaacaaattaatgtctggggctggagttggtgtgtctgctctccttggccctaaactaggtaggtttgtgtctccaggatggagtctatattagttcattttcacacagctataaaaaactacctgagattgggtaatttataaacaaaagatgtgtaattgactcacagtttcacctagctggggaggcctcaggaaacttaccatcatggcagaaggtgaaggggaagcaaggcacttcttacacggcagcaggagagagagagaaagtggggggggggaactgccaaacacttgtaagtcatcagatctcctgagaactcactcactatcacaagaacagcaggggggaaactgcccccacaatccagtcacctcccaccaggtccctcccttgactcgtggggattacaatttgagatgagatttgggtggggacacagaagcaaactgtctcagagagtgacagcctttttaaagagcacatatgcagacacagactccctttctttgggcagaaagaagggtgggcaacgagcacattatgtaaatcatcttgacggtggacacagcagctgttggctgtcactgctggatagtggtcgcagcaaacagctgtgggccaggtcactgcttgctacctagagagcccttcagctggggggcccagagcacagctgaactccacgggcccccttggtgagctcctttggcctctgtggatgacaggggacccctggttcctctgcttcgtgcatcttcagactcttctccacctctgctgagtagttcagttggcagcgttgcaggttggctgcaggggtgttgaccagccctggagctatggtgcagcctgggaatgagcacgcacaccaggagcctaggacaatggcagcagaacagctccagcggagcgtttcctggggctcaaggggaggcactcagatggcctgctttgggtgttcaagactgagtggtgagccagcagggaacacctagcattttgtgagatactcagccgtattcatctccttgcaccactgtacaagttacacatgcagtggctccaaagagcataaacttactatgttaccgttctggcatgtaggtctgaaatgaggccaaaatgaaggtgtcagcagggtcgtgatggctctggacgttctagaggagaatctatttccagcctttcccaccttctagaggccacctgcctgccttggttcatggccacttccctgcatcttccaacccagccatgtagcatcttcacatctctctctgacccctgctttcattgtcccattgccttctcttgtctccctcctgcctccctcttgtaatgacctgtgtgattcccttggacccacctggatgatccagaatcatcgtcccatctcaagattcttaactgaatcccatctgcagagtccctgtcgccaagcaaggtcccatattcaccagttccaggaattaggatgtggacatctttaggcgtcattatttagtctaccacatcaacctatgtggtaaatatttagcaatcaaaagtttgaaggaagatacgagaaattaggcatctttgaatctttcagtctaatattgctgaaggtgggacataagccccatactccagccactctaaggaatgatgtcttccatggagtgaaggggaatgccccagagtaagactcatgtatatgtttttctatattttaatagtgctacaaaatacaaccattgtacatattcatttgtttttgtttttgttttggaagcaaatttccgtcaggaaaaacagccttgttgctgtcccgtctacagtatctgctaaaataaaagtaccagtctctcagcccatagtgaagaaagacaaacggcaaaattcttcaaggtttagcgcaagcaataatagagaacttcaaaaactaccatccttaaaaggtaatttttatttgtcttttaaaagttaaattgtggctgttggagtgaaggagcaatgttttgatagtgtgctaatttattcctttgctgtgtttgtattttgtggggtcatcttttctgtattgaggggtttttttttttttaggttgaatgtcattaacttacttactcaattaacattttaaattccagagctattcaagataaaagtttaacaacacagtataggcataatacactaaggaaacaggaaaagctgaacatctttttatttatggtattaagctagccagtttttcttttaaattaattttcatttgtttgtcttagaactgtagcaattccgaaaggaattactccaagtacagtaattgtaaaaattatagtagaagttccctatgtttctaaagtaaggactgtagctatagtacattatggacttgctttgttatgagtcatttgaggattacctctactcaagcatttcttatatgaaattaggaaaaagtgctctttactttgaatttccccccaaatgacacagccatctctttccatctcaggttgtttaatccctaaaagtcttcctttagattttgagattgaggtgcttaaaaccttatcaaggaaaacagagtaaggaccgtaaagtcaaatgtgaacctcttaaaacctttataattactaaaatataagacagatatactaaataaaataacatttttcataccttaaatttataataatggatcttttacaattaatttccactgaatattaattcagcaaccagtccagtggctcgcgcttataatctcatcactttaggaggctgaggcagaaggatcacttgagcccaggagttcgagaccagcctaggcaacatagggagactccgtctctacaaaaaaataaaatttgctgggcatggtggcacacacctgtggtcccggctactcaggaggctgaagtgggaggattgcttgagcctgggaggccaaggctacagtgaaccatgatcgtgccactgcacttcagcgtggatgacagactgagatcttgttctcaggaaaaagaaaagtaaatatgaactcagtgagagcaggcagtctgtcatgtttatagctgtattcccaggctttccacactgtaaagcagatagcagatttgccaggtggaaggaggaagggaggaagggaggctgggtggatggtggatttatgggtgggtggatgggtgggtggatttacgggtggatgaattttcttgccccctacttgctagaaatccaggttctcggccgggcgcagtggctcatgcctgtaatcccagcactttgggaggccaaggcgggcggatcacgaggtcaggagatcaagaccatcctggctaacatggtgaaaccccgtctctactaaaaatacaaaaacaaaattagccaggcgtggtggcgggcgcctgtagtcccagctacttgggaggctgaggcgggagaatggcgtgaacccgggaggcagagcttgcagtgagctgagatcgtgccactgcactccagcctgggcgacagagcgagactccatctcaaaaaaaaaaaaaaaaaaaaatccaggttctcgcttgcattttctagagcttgtatttggcttatatttggtttacctttgtggtagataatatgcatgctaagtcattttttattattagtcttcctcttcccaaataggatatacctttctcatgctattcattcattcagcaaatatgtgttgagcgcctgtgaaagctattctaggtactaggggtacagaattacacaaaaccaagcccctattctcctggagtgagcaacccattggtgagacagcaaggaaagggataggtatcaactcctccttccagtaccctccggaggcccagagtcagagggagggaaaaggctttgtataaccactgttgggccttcatgtcccaagccctgcccctaatgcccatcacagctggggcttggatctgccatggtacagaaggttggccgtgtgccccatttttccatgcatgccccgcctcagccagtgcatgctgggtgtgtactgctgctgaatttggtcaaatgccatatgatttttctccttaagatgttaagattataattgctgtgttgatagatttttctggttttgaaccatctttgcatttgtcagttttgtcgccgtatattattccatgcgcggggcagagcccatgcaagtaccggtgtgtgccggcctctagcatacttcctttacctcttctgaggagtcgctgcacaagcctctttctacatctgttctacatctgttttctattctcaacctccgtttccttcgtttttcattatacctagtaagaatggcatgcaatatacttccactgacgcttacattttcacttttccccaaaatggtaaattctccatagtaaatccacatatccaggagaatttcacatgtatcaagccagttcccctcactggtcttgtttgataattctctcttggctgttctaaaacattaatgcctctgtatatatactaaaataatttcacctagttcagaaaaataataattgattggaattaaagttatatattaatttggtgaaaattgataccttttttccatctaggaagatggtatatatcccccatttttctgggtcttgttttctgacttataaaattttatggttttcttgtaaatctctaactttccagtaaatttatttctaaatactctatagcttttgtcacacttgtgactgggttatattttttcccatttccacttctaattggtttttgttaatctcatgcagagctattggtttttaaatattttcttttgccgtcaccttaccacattttcgtattagtcttaattaatttttccactacagtctgcatatatagtcctgttgtttgcaatagattcttttatctctcttccactatttatgccaacatagactagttattttaattttattctgccactaagaaggaccaataaaacctggaacagaggtgatagcaggcattcctgttttctcccatttcagtaaatggcttcagcgtttcctaagttgatgggaaagtggctcttggtttctggtaagcagcctttgcaaggccgctggtgctccggagtccaagctcacaggactcttcccggacccatgcaggctggttggcgccatgccagtgcatgctgggtgggtactgctgctgaatttggtcaaatgccatatgattttcctctttaagatgttactattataattgctgtgttgacagatttttctggttttgaaatatctttgcattttgtcagttttgtcacagtgtattttcatagtgtttggaactaattttctttagaatatttgcttccgtatttactacatggagctggtctgtagttttgttctttttcataaacctgtattttgtcctgtctaagatttgttgtcaccagcactttgtgaaggttcctggggtggcctggagcagcttttcccgcagctccctcacactgccaccttatgacagggataatgagatggacccggatttcagaaacaataaaatgtggaatgtgtccatgaaatagggttgaaagtttgacttggaactcagtgggcctgttgcttttctctatgaaacgtctgtagcttcttagcacagtgcgtccatttagaaaggggggtctgttaactagtacatggtcattgtttaatgcaccttttaatctcttccttatcagtggcggttatgtctccttataagttcatttattcttttgactgttctgtttgtgttcagtattattcatctgtacttttatctttaattatcctatgtcttttattttaaccttttcttcatttattaagttgaatagagagttgacttatttttagtttgctttttaataataaaagaatttaaagccacgtattcattctgagtgtaaccttcagccctatccctagattttattttttcctaacttttcaagtcataggtttttcttttttagagttgaggcataatttacatatcctaaaactcacccattgtaactggaaaatttagttattttagcaaatacatagagttgtgcaaccgtcaccacaattctgttttagaatgtttccatctgcctccaaaagttacctcgtgccattcaccattaagttcccctccgggccccagctgcaggcacccactgatctgctttctgtctctagacttactttcttccggacacttcatataagcgaagtcataccataggtagtcttttacacctgctgtaaggtttttgaggttcatctgtgttgtttctttttaatgccgcatcatattcagtcagatggatacaccacattttgtttatccgttcaccagttaatggacatttgggctgtttcttagctggtatgagtaacagtgctgctgtgaacatttgcatagaagtctgtgcgagcagatatttcatttctcttgagtagatacctaggagtggaattcctggcttgtgtggtaaatttatgtttagcttgttaagaaactgttggctgggcaccgtggctcacgcctgtaatcccagcacttcgggaggccgaggcgggcggatcatgaggtcaggagatcaaggccatcctggctaacacggtgaaactccatctttactaaaaatacaaaaaatcagctgagcatggtggcactcgcttgtagccccagctactcgggaggctgaggcaggagaattgcttgaacctgggaagtggaggttgcagtgagccgagatcacaccactgcactccagcctgggcaacagagcaagactccgtctcaaaaaaagaaaaaagaaaagaaaagaaaaagaaactgccaaactgttttccaaagtggttgtactgttttacatttccaccaacaatgtatgagggctctgatgtggccacattcttgccaatatctattattgtcttttcgattatagcttaattcttgtgggtgtgtaatggtgtctcactgtggtttccattggcctttccccaatgactggaaattttaagcatcttttcatatgcctgttagccatttgtctctcttctttgatgagatgtctttttttaagttggttgtcttcttcttgttgaattgtaacagtatgttttcccagatatgagtcctttattttaacagaaaataaaatacagtaaaaataaattattacagaagtgaagtacaaaatacactgtgtataaaatagtgtttttattattatagtcagtagacataagattaccctgttaagttgatacgaaagttttgaaacgcttattctcaatttttgttattcgttgtaaatcttcagatttgtctatatgtgtcaaacccttcttttgagcttttaatttcagggttttttttttcatttatgaaagttctgtttggttcttttttcagtctgcagtgccattttaaaatattttcctattctcttgaacataccatcaaaacttgtatggtatacaagtttagtatagtatactaaataagtatagtaaacgcagctgttttatagcctgcgtcaggtcacactagtatctgaggtgtttgacacattttgttcatgatgtcttatttccttgtgtacctgattttttttattgtatattggtcattgtattcagatatgtgaaataaattgaaacctagaatcaaagtgtcttcttcaatagggatttgtttttgctctgccagacacctggaggcactgccaatctgggagtgccttaaaccacaacactggtttgttaaatcaaccgacccagttgttctgcaatatatcccacttaccccactgcggttcctgtaaatggaaaccttttttggctgaaatacatcagaggcaacgctttataacttaggagatagtgacattattgtgagagatgcatagcctctggttgcctatcatcagaagtgatgctaaattttcagttttactagtgaattcagttgatgacagattgatatctctattgaacaattacatatttccctttacaattcaaaaagtactagtaatagtctgcagtgtatattttggcatcctaccaatgtgtattccctgtcaaccatgtgctaatgtcttgaacaacagttgataatccttgcctgagtcagtagtttcagtttcactagcgaattcaacatttactctaacgttcttctgaaagcagtgatttttcttaccaaccagagatacttggttatcttgaaatggagctcctactgaaaaagaaggataagcttaattctttgtcttttattaccagttccctctaatggtgacagctgaagcttttttctagctttctctttgttttaatatcattgtggactaatatattgttgatttcagtgtgttttcatgtaccaaaagcattagtctttctggtgttcagatggcataattgcaatcattaagtgccctttagggtagctcgtgtgtttttttgtttgtttttgtttttttacatagcctcatttatttttgattccttgatttctgacacagtgagacatcccttgggctcatttaataccttctcttccccagacttcaaatcagccatttttcttttcttttttttttttttgagacagtctcatggtctcatccatgctggagtgcagtggtgcaatcttggctccctgcagcctccgcctcccacattcaaatgattctcctgcctcagcctcccaagtagctaggattacaggcgtgtgccaccatgcccagctaatttttatattttttgtaaatatggggtttcactatgttggccaggctggtctcaaactcctgacctcaagtgatccacccacctcggcctcccaaagtgctgagattacaggcatgagccaccacacctggccaaatcagctatttttcaaagagccctggttcctttcagtagtaaatatattagcaaccaaaatctgggtcagagggatgtttattgctactggtctgacattacttttaaatgctttcaatggagggagcgaggatataaattttctgaatcgtacattcatattgatattttaaatttaattttaacattatagtgtttttgaagcaggatatttccctgaccacttcacgggcaggaactggactgcgtgggtgtgggaactagctggccccttcagcgccagcaagggcgatctccacttactcgctgctccacccctcgtgggaggggaagtgcaggtgagctggtgcaggagcacttttgggcaccagcaggagcaaaccccataccagccccatggcagcgtcttcaggggtccctgtgatccctgaagccccagagaaagtgttgcagtactcttttagctctgccatccatggatgacttaagtgttaacagctcagtggagggtcagtgggacaaccttttacacccatactcatggcacccaagttgttgtccagcatccaggaggaatgaggttgcatgaaggaattgaagatggtaaatgcaggggattttattgccaatgaaagtggctctcagtgggaagggaagctaaaaaggagacagagtgggaaggtaatcttcccctgaagtctggctgtctccagccagattcttctctgaagttacgccatcaagttgtccctctgaagtcaagccacttctttccaacatccaactctagtctcctatgtccagttgcttctcttctctctaccagctgagcctggggtttttatgggcacaggatggaggcacggggcaagccatgggtggttttggaaaaggcaacattcgagtggggaaacaggaatgcatgttctcactttggaccaaggttccaggcttttcggcttgaggctagggccctcacaagggacgtgccctcttctgcccagaacttccctgcttcctgttcctatcactttcacttatttcttggctttcatagttttatctctgtcttacactgaaaatgttgatttctagcatcactaatgtaattatgggtatattctcttaaacagttcccaaaaacaatattgatattactgcaaacagttggaactttgaattgacccatagtcattgcagaaagaaacagctgttgactttatttatttatttattttagagacagttccatgcgatgttgcccaagctggtcttgaactcctgggcttaaatgattctcctgcctcagcctcccaagtagctgggattacaggcacgcaccaccatgcctggctactgttggcatttttattgggatcctgttacattttgcaaatatctgagggagggctggcatcttgtgatgtgtgcctcctctaagagtatgctatgactattttccaaggccactttcatgtcctttaaggctgtttttaagtttcccttgtaggttttgcatgtctcttactaagctaatgcctagataatcattatcatcgctcttgtaaatagagtcttttcttccattgtgtcttctagttattagttgtttatatgaaggctattgaatttgggggccttgctttcataacctgcttccttactgaattacctgattgtttgcatcagtttttcagttgattcttttgaatattcaggtattaattagagcatctgcacataatttcacctctgtttataattgtaaactcacatgtctttctctccagttgactaataaattcagtaaaacaatttcagtaaaatgttacatagtggtggtgagagtgggcatacttgtcttgtttctgacattagtgggaacgagaggcatgatttttagcaaccgtttattatttcattctgtggataccccagtttttcagctattataaatgatactgttctgttaatcttttgttatcgttgttgttcacatctttgaacctttccttaagcttgatgaaggaggtactggatcaaagagcaggcattttcaaaaacccttaatagatattgtctacacactttccagagagtagcaccacatacagagtatgtgagatgcctgtccatcatacctctccaatgctgagatcatgtaaaagttgtagttatttgataagtagaaaaaggtatttcatatttttatttttttttaaccagtgaggttgaatatagccctcagacctgttcattgtaagattattctgaattaatgccttcatttaacatttttggactggaaggtggaagtgttaaataaagagaccttttttttttaagatacttataggaagagtaaattaatcatggacttgttttttgaggccatttttagaaaagaaaagactaggagaagtcaaagttatagcagaataatgtaggacttattatcggctaactaactagagaccctggggcaaaagagttgccgagtatttggtcttttgtgaaagaagtcattacattattgttagaatttacttgaattgtttaaaattggcttttgaataccagttaaatattttatatctcttgctctcctctcatgcaaatacaatacttcaccctcattcaaagcagtttattttcttttttgagacacggtttcgctctgtcacccaggctggagtgcagtggcacaatgtcagctcactgcagcctggacctcccaggctcaagcagtcctcccagctcagccttccaagtagctgggaccacaggtgcgcaccaccacgcacagctaatttttgtatttttagtagagacggggttccaccatgttgcccaggctggtctcgaactcctgggctcaagtgatccacccacctccgcctcccaaagtgctaggattacagccatgagagccactgcgccctgcctattttctgatacaattgaaagctttaccataaaagtagaggtttaactgcctacaaatgaattatgcatatatttacaggaactttggcttcttgcctgttagttgaagaataataaaaatggactgtgcggaagttatcggagtgcctgctgctcttctagtcagcttagaaagagccgcgcagggaatctctgctttcattagtcttttcttctcttgcatgttttgatttttgtgtcttctcgtgatttgccatgatatcttaatgagaggacacagtccctggattgctgaggcagttcacactggccatctgtgcttctcagagcaaggggaaggtgttcagagcgatgacccaaggtggcccttgccctcagggaaccagcgggcccggagtcacagcggtgttctagcttcagcccctctaagccacagagagttaccaccagggccactccctcttcagaacactggggagcccgttgcctgtcagacagcctgagcccagccagccagcccagcccctccagggtaccccctctccatggcccggggctacacacatgaccttggccgttactccatggtcagtctcagctctctctgggtggcacccatggggtttagtttccagctgccagctgtaatctcggctcattaccgcacacagagaccacttcttggacattcccgtcctctgtctggtccagcgccctgctgcctctgctcctcaagtgtttcctgaactgccctggctcaagccgtccttatctaaaaaaaaaaaatttaaaaactgaggtgaaatacacatgttaaaacataatatttattattttaaccattcataagtgtacaactcggtggtattagatacattcaaaatgctgtacacccatcactactatctctacccaaaacttttcatcatccccaacaaaaactccattaaacagtaagtggctgtctccccattctgctttctgtctctatgattttgcccacagtaggagcctcttagaagcggaatcgtacagtatctgtctttctgtgcctggcttatttccctaaacataatatcttccaggtccccccacattgtagcacgtgccagaccctcgctcccgtcgaaggctgatgccatccttcagtgatgtgtggacggacacattccgcgtatcccccaatcagtggatggacgcgtgggttgcagagcacgccacacacattcagtcagtacacgagttaacagttgcgtgcttgtctgcctgtgtcatccattcgagcatctgccaaggacccaggaaacacacagtgtgtctcctgaaggaatgaaaagccctcctggcccctctgccctctttctccaccctctccattttcaccgagatggttgtggtgtcacctctcgtggggtggccaaaaccccagccagggccacctatcccttcacctccctccacctcggatttcctcttggaaaatgaggctcctgactcacttgacctactgcgtaggctcctaaaagggtgtcggcaagttggcaagttaaaaaaaaaaacaatcagcatgaaagcactccgatgtatgcatacttttacttcgcgttggttccctacgttcttagaacaaggaaggagtgtgagtacttgctttggattgaaaggttttccagactagctgtaggaagtatgaaagtaaccaaggtctcacacacagccccagcactctgggtggatttcacttcatctactccactcacctacgctgagcttccctgtggacaagctcgtccatcctctttaatcactcccaggcctcgctcacacagcaacaagtgcctgtccctgtgtccttgctgttggcaagcagaagttccctggcagcctttgaacatagctgaatgttaggtatctttgatctgtctaaggaaaaagtctattttaaactgtgaagtgaagccaatttttttaggtcagattcttacccaacaaagcatacatcatccgtgctcatatagtttccagtttaaaaaaaaaaaaaagtgctggccagcgcagtgtgagtgcactgtgcacatgatgccactgttctctaggttcagaacaccagccttctgttaattacaataaaatgtcttcactaaaatagaagcatatttaatttgcctacaaaattgcttggagagccttaaaaaataaaaccttcagctgaatgatgtagaaatgaaaatttgaaagttttaatcagaaatactacctagaaataaaatcagtaggatgtatttacaggtagtttgtttttaagtaaagaataaaacagtgacagagggatcaaagaataaagaataattccttttcaagccaggcacagtggtgtgcacctgacttctcagctacccactaggctgaggacggggagaatcatgagttcaagcccagcctgggcaaaatagggagaccttgtctccaaaaaaatatgaaataattgtttcttcattattgtctagtacatagattattgtagttatagcatttgatgggagaccatattgagcactgtggcctttttggcccattgggctgtggaaggtatgctaggtgggctgggcccagcaaagcgcccttccttggtccttgctcaagcccttcacaggcagctgcagtctcaggaaaggttcagaatgtcactgcgaggccagcgtagaaggcaggtaggcatgtcacaggaggtgagtggaaggcatccactccttagcaagtgcatcatgggggacctggaatggggtctgtgttcaggggagagggaaatgctgttcttgagatgatttgacagcatatccctcttaattatgtgctacctggaagaggtgtaaagggtagcaaggtggttttgtaagatcagaattgggtgcaactgcttgattcattcattcagtacatttgatggaacacctgcatgccagccattctgtaggagctggaccaaggaagagcttgtggtccaagccacagaccgggagggaagaggaagcctgcctggatgagggtggtctaagccgagattcctcaggtggctctgctgcatccccacgccgcagctgaagggatctttctgttggcagatggcccatgtttttccagtgggacaatgcccactgcttcctgcattttgctctgatggccggagctgtatttagttgtgtcctgcctcagtccctcccaagctgtccacctcaactcagcatggggagcgcactccatatctgacgctggcttctctaaacgtgaggggatagggagatgacatatatgcccttttacgggtgaggaaaggaccagcggggatttattgaaggcagcctcgctccccatgctgagcgacagctctgtctagcccctccctgagcaggtgatgaaaacctggcccagtgcgagtgacatggttgcattatgagcctcttctgggttgcatttacttagagtttgtttcatcagtgaggaaagtactctggagacccagttgaactctgatagcttcagtgagcctacagactcaatgcaaaggtgacaggcttacaggagaaggtccaggcggttcaaaattgatttgagacagggagtcaacctcctctaatctgtgttggttccattttccatgcctcatttcagctaatttttgtttgtgttttttatgtacctgatctcatttatccagatttccttggttcagactttcttggttctcatcacagccctttctttgttcctagcctgtgcctaagagacagtattcattaagggattctccctgcagtgacttaatctatatctctttttaaaaattatttttatgccaggtgcagtggctcacgcctataatcccagtaatttgggagaccaagacgggtggatcccttgagcctaggagtttgagaccagcctggacaaccttgtccctacaaaaaatttaaaaattagccaggcatgctggtgcacacctgtagtcccagatacttgggaggctgaggtggggggatcacttgagctcaggatgctgaggtttcagtgagctgtgatcgtgccactaggttccagggtggtagagtgagaccctgtctcaaaaaatgtacgtatttttttaaatcgttactttaggccaggcacggtgggtcatgcctgtaatcctagaacttcgggaggccgaggcaggcggatcacctgagctcaggagtttgagaccagcctgggcaacaaggcgaaaccccgtgtctactaaaagttcaaaaaattagccaggcgtgatggtgcatgcctgtaatctcagctactcaggaggctgaagcacaagaattgcttgaacccaggaggcagaggttgcagtgagccaagatggtgccattgcactccagcctgggcaacagagcaagactctaactcaaaataaaataaaaattaaaaatatatataaaataaaattgtcacttttaattactctgaaagtaatgtatgcttgttttagcaataccaaaaaaaaaaaaaagggaaattttagaaataaaaaacatccatatgatcctacagccttactgctgggtatatatccaaaagaaagaaaatcagtatatcacaggggcacctgcactgccatgtttgttgcagcatcgctcacaatagccaagaaatgaaatcaacctaagtgtcaatcagtggatgaatgactaaacaaaatgtaggacatatagacaatggaatattattcagccataagaaagaatagaaacctgtcatttgcagcaacatggatggaaccagaggtgattgtgttacgtgaaataagccaggcacagagagacaaataccatgtgatcttactcatgtgggaggtaaaaaaataatggatctcatggaggtagagaggagaatggtggttaccagaggctgggaagggaagatagggagagagggtggttaagggctgcaaaaatacagtcagaaggaataagttctagaattcaagagtacagtaggggaattgtagttaacaataatttattatatatttcaaagtagctggaagagaagaattgtaatgtttccaacacaaagaaaagatacatgctggaggtgataggtatcccagttactctgacctggtcattacacattgttaacaggcatcaaaatatcacatgtcccctccaaatctgcacaactattatatatcaattttaaaaaagaaaaactcatacccataccacccaatgatgacactgtggatatttggggagtgattcttcctatgatcattttatttctgattacacactgcctctttcacttatattttcattttatacatttataagtatttctgatggatatgtaatatttcactaggtatgtgggataatccctttggcattaaagtagtttccagtattttagaaccataaataaaacatgatgccctcaaaaagagtaagatagttagaaatgaagttatcaaggagagaaaagacttgcacactgcaaactatgaaatgttgctgaaagaaatggaagaatacaccaatcaatggaaaaacatctctcgtttatggtttggaagacttaatgttgttaagatgtcagtactgcccaaagcaatctacaaattcagtgcaatccctattaaaacttttacagcattcttttccagaaatagaaaagtttcatcctaagattcatagggaatatcaaagagataagcatagccaaaacaatcttgaaaaagaacaccaaagttggaggactcacacatcctgactttaaaacttacagcaaagctacagtaatcaagactgtgtagtactggcataaagatgagcccagaaacaaaccctcacataggtggtcaaacgagttttgacaaggtttcctagaccattcaatggggaaaacacagtcttttcaacaaatggtgttgggaaaactgggtactcacatgcaaaagaatgaagcgggacctggccgggcgcggtggctcacgcctggaatcccagcactttgggaggctgagacgggcggatcacaaggtcaggagatcgagaccatcctgaccaacatggtgaaaccccgtctgtattaaaaatacaaaattagctgggtgtgttggcacacacctgtagtaccagccactcgggaggctgaggcaggagaatcgcttgaacccaggaggcggagattgcagtgagccaagatcgcgccactgcacaccagccttgtgacagagcgagactctgtctcaaaaataaaaataaaaataaagaatgaagtgggacccttaccttcataacacatacaaagattagctcaaaatggatcaaacacctaaacctaagagtaaaactataatgtttgaggagaaaacataggagaaagatttcatgacattggatttgacagtgatttcttggctatgataccaaaagctcaggcgacaaaaataaaaatagatagattggactacataaaaatttaaaacatctctgcattaaagggcccagtcaacaagaaaaggcaggccacagaatgggaggagatatttgaaaaatcatataactgataaggagttaatatccagaatatctaaagaactcctacaactgagcaaaacagcttgattttttaaatgtgtgaaatacttaaatagacgtttctccaaagaatataatatctgcaaatgaccaataaatgcatgaaaagatcctcaacatctctgtcattaggaaaatgaaaatcaaaattacagtgagatacttcacacccactaggatggctactatttaaaaaaaaaaaaaaaaaaaaaaaggagcaaaggcaggcagatcacttgagctcaagagtttgagaccagcccggacaacgtggtgaaactccatctctactaaaaatacaaaaactagctggttgcatgtgcctgtggtcccagctactcgggaggctgaggtgagaggattgcttgagcccagagggtcaaggctgcagtgagccaagatcatgccactacactccagcctgggtgacagagcaagaccctccctgtctctaacaataaaaatagtgctcgcttcagcagcacataaactaaaattggaatgatacagagattagcacagcccctgcgcaaggatgacatgcaaattcgtgaagcagttgcatatttttaataaatggcgttgggaaaactggatattcatatgcagaatggaactagacctctctttctcactatatacaaaaatcaaatcaaagtggattaaagaaatctaagaccttggccgggcgcagtggctcacatctgtaatcccagcactttgggaggccaaggcaggtggatcacgaggtcaggcgattgagaccatcctggctaacacggtgaaaccctgtccctactaaaaatacaaaaaatcagccgggcgtggtggcgggcacctgtagtcccagcaacttgggaggctgaggcagcagaatcacttgaacccgggaggtggaggttgcagcgagcagacatcgcaccactgcacttgcactccagcctggacagcagagcaagactccatctcaaaaaaaaaaaaaaatctaagacctcagactgtgacactactacaagaaaacaatggggaaaatctgcaggacattggtcttggcaaaaattccttgagcaataccccacaagcacaggcaactaaagcaaacagggacaaatgggatcacatcaggctaaaaagcttctgcacagcaaaggatacaatcaataaagtgaagagacgacccacagaatgggagaaaatacttgcaaactactcatctgacaagggattaataaccagaatatataaggagctcaaacaactctataggaaaaaaaactaataatccgatcacaagatgggcaaaagatttgagtagacatttctcagaagacagacaaatggcaaacaggcctatgaaaaggtgctcaacatcattgatcattagagaaatgcaaatcaaaactacaatgagataccatctcataccagttaaaatggcttatccaaaagacaagcaataactaatgctggagaggatgtggggaaaagggaaccctcgtacactgttgttaggaatgtaaattagtacaaccactataaagaacagtttggatgttgcttaaaaaactaaaaattgagctaccatatattcagcagtcccactgctgggtacataccacaaagaaagaaaatgagtatatcaaagagatatctgcactcctatgtttgttgcagcattgttgacaatagctaaggtttggaagcaacctaagtgtccatcaacagatgaatgaataaaaaatatatatatatacacaatagagtactattcagccatgaaaaagaaagatccagtcatctgcagcaacatggatggaactggagatctttatgttaagtgaaataagccaagcacagaaagacaaacatcacatgttctcacatattcatgggatctaaaaatcaaaacaattgaactcatggacatagagagtagaagaatggttaccagagactgggaagggtagtagtgggggttggcgggggggatggtcaatgggtacaaaaaaagttagaataaataagacccacttgatagcacaacagggtgactatagtcaacaataacttaattgtacattttaaaataacactaagaatgtaattggattgtttgtaactcaaaggataaacgcttgaggggatgaataccccattcccattctccatgatgagcttatttcacattggatgcctgtatcaagacatctcttgtgtctcttaaatatatatacctactatgtacccataaaaattaaaaataagttttaaaaaataagtgttaatgtcctcgtggagaaattggaactattgttgtgcactgttttttgttttttagggtctgtttgtttgagatggagtctcgccctgtcacccaggctggagtgcagtgatgtgatcttggctcactgcagcctgcctcggcctcctgagtagctgggcctacaggcacgcaccaccaggcccagctaatttttgtattttcagtaaagatggggtttcgccatgttggccaggctggtctcaaactcttgacctcaagtgatctgcctgcctcagcctcccaaagaaagcgctgggattacaggtgtgagccaccacacccggccctgtgcactgtcagtgggaatgtgaaatggtgcagccactgtggaaaacagtatggcagttcttccaaatattacacatataccttgaaactgtgtatcgctattatgcatcaattaaaaataatagaatgggaaaaaaataaaaatagaactgccatatgatccagcaatttcacttgttggatatacacccaaaagaattgaaaacagaggcatgagcagatacttgtagccccatgttcatggcaacattattcacaagtgacaaaaggtggaagcaacccaaatgtccgtaaacagggaagagtgaataaacaacttcagtgtatgccaatggaatatcattcagccctttgaaggtaggaaattttggcacttgctacaacatggatgaatcttgcggacattatgctgagtgaaataagccagtcccaaaaggacaaacgctgtaagatctccttatgtgaagtacccagagtagacaagttcatagagactgaaagtagagtgatggttgccagcactggaaggagggagaatggaaagttactgtttaatggggacagagtgtcagttttgcaaggtgaagagttcggtggatggatggtggtgagggttgcaagacactgtgaatgtgcttaatgccacagaactgtatgctgaaaacagttaagatggtacattttgtgttgatgtatattttagcacaatttttatttttatttttttgtttttattttaccttaagttctgggatacatgtgtagaacgtgcaggtttgttgcataggtatacatgtgtcatggtggtttgctgcacctatcaacccgtcatctaggttttaagccctgcatgcattagatatttgtccaaatgctctcccaccccctgtcccccaccccccgacaggtcctggtgtgtgatgttcccctccctgtgtccatgtgttctcattattcacctcccacttctcagtgaaatcatttagtgtttggttttctgttcctgtgttactttgctgagaatgatggcttccagtttcatccatgtccctacaaaagacatgaactcattcttttttatggctgcatagtattccatggtacatatgtgccacattttctttatccattctgtcattgatgggcatttgggttggttccaagtctttgctattgtaaatagtggcacaatttttagacaattgttttttaatcaattataatattattaactccttgtatttatagcatttatatttccttttgcttgcttttggagagaacatacagaaatttgtgattttaagatcgggcatggtggctcatgcctgcaatctcagcactttgggaggctgaggctggaggatcacttgagcccaggagttaaaagactattctgggcaacatagtagagacctcatctctactgaaaatgaaaaaaatgagcagttgtggtgattcaagcctgcggtcccagctctgcaggaggctgaggcaggaggatcacttgggcccaggaggccgaggctgcagtgagcagagatcataccacttccctccagcctgggtgacagagcaggaccctgcctccaaaaaaacaaaccacagaaatttgtcatttttaatatgagcgctattcctgaggggtttgttcagaggtatttacatgttatttttttgcttgagaattgattattcactttccctttcttctaaaagttatagggatttgggggggtggttttgattgatttttatttaactgtttaagccacgtcaaattttattctggtatgatgttaagacttaaattgacttttttctgcatatagttaatcagttgtctgccccaagattgccaagcaattatctaattcttccccttccactgatttgagatatactctttattatattacatttatgtcaacatatttctcagtttggggctgtggcttctgttccattaatctgccttttttgccccatcacactgtcattaattcatacagctttatagttggtaggacttgcctttctcattagtagtgttctcattcttcttgttcttttattttttgcaggtgaactttagaatacttttgctaagtacctggaaaaatagaggcccacctgaattttaattggaaatactttaaacctgtagatcagtttggggggaaattatcagcatagctgcagtatttatatttttatatttccaattcagaagtacaccttacctttattcaagtcttcttttcttccctcatattatttgtttatttatttctatcttagagtctgttttatcaatgatggccagatcagccttgggttctttaaagaactacttacatgcatagggtttcaaaagagtgtggggtaaatcactaataaaggcaagatcctttgatctgagatcattaggaaaaatacatcaaaaagtgtcttcactgtttctttgactcctattccgtatattatatataaagctcttaggagcctttcccccttatttctgtattcccactcatcagcacagttgtaggataggcacattttttcatcttatctcgtatgaaatattaaatcattggagggcaggtctctgtctccttaaagcccagatcttcaataagcatctgctcctgggctccttcctgagcccctgaacgcctcgttcctaattgtgtctgagttcatctggcatcactcagaggaggaggaggaggaggaggctggggtgtggggcagtgagagtcatcaacactgcttcctagtggtcgttggtgatcggtggccatcccctccagacagacaacccacaggtcagcagtgaaggcttagaggcaggagggcagctaagatctaaattcctcttacccaactgaaagcacgtgctctttaaaaaaaaaattaattctgctgttcagatagcagcaaagtcagagcaggtgtgaggccggcagcctgctcaggtggtgcgtgcccactgcccacttgtgttagaaatcacatcatctcctggccggccatggaatccagcactgtctgtcagctctggggaaagagggggaagggtgggatttggtttgcttttatctatttattttagttgctattgatacacacaataaaagctacattcttgtgagggaggacttgattagcagccctgaagggcggtagcagttcccttactcattgaatgtatctggcgctaaaccctcagctggaactgcgagccctagctgtatttcaggtgtttcttactctactgtgaattatgtttaggaactaaagggcttttgtatccttcacaagtggggggaagagagcaggggaattgtgtgagaaactattaaaaatgaggagccatggtttggacaaacttccttgttggtgtgaagaaaggaggaatttttttcagttccacctgccgaagaggcttttcttatagttcgttttcatttggaactactaataacactcatttttgtagggaatcatctcaccgcaccccctcatgggatcctgcaatactccatccaattcagaaataatgtttttctccttggaatagctttttacattaactgtatttgaagatagaaaatttagatctgaatagcagcttttaatagccccataaaaataagtgaaaatatctttaattttaaatttaaacaaaatatctaaaacttaaaaggtatttaatatgtcagcatatttgcaatacaaaaataaacatgctccatttcatttttttgctttcttactcccacggccaggtgatataaatatttcaatttgtgtcactttctagctatcgaatttataaagcggctttcattttctacgtaagtttttaagcttaattttttcagggaaaaaatagatctcaagaaaaaaagtgtttgggatcataagttaataactcatcctattggtaagggaagttgaataagagtccaaactaatggattagaattgtgtaatatttgcttaaccatttgttaaaaaaaaaaaacaaaaaaaaaacactgggttgccagaatcctacctaagatgcagatattaattagaactagcaagtcgaagttgcacaggtgggtataaaatgaatttgggatccctcactgggaaatgctaaagttcacacagacatatacacacacttttttttttttttttttttttttttggtggctccctcgaaatcatttgtttacagtctggccaaggttgtggcctccagtattccccctaagagatgggatctttgcctaaaagttactgagaaacgaaggctgcaaaaagccggaaaatatcccagcttttaaggcacactgacagccaaacagaacgctctttccgtttgcagtttttttagtgtcattttaagttgcagcttccggccaatcagcgagcttcatgcctgctgacatcacgaaccagccagttccctccagctgcagagagcttcagtttgtctttttttttttaaactaaaatggaggctggtttcttgccttaaggagcccattgcctttcccgctgaagtctagatgttgacatgtaataaagcgggcagcaggatggtggtggatgcggccaactccaatgggcctttccagcccgtggtccttctccatattcgaggtaagttattgtgtgtttcactgaatcggaaccttccgtgggtagttaataaatggctattgtgcttcagataagaaaagcaggaagtcctttctagcagaattcaccccatttcgctgcagacttaaccagaggaggttgggtgtgtcactgcagtttggcattttacgaactacttacagaatttgaggcttgaaagaggccttgcatgcatagttcaaagctggtttttctgctttctgctcgctctcccatccccctttcaaagctgtgctgatgtcaaaggatgtgaagtcactgcccagggaaggtattgggtgggggtaggaaggagaggcgggcctgtcgcgcctggccaagttgttcgtacgcagagtttctgttacatatgtgtggcttaatgctgcaaaggttttgtcgaggacacatctcagaattaaagatgaattgcagtcagaaaatatgcacaattgattggaaaagaacttcctttaaaaggattgttttcattcttgccgtggagcctgagagagaaatatgctccactttgaaatattgaaatctatcgtgggtcatcatttttgaaatgttagcgttttcgtggaatattaggaaatattttgcatttaaataggctctgtgttgccagttggcttttaaaattttaaatggcaacaagttttcaaggtatatagagatcactgttttaataattagtttgcttctttttatgcatattttggtttcaaaacttagcctaaaagcacaactactctagtaattaatagcggttatattgaactacaggcatcagggtagtagcctacttattcttggtattttaagatatatgaatttttttttggtcataattgggtgaaatagaaaaatgattttaagcttcatcagatcactttagaatttatagtatcagagctgtgccccaacaaaactgtttctcagaatctcttttaaggaagggtgggagcaagatttctaggtgactaataatctctatgactaaaacgccaggccagacttttcagatcctagggtgtacccaggcacatgcagactcaatctactggaataaaatgggtggtgcttttctctccaaactatctttcatgaaggtggaaatcagcattcaatgaccaaattgtaggacaggctgtgaatttattgtttttgtagtgcacccagtaaaaagcaaaggttgcctacaggtaacattcaggtattttagctgcaagaaccaaatgggcaagaacaaaatgtaattgtttggatttaagttagatagcttttgtttgttttttgggagacagggtctcactcttgtcacccaggctggagtacagtggtatgatcacagctcactgcagcctccacctcccgagctcaggtgattctcccacctcagtttcttgagtagctgagacttcaggcacgcaccaccatgcccagctaattttttaatattttttgtagagatggggttttgccatgttgccctggttggtcttgaactcctgggctcaagcgatcctcccacctccgcctcccaaagtgctaagattacaggtaagagccactgtacctggccaagttagttcttaaaaacgaactagttagcagtaagataaattaactgcatataaaatgtaaatttttatacttttaaggtatccacttataaataacataaatctttttggtttgtgttttctggtttttattagatgcctaatatactactcagtttttgaattatgaacttattctgaaatagaatcatttcacgttgtgtcttgaaccacattgattttttttttaaaattccaagaccttattatggccagtttgtatttgttgctgttggttgggtggttggttgcttgctgtataattgtggagggaaaaagcagtgaagtgtattagcctgaaagagacttgagtttttaagaagggataactttggagacctaagactaacttctgactcaaacagtgggggtaatttctaacttcaaaatttgaagaacgcttgatttactcataaagacttttctggagcgagcatgttaatgtgagatttagcaaaatttgatttatttattgggccttagagtcttagcttaacatccattgagcagctccggtgtgccaagtgctgagcgtcattacagtgattaagttgcagcccctgtcccaaaggagcgaatggagagacccagcataggagctctgccacgagagggctaaagcaagaacacaccggcagggtgcccgggagagcaggggctggtgtcaggagcagaaggaaccaaggagggctgcaccctgggctaccctgctcactcggatggggtgggcatgcgctgtccttcccgtttatttaggaaggaggggtctttcccactgaaggagaaataacttacccaaggtcacacagcctggaagtggtggagccagaatccaaacccagactgttgtgttgttttgttttggatctttttaaaaaaatcattttaaaataggaatgttggctgcttgaagaacattttgctacaggattacagtagtggtattttccccaatgccttaccatttatttggctcggtagcctctttttgtataacagttttgtaccttgggctcatttattaatcattttacaaatatttattgatccataccacatgccaggcagggttctaatgtggatatgagcaggggctatggcccagctttcccagtttaccatccatcagggtggggaccaagtaagtaagtaaggaaaatgatcacctgatttgttgtcacgatcgctttgaccattattgtctaccaagtagtctggactttgcgattaaaatggtgaatttgcacatcctaataagtttgagtgtgaaagggacatatttttgagagttagtgtaagcccttctgtctgtagaaggagagtcacctggaacttgatggctgtgaatgtagcttggtgacataaatcctcactctcagctgtgtccaggagaactgtctgctgtggtggaaatgttctgtgctgtcctctgcagcagcccctggtcacctgcgactgctgagcacttaacatatacagctgagaaagtgaatttttaactgtagttattgtaaatttaagtggacacacctgtcttgtggctaggatattggacagcacagtcgtagactggaattgttcgacttttttggaaaaggaccagattgtaagtagctttggctttgtgggtgaaagcagccatagacagtaaatgaataggcataactgtggtccaataaagctttattgacaaacaggtgacaggctggatttggcccatggaccatagttcaccaactctgttctagactgttctttgactttcggaattgcctgttaaggataggaaagcatgtttcctgcaggccttcagtctagtgcctcctccctgtgctgggaagctgggccagccgtgatgctgtgaggcgtggtgggtgggcccacttcccaccctgcagcgcatgctcacttcaggagccaggtttaaggcagtgacagccaagccggaaagatggtaatggccagagaggaagcacacagtttgagccttttccagctggcccttattctgggcttcaagaatgttattaactgctctcatcttgttctagtcattagcaaacttatccagtggatgagtctgtccttgaaagactcaggagtagctccagcctggtgggatgttggagaacaaaccattcttttgatgtaaacccattttttcttgggaagtggaagtctaatggaaaagtttattttctcacaagtacttcctgagtcaccaatttgttgaaggtcttcacctttccaataaaaactcattaaaaaacatgcaagaagcaagcacagaactcaaacccatggctttcatttcctgctgcgctaaatctggtgacttaacctatattaataataacaatagctatacataatgcacatgggttgctaaattagtaacacacctgcatggtgtgaagtcagtaagtactagtgagaatgggtgccccctgttatctttattccctaaaattaggaaggaaaaatgtttgaatgatgactaaacagttcttcaaataattaaaccagtgatcctctgaacagtgcctcagctcaagatttttacttcacaaacatctctttactatgtaactgcagctctctgcaaagtgactttatagaactacagccttaaccttacccatatcctatcctgtatccaatcctgtatcctaggtgtgaagttgtttctttcgtattcctggtggtgtggaaggtaaccaaagtaacagataactctctgaggaaacaggggtgggtatgtttgtgtaaagtctgtacacctttttgttccttaaacacacacacatttatgctcataaacacactctcatccacctccctcatccatacgctctcaatctcagaggcaaaaacaaaagcttaccatccagcttgggtctaatgtctgctcaggaggttttgccttgcagcaaaagctatcttctaaaattttctcattaaagtatgttgtgtagaggaatgaaagaaaaatagaggtaaggttattagtcaagaatagggtgtgtgtttttaaacccaggaaaagaatagacagaaacacaaagacaaagtggtttgggatacatcctaacttttggttccatatgtcaaataaaattgcgaggtggttctttttggatcctacagcactttgccaattgtgacaagctgttgtgaacactcatgtacttcttcctcacagcactcctgcctggcaggtgagcaggacaatcctagtatttctcctccccaaggtcacccagcctagagggtccagtccagggctgttggcagcaccaagtacgaggtcccgaagctgctgctggtggctgtcccagaggagaagcagcatacgttgagtgccttcagtgtgctaggtcacagctgaaaccctgtacctctgttctctctctgaatctgcccaacactgtgaggcattataaccctcccccactcactaccgcccctgccttttttgtccccccgggagaaaaaagggagcctcttgcccagggccacagagaatgtagtgaaacaagatttgagcctcagtcagtctgatagcaaagctcatgttctttgctctgcagacatcagagtgttgagagatgctggtgaaagctcccacctcataggtactttttgatttttactgttttctgtacagtggtaatggatttgagtgtctggagttcaaaactcatttcagggttgaataggagtttgttaaaggtttacatgcgtatgttcttggtgtgcagggagaaagttgataatcttacctgctgtcccagttcacttaccaaatctgccagctagtaactgttgacttacctcctccacaaaatcaggagtatcccgaggacagtcctgttgaacttgttctctggtgacactgagcattattcctagagtagaggcatcagttagtgtcagtggattaaaaattaaaagttatctctgagtgatcactcaggaaatagctatctactatatttcttttttgagttggagtctcgctttgtcacccaggctggggtgcagtggcgtgatctcggctcactgcaacctctgcctcccaggttcaagcgattctcctgcgtcagcctcccgagtagctgggattacaggtgcatgccaccacgcccggctattttttgtatttttagtatagacagggtttcaccgtgatggccaggctgctctcgaactcctgacctcaagtgatccgcccgccttggcctcccaaagtactgggattgtaggcatgagccaccacacccggcctatctgatgtatttcttagctaaatacctcatcagtggaatgagaagctcatgagaagctgtactttatttttctttcaatcctctatacgctgtagttaacgtatttcaatgaaaaacatataggagatggcttttgctgcaaggcaaaaacctgctgagcagacgttatacccaagtgcaagagtaagactaccaaaaaggtgacagactttacacaaggcggctggttgaaagagcgacacaggtgcccactccactctaggccttgctcaggcgctgtttccgctccctgtcacactggaaataggaccgccaagtggtctaaacgtgggataaatcatttctctcactcacatcttggaaagacgctggctaaaatgcatgggggaaaccagtactcccacagcaggtagaagtctggctttatttgaggcccttgaattacacataaatcaaaaactcttctagtttaaaaaagaaaaaagactaaagagatataacaggtaccgtgagtgaatctagatcagatccttgttctaaaaagtgtgaaatcaaacctattagagacattttgaaggcagctggagaaagtggagtgcagaatgatgttggatgtgtggaattactgcgaactttctaggtgtaaaaaggtgtccaacttttgtaagggacttttcttattcttagggaatgcagaatgaagtattaataagtgaaggatcgtgatctctgcaactttaaatggtaaagagaaaagtgggtaaaaagcaaatatgtcaaagcatgaacagttgttgaatctagctgaggggatatacaatatacaattattcattgaaattctatggagattttaactttttcataatgtttgagagaaataaatatatatatttatttatatatatattatatatatattatataaatatatatataatatatatatttatataatatatataatataaaaatattatatatgtatatatattttttttttttgagatggagtcttgctctgttgccaggctggagtgcagtggagcaatctcagctcactgcagcctccgcctcctgggttcaagcaattccactgcctcagcctctcaagtagctgggactacaggcacccaccgccacaaccagctaatattttgtattttaatagagatagggtttcaccatgttgaccaggattgtctcgatctcctgacctcgtgttccacccgcctcggcctcccaaagtgctgggattacaggcgtgagccactgccccaggatgagaaatatatttttaaaaaataaggctgtttcgctctcttatcatttcaatattctctggtgaaggaaatatctttaaaaagggtctgctttggaaaaaatgtacaaagaaaatgtaataacttagctactgtttcctaagccatgagcagtggcctttcatatttgagtctttgccagccagtgttggtcctctggttgtaactcacagtagctgcacagacggccacaccatctgacaaaacagcgtttttggggtgcataaccgtttttgatgtttattggcatttttattggtcttttggagtgtaactgcctttgagccacactagaagataagataaaaccaaagtttcctccgcactttaagaggcagggtgtttggtggctgagggtaggacctggagccacacgccagggtcagatcaccccccatcccccaccccgcccaccccaggcaagctgaactgtctagggcatgtgactcactctctgtttctagaaatggaacgtgaaatgggaataataatacaacctacctctttggggttttttgaaagttaagtgaatgcacataaagaacttaaaatggcgcctggagtgtcgtgagactcagtgctcatggtgtctgtggttgtctctttcgtaggtcacgtatggtactctagggccccgccacttagccataatctgttttctttttctccagctgtattatctgtatttgttcatctcaaagctcatctgtctctctctctctcttttacccagccttttcatctcttgcagtttgcttggcatttcaccatttggaagaaattagtatcatcagtacctctggagtttgcactatgctctgcttatagattgtgtatagttacctgctaagatggtcctaagcacatgtccacggcctcagttcagagtatacttaatgctccctattcagtctttctgttcccgtgctccagtccgtgaagtctagagtaaaataagaaattggcatttatatacatctcccctcctcatctttaactcttttgaagaagagagttttagtatcacattcataagaaatttcatctttaaaagttggtattacaggcgcagtgcctcacacctgtaataccagcactttgggaggccaaggtgggcagatcacctgaggtcaggagttcaagaccagcctggccaacatggtgaaaccccatctctactaaaaatacaaaaattagccagcgtggtggcgggtgcctgtaatcccagctactagggaggttgaggcaggagaatcacttaaacctggagacggaggttgcagtgagccgagatcacgccactgcacaccagcctgggcagcagagtgagactctgtctcaaaaaaaaaaaaaaaagtgagcaatatctgtggttaatctcaaatagggtggctttccgtgtcatttccctttagttgtttttaaatgcagatgttgctttaattaaataatatttgaaataagtggggtcccaactataaccttatatcttattgtttttaaatgttgatattttggtgttttcagtagaatttgagctgttaacagtgattaggttttttcagtttgtcatcgatgtatgtgacctcgttataatacacatggatttttgtctgctggttgtgttactcatgagcaatgtgttctaattatggtattttaacttataacttatgaaaaagttatgtttcactctagggaacaagtcctgaagaaccctcaagccctaaagtaccacctccacttcttcctgagttgctggttcttatttttggtgggcttcaaggaagaggtgggtggtgagggtgtctgtatatgtgtgtttacatttgtagacagtttctgtacatgtataattaggaatgggttgtcggttttggtttttttcccagctttatgtaattggtcagacttctcaaaggggggtagcacttgataatcgctctcttggaactctgaagcctttgcatggagcagtgttcaccctgggcagcctgtggcccctggggtcacagagctgctttccagggggtttgcaaggccgtcactgcctcataagattaccaagatctaatttacctctcactgtgtggacgtttgccctggtggtgcaaaggcaatggtgaggaatatggcgcctttctttcatcgagcaggacagcggtgttcagctagcaacacaccagtctgacccaagaatgtcctcgataaagcatgaagttactggttttttaagtctcaactcttttgtatacctttttaattttgtttttgtttgggtttgtttttagttttgtttttgtttgggtttgtttttagttttgtttttgtttgggtttgtttttgtttggttttttggttgctcaggctggagtgcaatggcgcaatcacagctcactgcagcctcaacctccccagctcgagcattccgcccaccgcagcatcctgtgtagctgggactacaggcaagcaccaccacacccagcgtggttttttgttgttgttgttttggtagagctggggtctcactgggttgctcaggctggtctcaaacccctgggctcaaatgatcctcctgctttggcctcccagagtgctgggattagaggcgtgagccaccgcacccagcctcctttttaattttgcgtgacgaaatgcagagttcacatgaagccgttctagcatgctggagtgtgatggccgtctcgaagaaaagcgcccatgtgatgtgtgagttatgagccaaaatagccactttttccaggaactttaaattatgagaatagtaatgtaaaatcatttttacttgacagaacaaaaagcagacaaactgtggatattaagacttaaatatttggctgatattttctagaaaatctatgaagtgagcttatcaattgaggggaaaacaactgcgacactgtttttggcccatggtaaaatttgagctttcaagaaaaatttgaactttggagaacttttatctgccagtgtaaatgtggcagctcccagtgccacagactcttctgctgagaggggtggtgacattagcaagtggggtttcttgatgtatacggtggaaggtcacacaccacatgcagcagtgtgttctcagtgaccaacgaacgatgctacaaacaagcgtgggtgaagagccaccaaagtgtaagacacactgccgggtgttcatgtaactgacaggttcatcaacatggtttcagattcctcattgcaactaatctttaaggaactatcacttgttgaattttagcataggcaaagaagaacatcggcaattttttgagaagcattgaaacctcccttttcccaccagacgtgtctgtctgagcctggggtgtttctttacatatacttgaaccagaatagcatatcacagcaagttgaacacagaagcatgtcggcagatccgcctgtcttctgttgagtattgaagatacatgcaaaaatgtacaacatggccattttctcgctggtttctttttgaaaataaggttattttcataaaatattacttaacatgaagtgaacctattgctaatttaatgaataagtaaatatttttaaaattttcaagtatggtcagtatcaatggatataacccccataatcaaagctctttagggttctccatactttctaagaatgtaaataggtcttgacaccaaaaaaatggaaaacacgtggacttggaagtttttctcgaatgggctggatgtgaccctgaccctgtttttaccaagcctccttggttttttccctcttttctctaaaaaaaaaaataaaataaaaataaaaataaaaaaaaattaagtagtcagtggaatcatctaaactggtctctgggaccatgagagctgagagcatccggagcccacctaaccctgagccttcctcttgccttggtcagtttccttctttgtttttcaaatctttttttaaaagccattttcaagtaatcaattaatatgtgaatacggccccatttacattttttcttcattgcaaataaaactgaaattttccctaaccttatcccctgagattggtctaccatccccacatctcaaagtgactgctgcctggagtttgctgtgtgtcattccagaccattttctccctgtggggggtgtgtgtgtgtgtgtgtgtgtgtgtgtgtgtgtgtgtgtgtgtatttatccacataaataatataaatatgtatttattcacagagtatatagcattttttgtttcatttctttaaaaaattgacatgagagcagttttagtaacaaaaaccttttatacgtttttaggatcttggtggcgctctcggttcataatgctctgagttggtgttacgtcatattatcctgtattgtactgtgtatacatacgttacgtaaatgcttaatgtggtctcgcatgtttttctgtgaatttggcttaaactttcagactaggcatctaggaggtggcggcaagtggaaggtggagctgtcacagacactcggcccccgcagcctgtgcataggtgctctaggctaattttacaggtgtgatgaccgggccagagtgaaaccatgttgtctgattttagaacagaggtcacttatgcttcaccaagctgctggaaatgtggaattttgtttctcaattattggacctggtcctgaggagatgtttccctttagagaacatcattgacgcttttaagagtattttactagatgttgaaaacgttgaggtcttattaatgtagtgaccccaccaccaccaccccctgccccccccccacacacacacatcccttgctaaattattacatcaaatcatacaggaatctggcgctatcagagccagggttaaggcctaatagtgtcactagttactgagcttcttgattaagtcaccttactttcctgaatctccaaataagttacattaaaaatgcatctgattaaattacttattttagagggaattggaagaattctgtgattggcgttccgatctaatcccccaaagagaaaaacacgaacgagaatgaacacatttctccttttatattattcttagttaagagaaatgctctgccaggagaaaacttaaatgactatccaatgggtagggttttttaaaagaatctaaccaattcagatactttttctttttacacagtcacaaatgatgttatgttgatgtgtttttatgacttactcttaaacaacatttaaatttaagccaaagttaaagttgtgattttgggaaatttttttacttatccttcctctcttcccgacttccttcccttaagaaccccattcttattttctcatttatatcctggctgaggctatcaggtattgaaactggccttttgaagacatataaacttctggggactgacttttctcattcaaatagtctaatatcagtggatatgaattctgcatttttttacttctaaatcttatgcgtcatttaaatgttaactttcaaaatattaatcttgaattttcacatttttgtgtgagttggaattattatccaattaaatgaacataaattatactgcctacatagattggaaaaatatcttttggtgggccgtgtgtgtatatgcacccatgtgtttatgtaaaaccaaacatcaacttacaaaaaccagttcagtcttatagccttgtatagtgtaacatacgggctgagacatttgcttatttgagccttttcaccctttatttgtaaaaaggaggagagcctttaagtgaaatgtaaactaaacttggaacccctaaaacgattttgaacactacttgacatttaaatgtttattaaaaataaagcaaagtttaagaagcatgtttggtaaagagttctttggcaggaaatggggacctatcagccaagctaatagccttagctatggcatccatagtaactaagacacgctgccgatgtaaatatttatgccagcaagcagtgctgcagaacccgggccgagcagttcagagcagtgaaattaaagcatcagccgccaatgtttgatttattttgtattatccggtattccaagcattaccatcattcatctcttctagggtttttcaaaatagtttagccctaagaacaagaatcctagaagaccagtttactcggagtaattcggtaccctctcccccacagcatgatagatacccaaatgagaatagagaggctgttattgtttgtcattagcaccctggaacctttttcatcttcaaagctcctcgcaaaagggttcattaaccgtcgccctctttcctgtgagagagtaaacaagtatgattagtcctactttgacagcggtggaaactgaagcagagaggttctccaacttgtctgaggtccaagaaggagctggtgacagagaccagataccggaccagcacttgggttttctgactcacggttctgggctcacccctctctgagcatgcactgagcctgctcttgcaggtttctttatcacagggatctatctacacggtactttctgctctcagctttttacagtggtgtagagtgcagtgcagctgaaaccaggttagttgatcttatggtgtcatctagaaaaacaagagatgcagattctgggtcacgaaggtaaggttgtacttttagggtttgtggttatggatgaaattaacttatctgagccttacattgtctcactaggcacagtgcccacttgttccgtggcacagccccagagctcctgttgaaggaacagactccaggactgactttccacttgattttcggagctcgcacatcccgagagattcatgttcaagctgcattttagacatagctggcaagagtattttcgtggtaaacgtaaacttactattggtaaagattcttaatgagtaattcttaggatttagtacaaaattagatatattctttttattcgtaatgatatagcatgaagttcttgcggggtaggagagagaggtattcatctgaaaactggctctgttttagtgtagacatttgtctacggggaaacagtaggaaagcatcaagaaatatttcttgatgtgtacaattgaagtgatgtttacaatgtagtgaaaaaaaaacctatgcacgcatgttcctgattttaataaagctctgcaaagatttccttcctcattctttgcttttgattcagcatatgtgctgttgctaagttaagtgttggtaaccctgtgtcctttgttgggccaaacaaggttaaaattaagacgaaaaaaatttctgagttcatttcaaatggaaggacaacatgatacctaacacagaagagaacaaatttagttttgactttctgccctatgtccacctaaagctgtatttcactcactcactaatatttagaaatcacccacttggtggttggctctgtgcttagtgctaagaactggtcgtgttataggtgctgtgggtgcgtgtctgcgctggcttcaggaggagggagcaggccctgtggggcccagcaaggcctcccaggagaagcagtgtgttagctgaagtttaatgaactaattggtggtcctgggatgcagttgggaagatgggatgattcagcctgttggggtatgtgttgggggtggttgttgcactgtggtgagaaaattcctggaaaagggtgtatgtcaaaagggtgtaagtagcatccctttatgactgatgaaaggagagcagccgagagcagttaagtggaaggcaagacgcagcagtggcttctcacgccatcttcgtcactacacaaggggaagttgggctaagaataaatttgttttggttccaggatgaaactcaagagatacagaagaaactgaaagtgatacttttggcagagggataggataagagggttttcagcgtgtgtgtgtgtgtgtgtgtgtgtgtgtgtgtgtgttgatgaatttattacttattaaaaaaatgtaaagaaggcatagcattaaaagtgggagacatatactgataatggaatccgggcattgctatctttctgtgtcttagaagttactgctatgattttagccacttaactggctagaacagttttgaaaggccaagatcatgggtttaagatttgagacttggccaaaaggtagctttcctagtccttatcgtagagtgcacgctcccagcttttgcccagcctatttggggtgcacacgctcatcgatgagggcaacagaacacagcatgcaggcggaactgtgcaggtcagtcaccactccacctcctagccagggtgtcactccaattccatcattcaggtttcactgaactttcatgttggcatttcatttagttgaatgaaccagttttgttgtatttcagatattctcactgtgtagttagcctgttcagtttttgtaggtgaatggtaaagctgtcaaaaccagatctgctgaaaaccaaaatgttcagtgtcatcttcagcagaggggattatcagaaacttctggggcagtaagggaaatttaagaaggaagttggggaaggtaggacctcatggctttggtttttctggtggtccaagagaggaggcctctagagaattgagggggaacaataagtgacaagcatgaagaatgaagagggaactgaccaaggatcggtgagaataggaggtggcccagagggcatggtcagatgtggctatcacagctgtcacagcaaagtctttatgtactccgagaaccaagcctttatcatatatatgttttgcagatatttttctcatactgtgggttgtctttttcactgtcttgatggtatcatttgcagcacacgtttttaatttagaggaagaccagtttatcttgatttgttttctgtctcctatgcttatggtgtcatagctatgaaaccattgttgaatccagacttactcttacacattcttctaagagttttttaatatgaattctcttacatttggtctttgttccatttcatgttagtttttatatagggtgtgaggtaagggtccaacttcctttatttgcatgtgaatatccagttttcccagaaccatttgttgaaaaaacaattatttccctcattgaatggatttggcacacttgttgaaagtcaatggaccataaaagggtttatttctggattctctattccattggtctgtatgtctgtccttatgtctgtaccacactgtcttgattactgtagctctgttgtaagctttaaaatcaggaagtgtgaactctcctactttgttctttttttcaaaattgttttggtattttgggtcccttttggtatattgggtccattttattcaatgatgtaatgatatgtgtgtttccatatgaattttaggatcagcttagcaatgttccttgtctctttcttctaattctgtagcctttcctgggttagaatcagttagactaggactaggacagtgctccctggaatctgcccagtagctgctctgactgtgagcagagaacctgtgggcatctgggcacttagtctgaaatggtccataaggaacccctaaaatgtttaagtttctgaaatccctggttgtattgtaaaaagctatttgaatttagtattctgtttcatgattattatacttaagtgtaaaaatgtttaacttttttttttttttttttttttttgagacggagtcttgctctgtcgcccaggctggagtgcagtggggtgatctcggctcactgcagcctctgcctcccaggttcaagcgattcttgtgtctcagcctcccgagtatctaggattacaggtgtgtgccaccacaccctgctaatttttgtatttttagtagacacagagttccgccatcttggccaggctggtctcaaactcctgacctgaagtgatctgcccgccttgacctcccaaagtgctgggattacaggcttgagccactacacccagccttgtttaacatttttcagctgcatggaaaactgatattctaggatgtatattgcatttatcatttatcctgtggctttatgcaccctccagaatgcataccccagcataaaaggccaagttagggagaaacctgcctgctggagttcttagatttataaatcttgtttccttaactgtctgccctctgacctctccagaccacagccagcagaggagaactaatgggcagagacaacactgatctgctgccatctgcactgggcaagatggcctcacctgactcacagctgttgctttctctcgcgaagcttctaccattttctgctgattcttaaaatagatttggatcttgtcaattttggtcgtcaaaaagattgaacttttacaggatgaaatccattattttcctaaattatctcgttttgggaaatcagttctcggccataagtgcaggctcaggtgtgctaaggagggcaccccagacacctgtgctgctctttgacaggacttacctgtcaaaggcgaaaataagggtgatgtcatgtgagttttccattaagctaaatttattccatgtacaggactatcttttattctgaaattgtcttcttgttccctataacctcatattggaagtgagatactgtctttttgggtattaaaatgtcttttttgtaggatcttttttttactgatcttatttgtatgttaggatgatagcccagtgtcagtcctcaggattctttatgaaatgttcctagtctgtgaaattctaactctacaatttcagtttagaccacaaatcccagatttttaccttgtttacatttgtagttaccacataatattgcaaatgatttatgtaacctcaaagcccatttttttattcttttcatgtaaaatgtccagaataggcaaatccatagagacagaaagcagattagaggttgccaggggctgcggggagggaggaagggggagtagttacttacagggatggggagttcttctaggatcatgaaaaaggtttgaaactcgacagagggctgattgcacaacattgtaaatgcactaaatgcccctgaagtgtacttgaagtggttcattgtatgttatatgaattttccatttttttgaaaagcccattttattcagtgatataatgatatataagaagacctgaaggtgtagggggagtgtcgtattcagaggatatacatcaaggcaaggatactctgtatgcttgtacacacacacaaatacatatacacaaagaacatacctattattaatttctgtttctaagtatgatcattagaagctgattaggtaaataaactttctgctttgggacaagcagaaagatttaattaacacttaactgaaattcacagatactcttttttttttttttttttttagacagtgtctcactctgcctcccaggctggagtacagtgacacgatctcggctcactgcaacctccgcctcctgggttcaagcaattctcttacctcagcctcccgagcaactgagactacaggcgtgtgctaccatgcctggttaattttttgtatttttaatagagacggggtttcattatgctggccaggctgttctcaaattcctggcctcaagtgatccacccgcctcggcttctcaaagtgctgagagtacaggcgcaagccaccgtgcccagcctcaaaagatattctttttcttacctcaaaaactatgttttccaacttttcacagtggaaagttgaagtcgtgaaaatatcctcaggataaatctgaatcgtgtttcttttattgctgagtctggttggcgtgttcctggtatttagtggaactctggtcaacacaggctgaagttagtggggttctctctgtggggttctaaccttgaaataggagcatggggcttgccttccccttctccattcctccaagaaagagaaaggaaaggaagagaaaagaaaaagcatcctgtattatgtgtaagtttgtaagaatccttactatgagttctgagtacaacatctttttaactcttttctctccctctcctgcttccttcttcaatctccagctaccattcatttcctgatttcatttataggtcttaccaggcaagaaggccaagcagaaggaacctacatcagggaagtgctgggctacgggccccacctggacttggggttctgggcagcctgaacacaggtttcttagtttcctgaagtaattgagcttgttgccttaacttcagttaaaacactgatcgtgctttacttttaactgagcattgagacctcttataatattccataaggctggatattgttttgaggaagacgatttttcctcttaaccttgcctctgtgtttgtgtgtgtgtttggtcggtgtttagacagttttccatgcatggaccctgattacagcgggagcaggcaacgtgaggtgcccgcaatcagacatccagctccacatggtggcctccctgcccccagctcatccttacgcagtgccttcaaattgagtgtcttcaaaggtgctgcttagtctcactttggttgttgtgtcgctgtcgtatttttcttttttcgcagtattgaaatgttcactcctagggaccgaacactggttttagtgtccatagtggcaaaaaaaaaaattttttttcaaaacttgtttctatttggtcctctgtgacccaagttgttgcttagctttcctgcctagtaagagccagaaacgagattaggacgtgaatggtattttctgaaccctcagagtgtgtacaataccattttgtaaagaaaagcatctatattcaaggtagatctaaataattcctagaaatgccaaattgttctcccattcatttttcaagacaaatatgttctaatccataggagagtgagaatttccaagttcattaattcgggttcctgttaccaactcatgttttacagcccatatgaagttttgtttcactgaaacctttgattatcacaagtagaacttgggaactctacactgctgtctccagacaagacacagagtttcacttacattaacaaaggatgatccattcagaactgtaaacaaatgctacattgtgcccttggtggttgtgacccgattcagtcctgctttgaggctgaggacagccaagtgttggcccaaatcagcataaatcagagcaacagaaaatccacccgaggtggggccctggattggacgtgctttggacagcaggtccacagcctgcacctgaatgaatcctgaggcgggcttctgactctgctctaaacactcatcctgaagtgtatctggatcattttaagtaccactctagcagtggtacttagttacaattaatataaacatgtcattccattaaaagaaacctgcagcttctgttaagttgggtcaaatataagatactggggtttaaagatgtaaatagaaaattcagtttcatccagcaaggaatacagagaagcagcaatagagcctgccagccctcggggagcttgcagtctaagagaacacaaatatgtataatttaaagtaaaatggaagtgtcactaagcgggtgagaggatgcaaagattgccttcagttagagtgataagtaagttaccgtcacggcagcatttgcaggtattggagctttattgtaagtttcttcattcagcaaatacttccgagcacttttgtgtctgatcctgttatagctggtggaaaattatagactaacaacccatgtgcaaatgacaacatcgtgtggcatgtgcagggctggcagctacatggggacattaacagagcccagcagaagggcacctcactccacacctggggagaaaagaggtgtgctgagttttgtttatttttttatttgcacttgttttaccataaatgaaatatgacccttcttaatatgttatctgtgatatgttggcatggatatcttaatgtataaaacatgcttatatttatatatgacattatgtttatttttggctacatccagaaaagaatttgataaggcttaaactattaaaacatgtgcaacaggctattaaaggaaacaaaataactagaagccagttaggaggactagttcagcttttgaatggagctattcaacagtttcagaaattttttttacgctactaatgggccagtgggcatagcatctttttaagcttccttccagtttgtggtactaaaaccattgcagatgcataaaggaagatgcttatcatcctgtctgagttgtaagatgggacacaactccttatcatagtacattccttaaataagtacaagaattacagttgacccttgaacgtcacaagtttgaactgcacaggtccacttatatgtggatttttttcaaccaaatgcagattgcaaatgcacaagattcgagacctatgtatacagagggccaacttttcatacgcacgggttctgcgggccgactgtgggacttgaatatgcgtggatttgggtaagcgtggtggtcctagaagcaatccccaacatggaccactgtagtctgttacttacattggctttaaagttgagtttaacttgtccaaagacattgttatttaagcagcaatattatgatacagctttgaaggcaaaacttaaaaaagaacccatggatagccttggaaccatggaaagattctaaccctgagcttctaaatagtattgcatttgtagaaccaaagactagcaggggatcagcaaaggctgagagcaagtggtctgtatgtcctcataatgaaaaggagcagaacagaacaacagaggtaaagtgattttcttgctcctcattcaggtaatcattggagatttgttcagcaataatagtcaacatagaaatctacagtgtaggccaaatagaggatttcttgttatcttctttcttcgtactgtgggatagatagcccaggattcctccaagtgtggcaagtgcacaccactgctaacggcagttattttaagtgattcagagttgagtattattttactttaataattatatattgatgaatgtgaaaatatataattagcacatcaaatccatggtttcttgggttattattgcttaggacagggcttagtaaaaagtgtatccatttaaagcaaaataccaagtaaataagagcctgactgtacacagatttgtgacgatcttgaaggtgttcatgcaggactgaagtacgggaaaccccagggtgggcgactctgggttccacctggggaatctgttccgaagacaccttcccatctctttcttgggttacaagcagtggagacacacttgggcttgcatagatgaagacaagtgtttttaaggcacagtcacagagggactccacacagaggagcagggtggagcgggactgtggaggcagaagggtccagactccagcagcgtgagtgacccctctgtgtcctcatccaccccgccactcccagtctttgcgtgtcatgccccttcttccccgcgctttaccgtgtaatttctctgcatgctcttctgcatttactcagtaacataatacagttagcagttgtgggacctccagcaagtattgaactgttgagtggctgttcttcatttggaaaatgggagtgataacagtttctctctcacaggacagttgtggatagtcagggaggttgcagtgtgaacactaggcacagcatctgaaacgtgctggaatcagtcatgtccacactggcagtgattagatctgcctgattcttcccatgttccgtctagtgagaagtcgtcagtagcttcagttttcaggaggaaaactttgacttggtcaaaactttgtccttgatcaagttgtttactctcacgccaagccgccctggagtgtggtccaggaaaaacatgggcgcctaggtccgcccctcggccagccgtggccagaggtcactggtgctgctgttcacatggccggtgtcagggttttaattcgaggtggagcttcccagccgttctggtaatgaggagtcttgcctgatatgtcttggccagctctgattggtcaaatgtttgaagaagatagggttaccaaagattcctagactctccaagtttggcagaagttgttagaggatcacacagttacctaaaatgattggtttaattatatggtttgatcattcttcagaaaccaccaccttgggtaaaccattgttcttaattttcccttcattttttgctctcattgtctggccccaaagacacacccccttgcgattttgtaaaggatgcatttcattgagaggacacagtatgagggagcagcacatggacctaaacttgacttccaccacccccagccagatgaattgctgagtcagttcactgttccaaaactgttttctcaaggcattatggtaacaggccatgtgaaattccctaacatgactaggggttttcacttcccagctttattcaatccaagggtttttttggcattttttgtttttaagacggagtctcgctctgtcacccaggctggagtgcagtggcgcgatctcagctcactgcaacctctgcctccagggttcaagtgattctcctgccacagcctcccatgtagctgggattacaggcacccgccacctgccaccacgctcggctaatttttgtatttttgtagagatggggtttcaccgtgttggccaggctggtctcaaaactcctgacctcaagtgatccacctgcctcagcctcccaaagtgctgggattacaagcgtcagccaccacacccggcctgaatcagttttgacattgtctcttcctctgggtggcaaatgtgatccattcaagacagattatatcccatgtgaagagtcaccctgagaatttgagcagggtgtgctgtgtggttacttggactccagacccttgtctgcagaactggtgggaccttgactgggtccggttctcctgtctgcacatgcaggccatggaggtgctgaggttgcagcagtgacggcagcactgagggtcagcttcagggggaccctcttcaagccaaacaaaaagtcttctcaaaaaatggaactaaagatggtcccttgatgtggcgtctcagtacggctgctgaggtatctcacaaggccaccagcaagttaatctaaggaggcattttcctcttgtgatcaggcagctgttccagcagaaatggctcaaggagaaattctcctcccagattcagtgtctggtgggtgaaacttcactggtgcgttgccagccctggcctccaaatctctttaaattatgaggtcatagaatgcatgcttaaagccccaggcctgtcaagtcgcttggggacattcatactgaggatttattaagatattaatttggttatcaggagtctggatggggatgagaggaggggatctttattacatgctgggaaaatcagaaatcaactctaattgactacctctactctttcctctcccaagatgactttgccaaaaagctgtgagaaaaagtcctcaaatctcagagattgacttggtacttgattatatccagctcgctggtgggcctgtggccacagagcctcagaagaaggttagaaggtctggccagactttagctttgctccacctacttggcagggtcaagcctacttgccagtggcttggagaagtgttttgttttgttttgtttactttttaggagtgtattcaaagcacattcacagtaaggaaaaaaaaaatgcagcctgtgtcttcagggactgggagtctctgattccagcacagccgactgtccagcaaccccagaattggtaggctggacactgggctgctcctcatggcggtgggagcatgggctgctcagctggggccatccaaggaagcaaagatgtggtgctgtcctgtggctgggggagcaggatgaattgggataagggaagcccagggcagggtgttggcacagagctgggaggtgcattacaccgaggaactgacgtggcctaaactccacagtgacttccacctgggatcacagtttacagtcagctgagtgctcaagagaactcagtagaggggaatgttgatgattcaggtatttggttggtgatcatgttatcaagtcagacttgcagttaaggtagtgtcccagacgtttgttcagagggctccttcccacttgtcatctgtaatactggctaatgggaaacctggcccatgtcaaatttgtattaggaaccattgatttcaattcacgggctttttccattgaggaatttaaaggtcttagaagtaatattcttgttaaggcatctgaggtctcccgggggacagacacagtcttcatcttgagcaggaacggtgagaccactcttctccctgtaagggaccagtagcatgtgtgggaccacgccgcctgcacagccgtcccctcacggggtgcctcttgcccttgcagatcaccaggtgctccgagctgccctgcctgggctcaggcatcagcacggtcccatctgagcgtcgccttaacctctctgtagacctctgtccttgtctatctaatggggatgatggtagcccctctgtgtgttcttactaggattagtgggctgggaaaagttacagtaatatattaccagcatgtagaaaatacccaataatgatgaactattagtattccttaaaagaattaaaagtgaaaatagtaggaaacactagtaagataaaatacaatgggaaattaaatttttttaattacttaaggaaattcctcaatccacaagcaacaataaataagaaactgagatttcctagcagctgaaaggtttttttttttgcagttgaggctgtgaagctgggcagggtttcagctgagctgaggttggaagtccctgaccttcagctgtggccgcctacggagcagcagggagagcaaacccatggagaaccccgcggcccccaaagcatggacggagctgccagccttctcccctgcccttcttcctctactcccgacctgccagccttctcccctgcccttctgcctctactcccgacctgccaaccttagcctaaaatcagagctgctagaatcacacacactgtcgtagctggttttgtattgtaaatgagtcattctgttattttggaaacttatgtctcatgccaggatctgcagatagttctttttcaaaatattgtttagacaaaataaatttctttaaatataatatctctactttaaatgcctggggtgttgcatgcatttttctaggctagcaaagcttaaagattatttctataatttcagttacatttacctttatagatgggttactctaagtaacaaattaaacacacatggatcttctaactttggctttaaatcctaagaagagataggtaatatataaaagagtattaaaaagaaatggagagtaaaggtatatgtcgggcagatgcagtagaaaagcaagggtcatgacgtcaatgctgggcaaagctaaattgtgaagacaaaacaataatgaaacagggttattcatcacgctaaagcgtacagtccataggatgatataactaccatgaatttggcctaaatgattgaacattgaaacacataaagcgagaactgtaggggattaaagacaaaatcagtgagtgcagtgctggtgggagaggcgcctggacttcttggcccctcacaggtcatgtggtagacataagttgttattactgtgagccagtagagactttcaggtttgatggctggaaaacaaatgctcattttataagtttttttttgttttgtgttttgttttgttttgtttttgagacggagtttcactcttgttgcccaggctggagtgcagtggtgcgatctcggctcaccgcaacctccgccccttgggttcaagcgattctcctgcctcagcctcccaagtagctgggattacagtcatgcaccaccacgcccagctcattttgtatttttttttagtagagatggggtttctccatgtcagtcaggctagtcctcaactcccgatctcaggtgatccgcccacctcagcctcccaaagtgctgggattacaggcgtgagccaccgtgcccgaccctcatggtataagtttttaaacttaatatatactagcttacagaggaaaccgatgtgatttccaaaaatttgaaataattagaaaccttattctcacattataatgcaataaaaatagaaataaacacacaggcggaaaccaggcatccctgggagtcccttggggcagagaagagcttcgtcgctcaagcaaaacttccatggaggcgaggactgtgggctttgttggaagctttatctccaacctctagaacacgagcactaagtagattctgaacaaatcttattaaatgaataagagctaataatcctaataaatatgttgaaagcactattctaagcatgtacatttattatgtcactcactcctcacagtccctgttcgaaggaggtgctgtcctcatccgcatttcacagatgggggaatgggaagggtaggctcagtcacttgccccagaattgacagctggcaagtgggagactgagattcaggctgggctgtcggacttggccgtgttctcatgtgcagaaccaccattgcctccaaattaatgaaaaaatgagataaggtaatggcttagagttaatgtgtaaagattgttattaaataagaatcaaaagaagtgatttaaacactaaagaggtagcaaagaaccaaagtaagttgaagaattactgtgttctttaaagacaaaagcagaaatgaatcaactaagaaaaagagagaatgaaaccaaagaacaggttttggaagggggcagacagcgatgaagcggggagagtaaagacaagtagacctggagccggtgtggtggaaaaaggagagaaatcatagcgtgtaagaagtagtaatcgtcgaaggaaggtgaatgcaagcgtcttgtgaatctgaaaatggcattttgtaaaattcactttccattcctgatttgtagtttgtttgcttatttgttaactttcttaaataatttcaaaagcatggaaaagttgcaagaatgatataaagaatttaatcaaaatttcacccatttgtcaatattttgccacatttgctgcacatttctctcatatgctctatatgttgtaacgagcaggcggtcttcccagcccctcctttaccttcagggccctggcctcacttcttgtccccctcgccccaggaggctgtgaaaagcaaagcactgtgcctcccaggcacatgatcttctcagaaaggaggagccccagggaaggaggaggcagcccctggcacacagcctatcctttgagggttgtgttgtcctttcttcttggttgtataaatcttcactattttggctgggcatggtggctcatgcctgtaatcccagcactctgggaggccaaggcaggcggattgcttgatgtcaggagtttgagaccagcctggccaacatggtgaaaccccgtctctactaaaaatacaaaaattagctgggtgtggtggtgggcgcctgttatcccagctactcaggaggctgaggcaggagaatcacttgaacctgggaggcagaggttgcagtgagccgagattgcaccactgaactccagcctgggcgacagagcaagactctgtctcaaattagaaaagaaaaaaaaaaaaaaagccgggtgcggtggctcatgcctgtaatcccagcacttgggaggctgaggcaggtggatcatctgaggtcagaagttcgagaccagcctagccaacatggtgaaatcccatttctgctaaaaatacaaaattagccgggagtggtggcacatgcctgtaatcccagctgctcaggaggctgaggcaggagaatcacttgaacccgggaggcggacgttgcagtaagccaagatcgcaccactgcactccaacctaggcaacggagcaagactctgtctccaaaaaaaaaaaagaacactcatttccagagtcaagttacgtgaccacaggtggcacagggcctgtgagaacagcctgcgacgacttcctgccagtcctcttcttccccatctgtgcccctactccacaggcacctgtggacaccctgacctgagctggtgaggcttcaccagtgcacgcctggctgcttccctgcctgccctccggccctgtgatcccatgtcctggaaagtgtaaactctttacaaaattccctgtcgttttagtgaggtttcagaagagagtagactcagataaatgtattccatcctccatctgtaatcataaagtaaaacattatttgtgatgtaatgcttttaaagaacaccatgagaaccctgacttgatttattgaatcgtagcacacatgtccagtgaaatttcaaacagttgacaatggcattacctatttgttggcatgtgagacatgctggacacgggggtgtgggtagagaacagaggagcccatgaagcctggctctcagtggtgcgctcgtccgcacacactcggagatgccagcagtgttctctctgggttggcctttcctgtgttgtttggatttttttttttctattttacagtgagcatgtattatttttctgaaaagaaaattcttcaaaaataagttatacatgtttacatatcacattagccattgaatactaagttgtttcatgtaaagaccagtggtcactatacacagagcgaaagatttcatttataggtttttatatggtccttcttgtagtgcccaccttgtaccttattttcctggattaaaaaacatacatatcacattattcttttctctgttcctgtttagagaccctgttgtattttcattttttccccctctctgggatttgctgctggcactcaagttcctgaaagaagcattctctcatagtctcaaaagagtcagaaagaacctcatttttcaggtgtagaaactgaggcccaaaaaggtcaagcagctggtcacggctagttaatagcagccagcgtctcttgcctttttcgtccgcttgctgctttctggtttttatcttcttacccatgtgagcttccagcaccacctgctccccccaccaccaaaaaaaaaaaaaaaaaaaaaaaaaaagctccactccaccggtcttttataacctatcaaactttaaggatatttttccattcaaatctagttatgccacagattgataatactaagatgtttgtgaactcaccaaacagattggcccccccatgacctagtgggtacatctgtagtaattggatttggggttcattcagcctctttcaaccaacatttaagtagttcctattgcactgccctgttacaagatcaagaacagcaaagcactattgctgtgctgtttatcagggcatatgcataattgtgttatgcagaaccagacattgtcaaattgagattccgcctttcatttggtacaaatttagttgctgagtgcagtgcattagaggcctgcttggacatgcctggagaggatgaaaatgttgcttccgttggttgcttccattagttgcttctgttaccatcaggagagtaacaagattgagttatagatgctggtaagtcacttgatacatcattaacaaaaaacaaaaacaacatttattgaggacatgctatatttcagggatttttctaagcactgtacatctcttaattcacatcaaccccagtaaagacaatattcccattttccagttgagaaaactgaggcccaaagagatcgttttctgcccagggtcactaaggtagtcagaggtggagttgggactccagctgggctttctgcctgagttcttaacacctttgttttactgctgcttcctgtcttcgaggctttacagatatttgctaaatgaaggattcagagttagaaatgaagggggcgactgtgcctagtaatggcctcagagtgctgtgccttgagtgtttttagtttagctataaaacttggaccatagggagcaagtcctaggaagtactgtgtacagaaaagtagactctagaggacagcctgtggaggtttccccaaatgccaccacctctcagatcacccaactgagcttccacattgaaagacacggggccggctcgttccgtgtccagacagacactttcactctgtgcctccggagatgaggctccctgctgagcggtcagtcctcacctgaggaggtggggcgaggaaagggggttgcccacggtcactgtggtgttggtgttctttttgaaacgaaaccttccagtcgcagacacaaaagccgtagagagtaaggcagaggatcggccatgcttctgggaggcaggggaggggagcacctgtcaaaggggaccctttgaggccaactggggcagtggggccaggtcagggagcagggctccagggccaggtggacagccaggaggctggagtcgtgcagtccctcacaggctgccctaggcttagtctggaaggtggggagcgcctcctccttcagagaccactgagctctcagctccccatggagcttcttggcacctgatttctagtgccaccttttgcggctcctgtggagagtccagctcacggaggccccccagagccctcgttatacctgcaggttccccccaccaaaccctgctgtgtcaggaaaacagaagttcagtggcagcgcagacttatgggtagagaagggtcccctgtctttcaacacttacccaaacactagaatgttactcatttccatgaataataaaaatatcaaatctttaggtgacgtatcttctccagtggaaaaatgaaccttttagctggtaaacctcttgaataaccggccagccatattacagtcgtgttacttagggagtgtgatatgatgggccctttgagaaagcgatcgaaagccaaggtttccgggtgcagcctgccccctcaagtccccactgaaacaggaggagagggcaggagcgcccgtgggctctcagtggctacgttgcttgttggtttgctttcctgcctggtgagcggccactggagcatcctgaggaaaggggagtgaggagcaagctggggttcggccccaaccggggtgctctgcgtgcactcatcagggtccccacccaggtgtgctggtgacaggcatgagggtactgtactggggagctgtgagtcaccacctgaggggcgcctgcttctatcccagaatcatcctccaggtcatgcatctatgtccagcccttcccaggtgtggtcagtcccctgagagcagcgtggccgtggtgcctgctcacacctggcatgggtagaccagccttagctcgggagggcatggatgggagtgatgtgtcttttttctttttttttttttttttactttattaaaatactgagttttatttcgcatgtattttttttatctccccaccatttccgtgtctgatcaccgctactactatgtcctatcatacttacttaaaaccatacatacttaaaaccaagcagagagtggagttccatctttaataactaaacaggcattttgggctgggcacagtggctcacacctgtaatcccagcactttggtaggccagaggggaaagattgattgagcccaggagttcaagaccaacctgggcaacacagcaagactctgtcttctacaaaaaaataaaaagattagccaggagtggtggcatgtgcctgtggttctaactgcttgggaggctggggtgggaggatcgcttgagcccaggaagttgaggctacagtgagctgtgatcacaccactgcactcccgcctgggtgacagagcaagaccctatctaaaacaaactggcatttgggaacaacatattcttggcaatggaacctggacagcattgatcaaacatggtagggaaagttctcattctgcattataaaaaggactgccagatatcaactgttagagatacgaaataagatggaacatttttaactgtttattttcttaaagagacttcctgccctgccagagatcttgaatagccccctagtcagtcatccagaagccattcacataattgattttcttggcttccactctgaaaagagaaccaccttttgctatacttggctgcatgtttgctttaatgtcttctgcagaactaggttcttctggtgttttaggagtattttcctattttttgaaggattcctgaccttttcttgacattggtgacttggagtcttttccattctggtttgattgttgtgcatgattgggtagagtatctcgtatagatttcttcactggagatttgtcttcagtttccttatcatcatcatcatcatcttcagcaacagcaaattttacttttttctgtggaaccttgctgccacctccagggggagatcgctttccagatattctgaagagtttcacatcctcctgtctctgactctgcatcttcctccccagctactaagtgccatccattgatacacacgggccctgaaccacacttcacccacaacgccacaggtggtggtatttcatagcccaagggaagcccttggctgtacagatgttttcaaagccatcagtgttaccgtaatcggactaccttcatcattcattgcctctgcttcaacaatgcacaattcatcctttgcccctacgatcattcttaaagatagctagtgctcattttcatcatcatccatcttaaagtgattatctgtttttggtgttttttttgttttttttttttttttgagttgatggccaggtgaggtggaggccagaacgcaaagtaggttaataccaataccaggtaactaattcgaatcttagagagtggaacggtgggtatttgacaagttcgaggaggctggcagcttgcgggaggggccggagcggtctggcactggtttctctctgtctcacctccccagagattggacacacacgtgcacacagttctgatatcgtggtttctggcacgtgacatggtacccgtgttgctctgtggccctgatcccccggctgcccctgcaaggctggagctccggcagcaccgcagggcccggtaggtcctggcacacaggccgcatgctcattgggttgtgtctgtcaccgaccctccctgctgtcatccccgggctggacgtcatttgaaggaagagccaagtttcagcaagagttcgtgtctagaaggaagcacttgaacctcctctgtctgagacatggagaaaggaagtagagaacataaaaagggcctggaaaagtgtgtgtattttcagtgtatctttttcacacctctacactgctttgtctgctggtaaacatattgaaggttctggaatcaatttcaagatggaattgaaaagaacttattacatcttcttgtcaaatgttaagagctgttacttttcctgagacagtacctgcctttgttctttggataaatgagctactgcattgttggagcttcttgtcaccaggtgcagtaatattgttaacattcagtatttcaccagtcatgctagtgaaagtggaagatgaagcgataacgggctgcacgaagggtgttgagcatttagtaatcagtgccctgggtgcctgttctccccaaggctttctagaactagagtcctatgtgggaaatatggcctgtatctggaaataatgctgtgctggatttatatctttatccctaggagtttgtttgacctgtctcaacctttccctgtttaaaaaaaaaaaaaaattgaatcttccaattcagctaacaccgttgaattcctcttgttgcctgcagccggagtgaaggttcattctgaatgtgcatgtgtgtccacaggagattttacagctgaggaacctgaggctgagaataatttcatgactttaccatgttctgatttggcagagtctgaaccgggagtcagtttgttcttccatatgactccctttactgaaaaattcactgaagagcttttccgaggaaagcagcctctcctggcctttgcctatttcagcctgacttctctccatccggggcgcctctccactccactccaccccacccttccccacccattccctggtagaagctgccagtcttcatgggcggaaagcatgaatgaactagaatttagcttcaaccactgccttttgaaatgaaaaatatctgccttattaaattatactgttaatttcatgagaaagggatgatggggttggtggtagaaagttgtgggggaagtgaatactacccctttcttcatatgcaaataaaaccaggctaacaaatcagaaaaacccaaagggtttaaggtaggagcagctcaggtttgtgagggaaccccagcttggtcctggggttagcagatcttcctctccaggaaagataatgtaaccttggtacatgtgtacaacaaagctggataaaccacagcattggaacgttatggtggactgtgagccatgggttgtctctatccaaacatgtaaacgagtgtcagtgtagaaactgcagaccagccccacgttaccaaatttatacccaaatgaagtgtacctggcggtactgttcattttgcccgaaatccacccacacggagtggaaagatggtttcagcatccctggtgacaggaagggctgtgcaccacctctccgggtttctcatggagccccgccaaacagacctagctacaggcagccacatgctggaaccgggaacacttagagtgggcacattgaagccagcttgcttcaactccttcacattgggtggtacagacagacccggagggaggcggggacattggctacatttgaatgaaataacatccatttagaaacctgagcagaggcacatgtgtgcagggaagctaagataccatatctcatcacacctaaggcactgttcattgtagtccaaaccatttttaaagaattaccaaaaaaagaaaaaggaaagtgaaagatgtaacttgattttagagacattaatatgaaaaatgtatgtattagaatggataaaataagacacttgcactttgaaattaagaaggatttattgtaaatttcagaagtcatctaccgagttacaaacagtacgagaagattaacccaattttgaagttatgtaggtgctaagggtcagggtagaagttagtcttgacattttgtagatatatagaagtatttcattgttatgtttattgagctttcaagttgtagaagcttggatttatagagtaagagatccttgttaccaaaaatgagggctggcaggcctgtaccggggaaggcagagcttgtgtgtcgggtttgcctggaagagggctgagggctgggttcatgggctgtagctaagggccttctcttctgaaggagaactgcctacctctggcttcttggtttcagttcacccatgtctctcctgaacagagatcaagttggatcgctcatctgcttaaaaatcctctgattcaaatctctcttcccacagaactttttagatttttctatcaaagcacctctgactgcagagattccacagaagagaaatgcctactaagagcagtttctttgaagacctgagttttatcttaaaagtttatgtagatgttgcattctactctgatacaggtggcgttattttgatataaatatatttcaaacggtacctctcagttaaattacctgagtttgttttcctcagatggatctgttcattcagcagacatctgtggtcccactatgtgctggccagttttagatgctgaggataaaaatggtaaaaagacaaagttctcctctgagaaaatttataattaagcatccagtatgattaatgtagggtatataaattattatcaattgttctcgttttgaagatactgtcttttgaggaaaattgattttccaggagaatgcagcctgattaatatctcctgtaacttcaggcccctgtgattgacaagtgagtgcctctagacagtctccccatttagtgcagccttcagtgccttcccagcaactgcagcctctcctcagctgtggttcctgttctccctgagccttcatccgcatgtctcccagcagaattcatcacctcccatattctggtagttttcttttagatcagatactgtcttttaatgtatctatcatcagtgcctagcacagtgcctggcgtgtatgtatgggatgcgtttgcgaaatacttcctagtgatgcaggctgtgtcctcatggttggggctgctctttttttttttttttttttcctgagacggagtctctatcgcgaggctggagtgtggtggcgtgatctcagctcactgcaacctccgcctcctgggttcaagcgattctcctgcctcagcctcccgagtaactgggactacaggcacatgccaccacacccagctaatttttgtatttttagtagagacggggtttcaccatgttggccaggatggtctcaatctcttgacttcatgatctgccctcctcggccttccaaagtgctgggattactgcgccactgtgcccggcatgagccaggcatgagccactgcgcccggccttgagactttagttcttatatcccaattgctccccacccatgctttagatctgataagcatgtcataccacagtttttattttatccatttgcaagcataattactgatctttcttttaagagagaatctttatataaatagaaaaaaattagagatcacctagatccttatcttaattgggaaagtttttcaatcaaaaaattagaagcttaaattcttcagcatgacacactatgtagaggaacgttagaaagtgtgttggggggccgggcgtggtggcttatacctgtaatcccagcactttgggaggccaaggcaggcggatcacaaggtcaggggttcgagaccagcctggccaatgtggtgaaaccccatctctactaaaaatacaaaaattagccaggcgtggtggcgagcacctatagtcccagctactcaggaggctgaggcaggagaatcgcttgaacccaggaggcggaggttgcagtaagccgagagccaagatcacgccactgcactccagcctgggcaacagagcgagactctgtctcaaaaaaaaaaaagaaagaaagaaagaaactgttgggatttcgtgagtgcgagtatgtcttctggtctcaggtagatccaggtgagtttagaggtcgtcggtgttgacgcatctaaaaccacgcaggaaacggctgacaatcgtgcagccgaatgtacccctggagcagcccagggacaccccgattggcaacagcgggagttgggagaagagagggaggccagagggtgggtgtgtggaaggagactcacgtctcactaggttctttccattttcattttttagccatatgcatgtatctttagcctttgttatttgaaatataactcacatacagaagcatatgaaacaaatgtgtagtgaataattataaagcaaatacccacataaccaccattcaggctgggcaccctaaaagccccctgtaagtcttttatagttttagggattcctgtttcttcctataaatgaaattatactgaataaatcctccttatctgcccctttgatgcaacagtattttgtaaggcatatccatattgtgtatagctgtatttcattcatctctatcgctttggaatgttacatagactgcatttgcatttacctaatccaccactgatgggcatttggttgtttctagtctgagctgttaggacgttgtgctgtggacattcctttacctcggttgtgatggacgtgtatgtgagtgtcgtgaggtggtatgccaggagtgctgtcctggctgtcaacctcgtgtatcctcaacaccactgataatgcactgccccgcccatgggtggtgttcgggctccagccacaaagcagctccttgaggcactatttggtgttgtccgtagtggttttaatttgcatttctctggtggttattaatgagagtgacgagcccttcatacgtggttagccatttggatctattttgtgaagaacctgattaagactttttcctattcttctatttgtactctgaagttttcttactgagttattggacatgtttatatattctggatatgagtctattggttatatgtattcaaatagttctatcctgtgccttgccttttcatccttgtggatgtcttgatgaaggaaaatgtttaatttcagtgtagatatatgtatataatttgatccagttgcttcctttctttctttcttcttttcttttctttcttttttgtccctgtgtacctagttgtcccaacacaacgtgttgaaaggccgacttttcctcactcctctgcaaccctctgctgtcacaagtcaggtgtcgatttatgcatgagcctgtgtgacagcacagagcctggctgttttcattcatgaagctttacaggaagtcttgatttctggaacagcaagtcctccagcttggttcttctcaggggtgtcttggttagtcttaaccccttgcatttccacatacattttagaatccatgtattcagttccacagaagtgtgtgttggaatatggattgggatagcattgaatccgtaggtcagtttcttactcgggtaactgttatccacaggctgctagagcaagcatcaaatcaatggttagctagtaaaagctcccctctgagtcggggatgggtgcaaggggccgttctcactgctcctctcagcgttgcccagaggtcctggtcagcgcagtagataagaaagagaagaacaatgtggggacttgcagatgaaaggaaaaccagagggatttagcaagatagctacatgtaaaagtgatactcaaaaaccattttttctgtattgcaacagcagttagaaaattaagtgtttttaaagataccattgacgatcacatcaaaacatagcaaatacctaagaataaaatctgaaaattaatgttttgcacattttgagaagaaaattagaagactttattgggagacatttaaagagaacttgagtaattggcgaaacagtccatgttcatgaattggaagactcaatcctgccaaattcttaagttctccccagatctgtatgggaaatataaagggccatgagcagtgaaaacgtgaggagggaccaggtgcaggaatcaaccagacattaagtcttctagggctctagaaactcagactccaggtggtgcaggatgaggcagtggccaagaagagagagagccctgcctgcacagacactgctctaggacacaggagacactagaagtcatggagaaatggtcatttcaaaaagtggcatgtgaatattatctttaaaaacaaaatagaactgctgagcttttgtttacttggtgggggaaactcatcctctgctaagtttcctcatctgggacatagaggggagtggaatttagtacatattaatgatgaatcccaaatttgccccaagttgttagttcaactttgttcctactcgttttgtactaagaataaatacatttgaaagacaagatggcaccgtcgctaaatgttggctcctgcctttccgagagcttgagcgcttctttctgttttgcgtgagatctcttgtctgtgggctcgcgacttgcatagacctccccaggaccctgggagcaccttgcatggaagaatacacttggggctggcatggtggctcacacccgtcatcccaacatttttgggaggctgaggcaggaggatcacttgagcccaggagttcaggaccagccttggccaacatagtgagattgtgtctctataaacaatttaaaaactagctgggtgtgggtgcatgcctgtagtcccagctactcagagggctggggcaggaggatggcttgagcctggaaggtcaaggttgcagtgagccaggattataccactgtactccagcctgggcaacatagtgagaccctgtctctagttaaaaaaaataaaaacgtgcatggaagctgagggtgctgcttgacctgatgacgctgtggtctctgtgtttgaaacttggctgcttcagctgcttagtgaatattacgtgagtgaccagggagtacttcccacccttgtgagcctgcacattctggggtatcttttgagttgtcactgtctaggctggtagtttttgcagctgtgtctccttgctccatcggggtaatgcttatttggaaggccccaacatctgtgcagcagaaagtcctggttctgctgtctttctgcagctgccatgctgaaagttggtcctttatggtgtcttggagcatttcttttgaccaccaagacttttcatgtaaatgtgggcttggcttctttttttcaatcagtttcctatccacagtttacatgatgcctcttggtgcatagtgacaatttagtaattcagccttacttcctcatattctatgatttggtggctaagcatgtatgtcacagctctcactcccttctgtaattgaggtacatgttgctagcaacatcggtgaagttggctgtggtattcgccgtttaggactcatttacaaaagccttcactgcccagtagtggtctccaaactcttctgtccacgcttgcctggcagcaaaaacaacctccagcacacacctccactgcgtgtaaatttgtctgttgaatattagtatgttgtaatttcttgttctttgtagaagaaagtataaatagacaccctgctgttttcttcctacgttccaatcttgagtaacccccaggctcaccctgcactctagatatcactgaccagtgaaacgcattcaatttctgtacctccctgactgttgggaccaggagcatgtataaagctagacaggaatgctcccagcctactttaaaggagatctttgttaaacatctctatttatcactgattaataacaggcttccctttagtaaatacgttttttaaagaatagcacattctttttttttcttttttttcattttctttttctttttttttttttttttgagacagagtcttgctctgtcacccaggtgggaatacagtggtgtgatctcagttcactgcaacctcagcctcccgggttcaagcgattctcttgcctcagcctcccaagtagctgggattacaggcacctgccaccacacccagctaattattttgtattttttagtagagatggggtttcaccatgttggctaggctagtctcgaactcctgacctcagatgatccacccatctcggcctcccaaagcgctgggattacagacgtgagccaccgcgcctggccagaatagcacattcttatctccaccttctttctgtcattttggatgccctgggtcttttctcctcttctcctacgggttttgcatgagtatgtccatgtatattgctccggggtatgattgaggatttatcttgaaatatttggaaattgtctcaaattcacaataacatattaattaaataatgggaaaagctaaaatgatctatacaagtatgaggcatttgtaataacactttactgttacaaatcagaatacgtaaaggtatgaagcatattcttccaccacctccacccatttttgtttccccgtggtacagtcctgtcaacgcagcagaaaataagatttttaaaatatgttgatgaagaagttgttaaattaacttgtattcaaaaaaaaatggaaatatttgatagggcccaaggatgcagttttttacttttttacccaattcattgttacaggttttttttaaaacagtaaaattcttttaaaaaaaaaatagtcaaatgagattttttaaatgaagaaaagaaatgaaaaaaagagctcatgagattataatcacaggcatatctgcttatggtctataagcaaaaattctacagaaacaccctgtctggaagcctagaagaattgaaattcacttgccttttagaacagtttggatagaaattttattaaaaaccgtgttactctgctcttccttcttaattgtaataaatttgcttttgtgtttgaatgacaacttagtcttttattctgagtatcagttactgtgcagtgtttataacgcgaatgatgcttttagggcattttgaggcatgtaagagtgatttaactccactctgaatgatcccaacatccttttgagtttcagttccctgaaaagggtacatttggccctcgtgtccgtatctgccacttcatagcaccgtggccttaggcaagctgtgttggctctcgtacctgtgtcctcgcctctagatcggggtaacggcactggcttgaactgctgttaggaggatttggcgaggacatgttcttaaaggacttaactggctactccttaggagccaagctgtgcatagcgtggctcttagggagaacggtggactctcagttctctgtagtgccaagaatgtgagaatgccaaacagctccaaatacacaggctgcgacaacacacacgagctcatttaaggtaatcctggcaaattagggtacaaacaaaggtgtagaattgatgagaattgaaggcaagcaaagaggtaattccaaaaatgaacgtttttcattgaaaaagactggatatctgaatgtgaagagtcctgaacgctgtaatgacagttactcgtttcaaatagttgcacagccactgagttctcagagtatttaggaataaaatttttgttctcatggtgttttaggatcctacaggcagtacaccccactcccatggccttgcgtgtgtgcttctgatctctgaatgcagcgtaggaaacagggaaaccgtagcttcctacagaatgggtctgctcagacagcagagtctgtgtgcttgttatttgcaaggctcaatgttgggcctttgggcatatagagaactagaagacatagtcacatggcacctaccctcaaaaagcatctagttgggagtaagaggtactaagcagatagctaactgtttaaagcactaacaagtgccagatgacttgctcagagtcatacatcttacctaggcagtaaggaaaggccttgtagaagaaacctcaacaggaagttgacagtaggggcagggaagggcaagaggagtgtggaaatgctcggcaccagaggaagcagaggagctgcaggaaagcagcaacaccccgccgcccccaggacactccctggagcgaggctggcatggggcagtgggtctcagggccccagtgctcctaaaaaactctgcaggacgtgaaagagcactctttatgtgaatttagctattgctactgacctatttgaaattaaactggagaaatttttaaacatgtatttattaatttactaaaatataataaacatattacattttaacagaaataacacatttttaaatgatctagccacgttggccaggcgcattggctcacacctgtaatcccagcactttgggaggccaaggcaagtggatcacttgaggccaggagctcgagaccagcctggccaacgtggtgaaaccccgtctctactaaaaatacgaaaattagctgggtgtggtggcgcacatctgtagtcccaattactggggaggctgaggcacaagaatcatttgaacccaggaggcagaggttgcagtgagccaagatcacaccagtgcattccagcctgggcaacagagtgagactctgtctctaaaagaaagaaagaaaatacccatgttttctaaaacaaaaactaatttagtggtaagagtggcatagttgtatatttttgcaaatctctgcaatgtctggcttactaggagacattaagacaaggattcccctgtccgcttctgcattcagtctgttgccatatgttgctttggtggaagtttgggaaaacgtggttgggaagggaggagtattttagtagccttttcagatagtcgtggacatttgctttgatattacaccaaaagttagtatgggtcgtttcttaaaggaatctgtaaggtggaatctgaaaccatatcagtaaaagccgtctgtaaattttattccattaaatcaagtggtctactttgtactttgaatggctcttttgcccttgaatggtgttaacactatttattcatcatttggaaaatacttgttcacggagttatgcaaatctcctaaaacattttgcaaatctttgacacatttcagtatgtatgtcagtcagtcccgtttattcgtgtcaccactgatctcctcttcagcccagggaagatgtcacgctcacagtggcagacagaagttttccagacttcccagaatactggaccgtcattcagagcttggtttgaatttagcttcatccacttgccagcactgagtgattttctaaacctctttctttatgtctgttgtgctgttataaagattaaatggcaagaaagtgtcaatatgtgtaaagtttttaggatgatgtctggcccaggtaagcactcactaagtaatagttaccgttattgctgtttctaaattgccatcatcattaacgtcagtcgtcatgtgtgataagccttgactgtagaccaggatgagggaaatgcagtgtgcttggtggggctctaaggtgctaactctttgaatgtttggaagttaacagtcagtttggactgttacatctttggactgatgccagttgctctgtcatctagcaagcgtggacaaccacctgcccttcccatgttgtaagctgagggcctataggcagacataaggaggcatccttccccctctggtcttttttaccctgcctgaacctaaattctgcagatatcacctggtgtcaatgtgtccacgccctttccccagacatggaccttactggttgcctctcattccactgcccgacacggtgcctgtgatcattgctgctcagagagtatttgttgaatgaacacatgtagatggagtttatttctaacagtgctctcaacatggtttgaaagagttaaaaagcataaaaacttcctcataccaaacatataatatgaccagcgactagctgggttttttcgttttattttctttaaggaatagcctttgtttaccccacccatctccttttttcttgaatctctattcaaaataaaaatagaagaaagcttaaatgtgtttcacaataactttgggttaagcacttttgtgatcaatatactttgctttctgcttttcagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatggtaagtgattacagtttaaccagtgtgtcccagttctgatttataaacaggacaggccaagatctctgagcctaacacagtgctacccaggagaagaatcctcctgttccagaatttgtagttgtgcttgaagaatgaaaattttctttgtatcctggattgtaatgataataataggaagggaagtcagttgtcttctagggaccagtctaagtgctttgcatttattaactcatttaatcctcacaactaccctatggagtagaagtgttagaatttgtatttctatttattattttatcttctttaaatttttttaaaacatatttaacattaatatactagtgcctttttatagttcagaagtaaacattttgtccatccatgtgcaggaaaattctaatgatgggatggagttgaaatattgacagaaccaagctggtgtcagaatagttcatgctgattggctgagaaggcctccacctgtcagtgctgggatcaggacagcccatgctgattggctgagaaggccgccacctgtcagtgctaggatcaggacagcccatgctgattggctgagaaggccttcctctgtcagtgcttcctctgtcattcctctatcaatgacagtatgtcctgactggctgaaatagtcttatcatcctgcagttagttcactgttggttttattcagcccccagatctcagtcctctgaagtgtcaaactttacagcccattcctcagtcagtaccacctggaaacacttcattcagtgccattaccaaaattcattgtttgacgctgaaatccagttttctgttgatttttcttgaattgttgatattttatctgcctttgaaactagtaccccccacacacacacttactggggagtcagtgtggcttagtgtaaaatgttaagtccaattttcattgaactctttgttaagttactgatttttttttccaaagctatatatttcagaattgactggacttcttgacctaaaatacttttatttccttctttagtatgtttgctttggaaaaagatgaaagtaatgttcttcgttgtagttcagtctactgtgtcagaggttgagatcaacttgattgttttaacttgttgtttttaactcttaaagttcagaattcactggcatggctaccatgtagtcggcctaaggactacaaaggccatgcgggttcctgtcccagacttgtgcctgaagaagagtaataggcataaactgagcagagaatatataccctaaaaccttacctgttcagactaatgacacttggggaatagcttttttctttcattaattttaactctcaattactttggaggcccactctagccccagaatcataaaaatctctaatattttctcctattactttcataattttgttttgcgcatcacattttataatcttttttcttttaggtatggatatgtaatagttgtacatatttatggagtatatgtgatatttaggtagaagcatagaatccgtaatgatcaaatcagggtaattggggtttccatcacctcaagcgtttatcatttctttgtgttaggagcattccagtttttttgtttgtttgttttttgttttttgtttttttttatgatgtgggttagggatagaacttcattttcttttaaatttattttcttctaaaattattgaaaaattatttctccctacatcatgtattgactatttcatttccccctattgcttaatgcttccttattatgtgttcattttattttactgtatgttagatttataagtatataaattctatattaagtttacacgtgtggaagattttcctatgtttaagaaagtctctgattcccactctttaacctaagagggaagaatctacaaagaatgacaagactcccgctggcctggttcaggtcaaatgcccacccttgaaccgtgtgtgctcccgactgcttgaaaccgcctctcgtttgtatttcacagtagcagtgtgggttactggcaccacttaggatacttaaaagcccttgaggctgtttttatagattaagtcatcattgcctctcctctccctgtcataattgtttcctaacttgattctcctcctgctgtattaacttgtttcccacccaaacctcgcgctgggctccagagcgttgccagcccctgggctccctaagcagtaagcagacactgagcatccatcatgggccaggcacgttttggggtgaggaaatagaatggcgaacaagacttctgccctcctaaagctttcattttcacctaaagctttcattttcacgtgggagacaaccataaaataagccaaccaataattttcattttagattacggtgatgccgtgaataaaagtaatccagatgaaatagatagggttgcaagactgggaatgtgatttctgccttatgcccacgtgggcgggaagaaggcgcagagtggaaactgggtgatgaattagactgtcccgtgaagatgggcacacatgagatgctgtctgtggtcactgtgagagcaggggacattttctttcctttctgctctaagttcagaaggcaacatagcctttccctaccccttgtttgtctggatctggaggtagaataggggatggggacagattggatttttggttttgttgttttgttctgtagctagagggcattgatgagaagtatagtgaaagaaggaagaacacaggcggtggggtggtgcctggccttggtttgtgaccctcttgtcaagaatttaagcaaccagtacaaggcctctgtcccaagcagtgcctgggcctggtgtggcaggcagcaaaagcctgggcctgtttgtggttcacgtctgatgagaagctctgcagcttagagcccctgtgtgcccaacacttaagcagcctttagccatgcctgtttttctctttgtttcttattggggatgggggtgtgtatattttggtcataacagttttagagacattaatttccacttttttttttttttgaagaatccaaagctttatagttgttgtactcctgatgctgctacttttaagtatcctgcttattagactggactgctagatggttttttttaaacagatctactgaggtattattcacatagcctagaattcacccatttaaagtgtatgagtcagtgatttttaatatgaatatagaattgtacagccagtatcacatctggttttagaacagtttcatcccctcaaaaagaaatcctgtactcattaatagtcactgccattgttccctcctccctcacccacccccagccctgagcaaccactgattgactgttcatctctatggatttgcctgttgtggacatttcatgtaagtggaattacagaatatgtaccctttggtgtccgccttccttcacttagcataatgttctcaaggttcatccacgtgccagtacctcatgcctttttattgccccataatattccatcatacagatatactacgttttatttatccacgtatctgttgatggacactatattatgtccatttgggggctgttatgaatgactgttgtgaacattgatacgcaagcttttgtatgaacgtgtgttttcgtatctcttgggcatatacctaggagtagagtcgctgggtcatatggtaactttaacattttgaagaactaccagaccgttttcacagtggctgcaccattttacgtttgtatcagcagtgtacgggagttccagtttctccatatcctcaacacttgttatgatctgttttattacagccgtcctagtgggtgtgaagtgtacctcattgtggttttgatgtgcatttctcgacaaccagttgtgttgagcatctccttgtgtgttgtgtatttttatacatcatagacttcagacctagaaattaatggaaacgtcctgatcatctagcttgacccttttcttttccagataaaaaggcttattgggttcagagagatgcgggtggtgaggagcaattcccaggggagccagttcttggcgtgcagtttcccaggcctaagttataccagctccatcattaatttcagccgtatttaaatataatcagcctcctgttttttcaattaaattatctagttaatctgtttctcgggcacagaccttcttctgatagtcacaataccagtagcaaaactaattgtagcttttaaaaaactcaatgtagtaaaagtaaagctgctttgttaacagtaactaaagagttaaggttaggggttgcaccctttcaaaatctgaaactttgacatatctagcagtttttacatggtttcagagggttcaagcctcttagagcctacagtagaccccaaattaggaaacgtagagtctcttctaaatcgggattctcatccaaatcaggggatcacagatacctggtctccttgagagcctttcggagggcctgtgatgttagaactatttccatcatactgctaagactttaattgactttttcactgtattgaaatttgtaccgatggtgcagaagcagtagtgggtacaacatcgcgcaccttagcaagaagcacagtgatggcaccaagctgacaaccacacaccccagtagaaatagaaacagccagtttcacttagtggtctaaatgaagcaatagaatagattaattgtattatttcatgacccttgtgcacacatggtcttaggactctatgatgaaatgtgaaggtttcataaagctcttctgctgccggcgccagtcaggagggagagcgcttgtgggatggagctgccagccaaacatgccactgttttcatggaacaccatttttacctgaaaactgacagacaaaccagttattcggactttgaatatttggcaggcatcttctgaaaaaataagcaaaatgagaaagtcactttaaggaaaataactgacagagtttgttgtcagtgataaaatgtgagctttctagggaagttttgtttcattttgtttttagagatgcggtcttgctctgttgcccaggcggagtgcagtggcacagtcatagcccactgcagcctcgaacttctgggcttgagtgatcctcccacctcagcctcctgagtagctgggaccacaggcttgcaccaccatacccagctgattttttaaatttttttgtagacacggggtctccactctattggccaggctggtctcgaactcctgtgctcaagcaatccacacgcctcagcctcccaaagtgctgggattataggcatgaactatcgcacccagccagaaattttcagttttggaaaatttgtatgcaccagggtgagcttcagcctcccaatgctgcagacactcctgctgagctcagtggtgatgggaatgagtgggatttttaatagatatgatgaagtgagtcaccacttggaagagccacctaactcaatgaacaagtattttccaaatgaccggtaaaggttacagagtcatttgtggcaagagagccattcagagtgcgcgatccagcactggatttgaatgtgagagtatagacccctcactgataaggtttcagcacccatgcaggagctcacccctaataaactactactggttgagttttgatgtagacaatgacctaaaaacactattagatagatactcctcccttgtcaactacgttgtctgtgtgagaccagactttcatcctatatttcaacctaaacattctgaacacagaagcagatatgataatctagcatttttctattaaaacagacattaaagaaatttacagaaatgtaaaacagtgccactttgctcacttaatttgttctggaaaatatagttattcataaatacatgtcatttacactaagacatgatggatttttttttttttttttttttagatgaggtcttgctctgttgcccagactagagtgcggtggcatggtcattactcactgcagactcaaactcctgggctcaagcaatcctccccctccccctgcctcagcctcacaagtagctgagtctacactgcaagtgtgcgccaccacaactggctaatttttttttaaagagatggagtctgggccaggtgcagtggctcatgcctgtaatcccaacactttgggaggccaaggcgggcggatcacctgaggtcaggagttcaagaccagcctggccaacatggtgaaaccctgtctctactaaaaatacaaaaattagctgggtttggtggcacactcttgtaatcccagctacttgggggtctgaggcaggagaatcgcttgaacttggaaggcagaggttgtagcgagccgagattgagccactgcactccatcctgggcaacagagtgagactgcttctcaaaaaaaaaagacatggagtctggctatgtttcctgagttggtcttgaactcctggcctctagtaataatcctgccccagcctcccaagttgggattttttttttaatttctgtggtttaatttataatatggccaatatcaatagatatagttcttataaacaaaagttctttaggatttgcaaccgttttgaggagtttagtaggggcctaagaccaaaaagtttcagagctacttttctaaaacagtgccactcaaaggctgcagcttcaacagcctttaggcttgttagaaatgcagattcttggccaggtacggtggctcacacctgtaatcccagcactttgggaggccaaggctggcggatcatgtgaggttgggagttctaaaccagcctggccaacatggtgaaaccccacctctactaaaaatacaaaaaattagctgggcgtggtggcaggcgcctgtaatcccagctacttggaagactgaggcagaagaatcacttgaacccgggagtgggaggttgcagtgagccaagatcgcaccactgcactccagcctgcgcaccacagaataagactctgtctcaaaaaaaaagaaatgcagattctttgggtcccaccctagacctgtggactctctgggggtgtgttgcagtgctgtgtgttttcagtgctctccaggtcatcctcaggcaagccaaaacttcaataactgttttgaataatcgtcctgcattgtcccatctttggatcgtcagttcccccagagaacaacttgttatactcttgcatttcttccactgaattcagcacactgccttttatagactcaataaatattcattcaatatgaggttttctgcatagacttgggcattaagactcgtcttaacagtcacagatgaaaataacctgaagatcagaaaaggaattgcttggattggtgattgaatgagtcggatgactcagaagtacttcgcattagagtggacctctccagaaatatccaaatctattgtgctggaccactgagaacgcaacctggtgtactcaatcatgcaagaaatgtgtattgcagacaccatgctacctcttggggctaccccaaggactaaaataatatagtctctacctatatggcatccacccttactggtctgggagacaagaagaggcagcagacgtaatgatacgagggccaaggactgcggtggcggtcagtgtaaggtctggtaagagcacaggcataggaggcctaaccccttgcctgggcgccccagagaagtggcctctctacaccagcggccagtgcttcaggactagctggctcagtgaaagcaatatagaggagggaaggggaggggagtgttcccagcagaaggaacagctcctctaaagcccaaagactagagaaagtaagatgtgtttgggtttgagccaagcctggagctcccgattgggtgggctagagtctggatcctggggagcttgatggaacccgaggacctgaggttgggtgggagagctgggaccaccccgtttgctccggctgcagtgtgaagaataggtgggaatgggtgtcagaatgacgcatgaagggaccagctcaacatctgctgcggcatttcaggagagaagtggtggaatgagccaagcggctttgatggcagagagaaatgggcaaatgcagagatgttaagaaggtagaaacacgattcggggtggatttgtttgagattcctggggagaggaaccaacgcgcaggtttctgacttgagcaagtggaatgctggttcaggggaaagagcatgggccctggtgtaggaaaggcctgaggtgggtctcatctgctaacattatttagagctctttgggttaacgggggcaggcacccaattcactgttgtttacactcacaagggagtttaccaggcagacactgggtctctcacacttagtccacagagtcacagggacagcttttccttccgtgtcccatgtccccgctctctgtatgcagccttccttctttggggcatccctctatgatgacagaggaaagcatggcccttgctggcttgccagaagaggcctgatgtctcctgtctcctacctgcccttgatcccgttgccgtaactagggagatggggtactgtggttgtgactcagactgggtcatgtgcccaccaaaccatgcgatagagtcaaggagcaagaattccccagaagggagggagtcgtgtgcttctctgggcagatgaaacggtcggatctgtacccaactttaatctgctaactgtgctactttgggtgaacggcttggttctgcaagcttggttctgtctgctgcagacaaatagctgtaatgcttctgcctcacagagcagctaggatgaaaggggaacacatggaaagcttgggcagtccccgtgacaaagttgtcagtgtcctcggaagtggccagaaagagacaagcctccaagatttctcagaatgcttaccagggggacgcctcaatgcagccttctttcttcatattcgtacgggacttatttctaattctcgctccagactctgatatcttgaggttacttaacttttttttgagacagagtctttctctgtcgccaggctggagtgcagtggcgtaatctcggctcactgcaacctcccaggttcaagtaattctcctgcctcagcctcccaagtagctgggattacaggcatgcgccaccacacccagctaatttttgtatttttaatagagacagggtttcaccatgttggccaggatgatctcaaactcctgatctcaggtgatctgcccacctcagcctcccagagtactgggattactggcgtgagccagcgcccagcctctattttcttatttagaaagttatcatgctgtggaactacttcatagagagttagttagattagtttaaatggtgattggaagattaaaaatacatggtctgaagtatgatttcatgtttgtaacatataaataaattcatgaaaataaaatcaaacttagggagagaaagtaacttgtgaaatactctacagagtacggtgacccagccctgtggcaccatccacaccacagattgatttggttccattttatcgatagatttttaaaataaagctgaaggcctcgccaacatggtgaaaccccatctctactaaaaatacaaaaattagctgggcatggtgttgcacacctgtaatcccagctacttgggaggctgaggcaggagaatcgcttaaaccctggaggcggaggttgcagtgagccaagatcacgctactgtgctccaacctgacggacagagcaagactccgtctcaaaaaaataaataaataaataaaaaagctgaaggaatatagtacaaactgttaatagtaggtgtctttgggtggtatcattaatttttcccttttactatacacttttgtaatttttaaaaaaattcagaatgggccaggcacagtggctcatgcctataatccaactttgggaggccagggcaggaggatcacttgagatcaggagttggagaccagcctgggcaatgtagcaagaccttgtgtctacaaaaaaaatttttttaggccgggcacggtggctcacacctgtaatcccagcactttgggaggctgaagcggacagatcacctgaagttaggagttcaagagcagcctggccaacgtggtggaaccctgtctctactaaaattacaaaaattagccaggcgtggtggcgcatgcctgtaatctcagctactcgggaggctgaggcaagagaattgcttgaacccaggaggcagaggttgcagtaagctgagatcatgcaactgtactccagcctgggcgacagagcgagactctgtcaaaaaaaaaaaagcaagaagaaagagaaagttttttaatagctgggtgtggtggcgcacgcctgcacctatatgcctagctactcggtcggggctgaggtgggaggcttgtttgagctcaggagcttaaggctgcaatgaggtatgattgtgccactgcactcctacctgggcaacagagcaagactctgcctcaaaaaaaaaaattaataattatgtaccacatttgtcatcatcaaaaaccagtaaagatatttttctttcttaaaaataaaaacaagcggccaggcgcggtagctcatgcctgtaatcccagcactttgggaagccgaggcaggtggatcacctgaggtcaggagctcgagaccagcctgaccagtatggtgtaacctcatctctactaaaaatatgaaaattagccaggcatggtggcgggcacctgtagtcccagctactcgggaggctgaggcagaaggattgctggaaccctggaggtggaggttgcagtgagccaagattgcaccactgcactccagcctgggcgacagagcaagattccatcaaaaaaattaattaattaattaaaaagataaaataaaaacaagctatccgtatgtaatatagtactgtttttatcaggactcttgttggtttccagggaaaactagttgatcacattattttaatccgcactgtctgtaagtgatttgatgttgacttacacgttttatgggcatgagagtgttcttaggatctgttggccgggtcctgggggaggtctcacaccctgcacccccagatgggtgtcctgtgcttcacttagggactgatgtggggcacgttccttcttctatttttatagctgatatttacagtgtgttctggaaagttttacttgctataagggtgatgatagtttgggagaggaaagaatgtgttgaattaagagggatagtacattgaccaatggagttgcagtcaaatttatttcaagtgaggatttaaatcatgcattcccaagtactttttgaaatccagagaatgatttttctactttaaatatcagtaagctgttttttagaggtttgtttgttcttacgattttgagattttcctttgatgtttttaaattataaaagaaatacatgcttatgtgataacaaatgaaacaaatacgaaagcattttaaaaagttaatctttttcctacttcacccctccccagttctacccatctctacctccaatcagccaattcatgtttattgtattttcagaaggctgctgagaaacttttgggatgatgagtatgttcattatctgattatatgattgtttcacagatatatgcatatgttaaatatcaaattttacactttaaatatgtacatttaattgtatataaattatatctcagtaaagctgggtgttttcagatgtccaaacttgttaggtatttcttttggtctaggggtgcagtgaagaaattactaagacaccaagggcattgtgaaccaagaagttttgggaacttatgacctagtgaatatctttccataactttttttaaattaattttttatttacatatagtgaaattcactctttcttgtggccagttctcggaactttgataaatgtgtatagtcacgtcttccgcaccacagtcaggatatagaacagtttcttttggttttgtttgtttgtttgtttgtttgtttttgagacggagtctctgttgcctggctggagtgcagtggcaccatatcagctcactgcaacctccgcctcctgtgttcaagtgattcttctgcctcagcctcccgagtagaagaacagtttcttcagcctccagaaacatggctttatgctcactttgtagtcagagccttccccttcctttctctctgcccctcactagtctgttctctatcacatcattttgtcttttccagaatggaaactccatagaaatggattcagtgtatagcctttgggtctagcttctttcgcttagcttgatgcattggacattcgtccatgttgtcacacagtttgttccttttccttctcagtgttgtctcattatataaaagtaacaccatttgcttatccatttcctatggagggatatttgaggtgtttccagttttatttggagcaataaaacttttataaatacttacataccgattttagacataagcttttatttaacttgggtaaacacatagggatgcaatcgctaggtgaatggtaagtgtgtgttgagctttctaaggaactgccaaaccgttttccaaagtggctgccccgtgtgattcccccaacagtgcgtgagttctcatgcctcccgtatctttgtcaatatttggtgtcatcagtccttttatctcattttgattttaatttgcatttccttaatgactaattatgccagccttgtttgtttgttttttggagacagggtctcgctctgccagccaggctggagtgcagtggctcaatcatggctcactgcagcctccacctcccaggctcaggtgatcctctcacctcagcctcctgagtagctgggactgcaagcgcccatcacacccacctcatttttgtatttttagtagagacaaggtctcactgtgttgcccaagctggtctcgaactcctgagctcaagtgatccccctgcctcagcctatgaaggtgctgggattccaggcgtgagccaccacacctggcccaagcattttttccctgcgctttttgtcgtttgtatatcttcattggtgaattgtctgttccaattgtttgcctgtttttcaattgggcttttttttttttttttttttttgagttttgagttttgagacttctttacatatctgggtacagattttttgcgagatacatgatttgcaaatattttctctcagtctgtagcttgtctttttttttgttcttaagtgtcttgtacagagcaaaaatgtttaattgagataaagtccaacttaggatttgtcctttatcagtagtgcttttggtagcatatctaagaagtctgccaaacctaagctcacaaagatttttctcctatattttcttcatcgtttcacattttacatgtaggtctgtgatccattttgtctgcagttcgttctttggcgtatggatttccaattgttctgtttgttgaaaagactgatgaatatccattgaactgcttttgttcctttgtcaaaaatcagttgagcatgttgtgagtcttcttctggactctgtcctgtcgcgtgtttgtgtatctctgtttgccagtctcacactgtcttcagtacagtacttgatagtaaattttgagatcaggttgtgtgactgctataacctctttcttctttttgaaaattgttttgactattctagttattttacctttccatataaattttaaaatcagcttgttatctacaaaatattctccaggggtttactgcatgcagtgaacatgtagacttggagaccattgacctcttaacagtgtgagctttgcagcccatgtacacagcatgtctccccattttggtcttcttgttttgtagttgtcagcaaacagatgctataaatatcttcttagactcgtaaattagtattttggtttttggttgtcattgtaaatagatctgtttatttcccatttgtaattgtttattgtcttgttgtaattatatcaggttttgcttcatgttatatatattcatataaatattcagtgtatatcccctcttggtgaattaactcttttaccatgatagatatgactgtattgctggtaatattatttgctctgaaatccactccgtctcaccttaatatagccattccagcgctcttctgactagtgttggcatggtatgtctttttcttcccttttacttttgatcagttcgtatctttatacgtaaagtgggtgtatggtagatagcgtattgttgagtcttggtttttttttgttttggtttggtttttgttgttgttgttgttgttgttttgagacagagtctcgctctgtcacccaggctggagtgcaatggcacaatctctgctcactgcaagctccgcctcccgggttcatgccattctcctgcctcagcctcccccaagtagctgggactacaggcgcccaccaccacacccggctaattttgtatttttagcagagacggggtttctcaccatgttagccaggatggtctcgatctcctgatctcgtgatctgccctcctcggcctcccaaagtgctgggattacaggcgtgaaccactgtgcccggctgagtcttgcttttttattcagtcagacaatccctgtctttcagggtgttgaaaccatttatttttcatgtgattatgaatgtacttgggtttaaatgtaccaccttcctattttttttctatttgtcccacctgtttatcgtttctctttcttctttgtctgcattcttttggatcaattgagtactttttatgattcccttctatctcatttgttggcttctttatgataactccatattgtttgattttaattgttagtcttttctagaacacacctttaacttatcacaatctaccttcaagcgataacatactatttcatatagaatataagacatttacaacagtatacttctatttctcctctcccagcctttccgctattatcatacataaacccctcaatatcttattatttttgttttaaagaaatttaagtgatttttaaaaatctttttttattatactttaagttttcgggtattaaaaatcttttatatttacccagatagttacaattttcagtgttcatcattcctttgtgtagattcagatacccatctgatatcaattaccttctgcttgaaggactgtcttaatatttcttatagcacaggtctactgatgatgaattcttttagctttcgtgtatctgcaaaagcctttcttttcttttgccttttttttttttttttttttttgagacagggtcttgctctgttacccaggccagtgtatagtggtgcaatcacggctcactgcagctttgacttccaggctcaatcagtcctcccacctcacaccccaaccccaactctgccccagtagctgggatgacaggcacatgccaccatgtccagctaatttttttactttttgtggagacagggtctcactaggttgcctaagctggtctcaaactcctgggctcaagcagtcctttcatcttggcctcccaaagtactgagagtacaggggtgagcctggtcttgccttcagttttgaaagatctgcttgctggtatagaattccgtgtcgaccgttttatccttgaaaaacttttgctcgcctgttgtcttgcttgcattatttctgatgagatgtctcctgccattcttttctttgttcctttggacataatgtaccctttccccctctgggagctttcacagttgtctctttttaagtcatttgattatgatgggccttggcatggtttccttcattttgcctgtgtttagagtttgtttataattttcatcagtttgagaaattgtctcttcaaatatttttttctgtcccatgaccctttctctcctttagggatcccaataacgtgtattaggcttcttagagttgatgctgatgctctatttctcttaattcttttttttttttctgtgtaacatttggatagtttcctttgctttcttcaacttctttaatcttttctgccatgtctattctgttaatttttattacagtaaatttttcatttcacacattttttttaattaagtgagcaaatttacttaagcaattagagatctgtgggtacatattgttgttgtcatctctagtggtttgatttgtgtctttttaaaatatctttcacgtccacctaactttttggacacaatactgtattcatgtccttgtctgccaattctaacatttgtgtcatttcagtttagttcagttgactggtttttcttctcattataaatccttctcctgcttctttgcgtgtctggtaatttttaattggatgtctgacattgtgaattttgctttgttgagtgctatatctctattcatgttcttgagatttgtttggggatgcaattaagttacttggaaatagtttgatcctttcagttcttgctttttcagatgttttaggcaggaacagttatattaaaaccagagctaattattctccaccactgagacctttctgattaggaagccagtgccctatggattatgaatttttcccatctggttggtgggaacagacactgttcccagccccgaacaagtactgggttctcactaatcctttcaggtggttcttttcccaacctctggtagttttctcacacaaatatgctgatctgtactctgctgaatagttgagtgacctctacaaataaatcactgtagttcttctctgtgtgcagctgtctcccctgtggaactctgccttgcaaattctaatccagtttgaatcctgggtcccacctgggttctttctgcctatactacaacctaaaaatctatcaaggcaggagcctggggcggtgtgggacgtgcctcacttgttcccatctcagggatcactgtccttatccttcgttgtctgaaatccagtgtcttgaaaaccgtaattttatatatttttgcccaaatatttggttgtttcaggcagtagcataaacctcatccttgttactccatctcatctggaagcataagtctgcttcatttataatagatactcaataaacacttaactccgtccacccaggggatctagcaattattataaaaatgaaagactgtttgcataatttataatgccataatttcatacgtcatttggggttaggggaaatggctgtgcatacatgactgggaagtgataaggagtttagctctgaaacttcccttctcagttgatttatatcacgttggatagagagtatgttgttctgctatgctaaagcattactaaactttctcataccttactgcaaaaagaaatcagaatacatgataaagcaaatatattagaatgctaatggtaaaatctagatgatagctgttcgctataaaattctttcaactttattgcattgaaatttttcgtaataaaaacattgggaatacatcattcagaatctatacgaaactaatctttggcccagagtaaataacttaagagcacttccaaatccagtgttatctttaaatgacactagttgaattgaattataagtattatgaattatttcttatgtataaatattctaaactcaaaaaatataaactcatgcacataactgtaaatgatttattttcatgcttatctgaagatgatcttgttatgaaactgtagaaaattaaaatattcattgtttgaaaagtttagactaaatttcctttattaagtattctacaaaggtttgtaagttgtttgttttttttttaatttgagacagagtcttgctctgtcgcccaggctggagtgcagtggcacgatctcagctcactgcaacctccacctcccaagttcaagcgattctcctgccccagcctccagagtagctgggattacaggcctgtgccaccatacttggctaatttttgtatttttagtagagacagggttttgccatgttggccaggctggtcttgagctcctaacctcaggtgacctgcccgcctcagcctcccaaagtgctgggattacaggggtgagccaccgcgcctagcccgtaagtttttatttccatatctttaactgctatttaggaacatatttgaatagattgtaaaaatagcaagttattcaaagtaagaattttcaatgttgtggttcttttcttgactgtcacatcatggcatctatttggaggtgaaatcgattctttgaaagcagctcttgctgtggaggaagcgcgaggtagatttgtgggaagaaggctctgctctcccttacctctcttcactgccgagcactcattgtgtgccagggccagcaggaagatattaaaccaaggacttcccggccacccagtcatacttgagataaatattccaaagaaaatgtacagcatcatagaagagcttaaaattaggggcccaattaggactgtaattattttgcagctgagacgtaaaggtttaatgagacatttttcacagtttccaggtaattaattggtgttgcagttaataaggtgactgatgcgtgcttttcccaggatccatttactctcagcaagtgtttgaggacctcctaggtgccaggcacagtggtaggtgctgggattgctgtgcatttatgttctctagatgatagctgagttctggtgccatgaaagcagattcaaactcactttacaaatggggaaaggggtagtatctccctttaagactgctactacgatttttactattctacctaaattttaggttaagttcattgagttcatcaaaaattcagtttaagattgtgtctgctttatacattgctctgcgaagttccatctttgtaatatgatctcattccacatcaaaggttcctccgttttttcgggcattcttcagtgccttttattagagttttctgctttctccatcaaggccttgtaactaggtcagtaattcccaggcactttgtagtttttgtgtctgggtagctggagtcttcgtctctgtttcttttttgtatttgcttaattgttagtggaaaggtggttgctgttggtttcatatttttgatatttgcatgtggtagtctagttgtgatggtctgtctgttgcttctgttttccagctatatcatttgcaaacaaatgacaattttgtacttaaatatatatatattgcgaaggggcttaacactttctgcccttcccagaaatgtatctcttagcaatatgactcgtagaacctaacagttccatcacaggaggaagtgttctgcagtaactgtaatttggcctttgatggattcatctgttataaatcctgttgacatgaataaaacagagaataaataacagaataacccttgtggttttgaacagagaactgtaaataatcaaacctttctttcctgttgcctctaaagttagactgtcagcggtttttttttttaatgtatcccttcatgtcttaaaatttttatatgttacactgctgcagttatgttacggcataaatattcactcattggtaatgaatgataacacatacagaaaggctgcatgatattgctgaattgtaagaattttccgtaaagttgcttcttgggccattctagtttacatctaatttaataaatttagcaatttggagaacatctgcaggactgatgtaagtactgaaagtggaagtgtcagggaggcagcagaagcaggtgcttcctgatattaaccagagacggtcctggcacagatggggccgtgtgaatcacatgcagacatacgtatgcactcacgtgcgtgccattattttcatgtggaggtcaaacagtcagaaacgtttgggaagtgctgtgtaatgctaactgttcgtgcataatgttttcccatttagtaagtgctgttgcatgtgttttctgtgattctcaccacagcccaatgcaaaaaataaaaaaaggatttacgcttttttttttttttttttttttttttgagatggagtctcactctattgcccaggctggagtgcagtggtgcaatctcggttcactgcaacttccacctcccagattcaagtgattctcctgcctcagcctcccgagtagctgggattacaggcacccaccaccacacccagctaagttttgtatttttagtggagatggggtttcaccatgttggctaggctgctcttgaactcttgacctcaagtgatccacccgcctcggcctcccaaagtgctgggattacaggcatgagtcaccgcgcctggcctttaccctttccaatggaggagaaaattgaggctcaggcaggctgtttggtctgaggtccttcttctaggtgggaagagggtgtagagagactgtttccatgaggctgtgctgcctttgttgggcagcgtgattctgcgtctgtgcctctgggtgtgcgctggatccgtaggtctcatttgagagatcacagtgaccctgtgtgctgcccagaagacccgggactccttagacctcagagcttctttggtgttcactgcataacgttgatgtcttctctgtttcctcagaccggatccatgcatccaggtagcatggcagtgacatttgcacacagacatcagcaccccaggtttctgtacctggggctcctgcccctgattcgcccctgcagcttttgtgttaagaaatgttgctaggtcagaaacccaagaagaatttgaggtgatagaccgttggccctctgttccttccccccgccccagtattactttttacttaaccttttctagagatatgcactaaattaatgcaatgtaatgtggtaagaaaggtgtgtagaagttaggagtgcaagtttttttccttacacatgagaaatgactttcaatcaatcagaattggcctggaatgaaccttcccggacctaggtcggtcatcagtcaaggacgctgtatcagtctgctcaggctgccgtaagaaaataccacaggctggtggcttaaaccacagaaatgtgtcttctctccattctagaggctggaaagtctaaactcaagggtgtagcagggtttgttccctgctgagggccttttctggcttgcagacggccactgtgccctcccatggcctttgctccgagcaagtgcagagaaggcgagtgtgagccttctaccatccctccttacaaagacactaatcctggagggccaaggccccacttatgacttcattcacccttcattattttctctgaggacccatctccaaatccagccacaccagggtttaggtctttaacatgaatgtgaggaagggaggccacaagcattgagtccatgacagacactgaaaagaggacattgtgttcagagcaagccatctgagtcaccttgcaggccctcagctcagcatcaaggattcagtgagtgtgcaggtgtttgagacggggcctagctgctgggctgactgtcactgtgcgggagagcttcaactggaaaccctaatcactagctttcctgctagtagaaaccaccagtttacttaggaatctcagctgactgggtgcctcagtcagggctgtgcagagaaacagcaggagagacagagattgagatctcaaggacttgccttctgcagtgggtgagtccagcgggcaggtctggactccgtggacaggcagcgggcacgagacttggccgtggtggacactgcaggccgcaggtggactctcctcagagaagctgcagtttgggtctcacaggcctctcagctgactggttgaagcccccacattctcaagagtgatcgctacttgaagtccattgattataggtgttaaccacatctataaaatgccttcacaggaacacccacagcagtgtttggacagctgggcactgtggcctagccgggttgacacatacggccagctggcacagtcggggacattttactttttttcagttatcgcctttaaccacgatgggtgaaatcacactttcctgtgcctaaataacatcttaggcaagttggttaacttcttagtcatccctggtcacagaaatccaatctaggttaaagctttcatctcagaccctctgcaaatggcatctaagccgcaccccaggcagcctggccagggagggacatgctgtgggagaggaggggaagcaagggtggctccgagcccctcttgcccgccctcccccggggctttgagcagaacccagagcagaggggaagggcagctgcctgttctgctcagttgctccctgtggcctcggccagaatggtggtctcttcctctgtggcatgtctgtgactcttgggcagcaggcctcttccagagggacggctgtttcctctcccccaagacctacagcctcatctctgggtgagctgacccctctctcccttggcagcttcctgggcggcgtggccctacggctcctgctctggcctctgtatccctgatgggcagccccagaaacctcggaagcagtgaccgtgctttccttccaggcgccatggttcctcaggccctgatgtcacaggctgttcccagagtctcctgccaggcatagtcctgttcacagattcctctgccacccagagttcgtgcccaggctctgccctccccacactgtgctctgcccctgtcggcaccaggccgggcccacagctctaacccaccgaagaacaaagtgccatctccctttcctgaaggtgaccctgtcctgtgggtgactggaccctcaccccagtctcttggctttgagagagagggtagaaaccccagttcacgaatgccacactccccgtaggagctaaagactcaattcagactttcctttctctgcccttcatggccctagaagttatggagagcttcagcagtggctgctaatgacaggaccctgggaggacatggcggcctgcccaaagtgtgtgtgtgtgtggcctttccttaatagttgagcttttagcatctgcttgttcacgtctgtgggctttggggtcagggtgccaggaggggcagactagacccctgtctgcgccgagtgcctgtgggccagcaactgaggcagggccgtccacctgtcaatcaccgttctttgggaggctccttgcagtgccctatacacacactagcttcacagaggaggggacagtccctggagagtagacattgccagaaattataacaccagtgagagtcaggttaactctcggttttagattgcaaacttttgtctttgtacctatgtcttaggaacattactcatacttttactagaagtgttttttaattagttgttcctggcttttcagccccttttttcatccctgcgtttctacagtatccgtgaaggccattacagttggtctttacgtcagctcccctctcagatgacacagagaacaagctcagatgcttgatgctcagatgcttgatgctcagagcttttatagctgatgactttctgaaaaatgatattaaggtttggagttcagtatcaataccagtaaagaagggaagaaacaggcaggtgcggtggctcacgcctctaattccagtactttgggaggccgaggcaggaggattgcttaagcccaggagtttgagaccagcatgggcaacgtagcgagttcttgtctctgcaaaaaataaataaaattagcagagcatggtggtgcgtgctggtagtcccagctacttgggaggctggggcaggaggatcgtgtgaacccaggagttggaggctgcagtgagcgatgatggccactgtactccagcctgggcagcagagagatgccctgtctttaagaggaaaaaagaaaagggaagaaacagcagtggtgacattgagtattagcttggtctttacaagactgggtatctaaagccagccaagtttgccctggactctctagaaacatcttctcgttgttatcgtagagtcagattttaatcttttatgtcaaaggttttgattttgtgcttctgagagtggtgggactggggttgtgatcacctataagagccattcaccagaacccagttatataactggcatacgatccgttcagagattcaataaggtaaccaatcatatttagacttagtataaaagagggttgggcatggtgactcacgcctgtaatcccagcactttgggaggctgaggggagcggatcacttgaggtcaggagtttgagactggcctggccaacatggtgaaaccgtggtgaaatcccatctctactaaaaatacaaaaattagccaggcatggtggtgcacgcctgtaattctagctactcgggaggctgaggcacaagaatcacttgaacccgggaggcagaggttgtgatgagtcgagttcgcaccactacactccaacctgggccgcagagggagacgtcacctcaaaaataaataaataaatacatagatttagtacaaaataaaaataggttataaatgtatgacatggaaacagtaatcttttctgtttatgtcactgatctgtcagtatgtgttatacaagtccaaacagactgagagaaatctaacagcccatgcctgggcgcacagccatgctgcccctaccgatcctctgtgcccctgagcagtcctttctctggaaatgatcttagctgccgactcaaaggtcgtcccactctgactgttgctttcctcatcgttgcggattgcagaggatgttggtgccattgtcacacgggtcctccctgcgtgacgcagcccttgccatttccagcattttcagctgtgaatctctgctgcgtctttcgtcatctcatccctttcttactctcattttgagcattctccttggtcttgcacccactggatagtataagacctcagaagtcatcactgtgccatcagcctttgttggtgttggttgtcattcaaagtttgacagtcaagagtccaagtaactttggtggtcaacttgcgtgcgcacctgtccaaagtgatgtttcctgctgcagttttgatccaggctctctctgaggacccacacagcttctgcgttttgaggatacggaggagctaagttaccatgggaagcggctactgttagaattacctaagactttataaaatgttgtctgtaaatattttaaatgccctgattgtaattatagaatatgtggattttagtttgcagttaacatgtttcgaacattaccaccttcctccaatcctacgggagcggaatttgacccggaggaagatgaaccaacgttagaagcagcctggcctcatctacaggtatcgggctctgggtgatagactcggagggcactggtgacacatgggaatggcctgggatccacagagcgggcgcactggtctggccagatggacctctcctcctcagtagcatgggcctcgtaaacccatatgtacaagaaaaatatttcagcagaataaagttaatgtgtgtgtttgaccactttacaacagccagtgaagatgtgtaattgtgagtatgttctcagtgaagatggccgctgtgttgatggccgttgaattgaattcaggcccagaggtcctaagccaacaatctcccagtttttgctcctcatatttaataggtgcctgctgggcccccaggtcctgcgctggccactgcctttccccagggcatttgtaaggcagaaggttggttggcaaggaggcgccagggtcggcatgagcagagcgggggccaggtgtgcgggtgggagggccatccatccgtgacaggcggcccacgctgtcccacccagcatgtctgcacagggaaagaattgtcccagctccaggaggtcatgattctgggtccacatcttagggccctcttacctggcagccccagagttcctgtgtatttggttggctctgcgccttggcattgtgggacactcctaggcgacaggctgcaaatcccccctgcagagttgggtcatggcttggtttgtggcatctgtgccctgtagtccctgaacagtgtactataactgatgacatcagccatggagatcattttgtttaaatgccgtttaagggtgtagtctgtgggtttcaccaaataaaataattaccatcaccatttatcattgaattaagccatgtaatttagcattaattctgtagatatgtggctttgagaggctaatatttgcataccaataaagattcaatttctggtatattttaaccgccattcaataaaatctcatgttatttgactcattgttttttttcctcctagcttgtttatgaatttttcttaagatttttagagtctccagatttccaacctaatatagcgaagaaatatattgatcagaagtttgtattgcaggtaaggtacaaattagctgacactctgaaagccctgatggaatgatgacacccagccactaagtgtctttttcttctcaaagcttttagagctctttgacagtgaagatcctcgggagagagattttcttaaaaccacccttcacagaatctatgggaaattcctaggcttgagagcttacatcagaaaacagataaataatatattttataggtaagtcacgtgtggatggcgttgtccttgtgtgtggtgatgctcatttcccccctcgatgctcccctaccccatcgtctcctctgacaggactcagcatgtggagggggtttctcaaagcctatttgtcatgtgcaggtggacccccttgtgcactgtgtgcagggggctgctgggctcatcctccctgccttcctcccctctccccacagctccctcctgagccaccaagctccccagcgcctcatcctgggtccctccattgttcctgtttctactgaaaggtcaagtttcctggaaatgtggatgaattggttccatccagaccaactgtattagtgaaggttctctagaaggacaggacgcataggatagatgaatatatgaaggggagtttattaggagagttgactcacacgatcacaaggtgaagacccacaataggctgtctgcaggccgagtcccaaaacctcaaaagtagggagacggacagtgcagccttcagtctgtggcggaaagcccaggagcccctggcaaaccactggtgtaggtccaagagtccagaagctgaagaatttagagtccaatgttcaagggcaggaagcatccagcacaggagaaagatggaggccagaagactcagccagtctagcccttccacgttcctctgcctgcttaattctggccgcaccggcagctgattagatggtgcccacccaggttaaggatgggtctgcgtctcccagtccactgactcaaatgttaatctcctttggcaacaccctcacagacatacccaggcacaatactttgcatccttcaatctagtcaagttgacactcagtattaaccttcacaccagctttttccttctacctgtgcatcacctcattcttcccgtggagtctcagtgagaggaggcggggcaagaagtgatgtcattcatctgtagaaagcctgagatctgtgcacctcggttaaaggtttggagactcccactgtgcaccaggggagggaaagccccgctggagcagccggtggaggaggacagagtccagtggcaggcccacctccaggcccgcccctccccagccagcctctgctcagctccaggctccttccacgccagggctctgtagccagtgttggagcctcctggaatgtcttttttacaccagcccttccctcagcctcccaggcttcctgaaacatcccttcactgggaggctctgcctgacttggcggtgggtctggtctcccgcaagggcagccaccatgtcagttgatttgtcgcacgccccaccccactgccagtttcgtgctccccactgcggtggcaccaagtgaatgtcaatagaggaaacagttcctgttgtttctttttgttcctggaaagttcactaaatgagcagtttcttctacaagttacagcttctctggtcagcttgcctctaaggcatctgactccaggatgttgcgaggtagtgacacatcctggtgatggtggggacggtatgatggcgtgtctctgtgagataagagcatgagcaggtcccacacagcctcgctgcagggccagggtgtggacagagcacgggccatggcctggagaaggggccaggtgtcagccacgcccaacacgggcctcggggtcctttcttagtcacagtgaccacgggaaaagaaaaggggcatctgagacagacagatggcagatgagaccccccctgccaaaacccacagccctggcccctcccatcccgtgccggcttgcacagcctgcgtcgggagcaccctgcctttccgtctgcagtcattagggcccgcagccccggcctctcccatcccgtgccggcttgcacagcctgcgtcgggagcaccctgcctttccctctgcagtcattagggcccacagccccggcctctcccatcccgtgccggcttgcacagcctgcgtcaggagcaccctgcctttcccctctgcagtcataagggttgcattccctcctgacctgcacacctgatagggcatttcggcgtgagagcctttgattttgcgtgtggctttcctttgaactccttccaagtaccccacatctcgtttgtaaaatggagcccggtgctggacatagcccagacctgacacattaactataacagagaatgatgtcactttcctaaatgttatgtttctattttatgtttcttggtatcatgattcctttttaacaagatcattacttgcctggtatacttatctatgaaaacataatatacattatttaacatacaacaggtacaatttaaatttccagtcttcttgacctaaaattaaagctctacctaacatatttctgttttcttaattctagtaggttttgttcagatagcagaatcacaaatctattgaacatctgcatttaagaagtagaaaatgggccgggcgtggtggctcacgcctgtaatcccagcactttgggaggccgaggcgggcagatcacaaggtcaggagatcgagaccatactggctaacacggtgaaaccccatctctactaaaaatacaaaaaattagccgggcgtggtggcgggcacctgtagtcccagctactcgggaggctgaggcgggagaatggcgtgaacccgggaggcggagcttacagtgagccgagatcgtgccactgcactccagcctgggcgacagagcaagactccgtctcaaaaaaaaaaaaaaaaagtagtagaaagtgttttgtaccttaaagaaccttaggaaatacttaaatagattagtattccaaagttattacgcataatttacttgagttctcactaaaggcttggtgctagaatatggcatttgtgtctgtgtgcatgcttttgatagtcttttctgtaattgtgtgcatgcttttgatagtcttttctgtaattgtgtgcatgcttttgatagtcttttctgtaattgtgtgcatgcttttgatagtcttttctgtaattgtcctgatacgcgcagtcaaaagcaagcatgctatctagattccgtgattggtttgggtcctcattgtcaataccactacctcctcatttcatgtgaggaaaaaaaaagaagaaagatcttgagagttgcattcagctcatctaggtttttttcttttcttttcttttcttttctccttttttaaggcagggtctcactctgtcacccaggctggagtacagtgatgctgtactccatagctcactgcagcctcaaacccctgggcttaagggatccttctacctcagcttcccaagtagctgggtctacagatgtgtgccaccacatgcggctaacttttaaaatttttgtagagatggagatctgtctcactgtgttgcccaggctggtctcaaactcctggcctcaagtgatcctcctgcctcagcctcccaaagcactgggattacaggcgtgagccaccacacccagccagctcatctaagttcaatatagaacagctgtgtcttgtaagaaaaaacattttgaacatatttggctcaacttaactgaaaatgtaaatataaggttgctgtttatttctatggtttatcattaccgtcagcttaagtgtgagttaaacagtgctgtccataacccatggtgcctgctctggcacacagcgggacctggaggctgggcgggcagggcagtgtgccgttccttctcttgctgcataaccagccatgggtcatgctctatcctcaccctggccctgcagcaaggctgtgcagcacctgctcatgctcttatctcacagagagatgccatcaaactgtccccatcatcaccaggatgtgtcactacctcacaccatcctggagccaggagccaccgccagctcagtggcttctgtcagcatggtccatcactcctcacgatgctgtcgtctgcgctaggctcatccagacggttctgctccgtggcgtgtgctggggctggagtgttcacaggggctgctgagcaggtccccacgctgcctctgtgatgccttgagctcctccaggttgtctgagtttctacagccacggccacgtccaagaggggagaggcaggacccccagtcctcctaagagtttggcttggaactggtgcagagtgacttctgccctttgtgttggtcagagcagggcacaaggacagcccagcttcagaggaaggagaaatagagtccacctcttcccatgaggccagaatacatcatacaggcaggaaaggcatttagaatcctttctggagacttctatagccagcaggttcccagcttagtgtctggggggtctgattccctttctgctgaaagagtgagaaacactctctccggctcccagggatctctgtttccctcccagggtgtccctgtttgtctcccgctggaaaaggaagaaggaaaagaactgtccttatttcttctttcttctgcctacatcaaagcaggtttaaaaaattagaaattaagaatttatcagtaagaatgtagtaatgttgatttaggaaaacaaaatggcttataactgcaagccatccttatgtaaatgttaaagctgatggatctagaccagaaggggtccaggggtctttgtctcggagaggcccagatcacagctctccaaggtccatgcgagaggaatagtaaactgaagccacacggctgccgtgtatgcaaagggagcctgcagggtgagtttcgtaaattaaagcacctctcggtgtagacacacacagactgacttctgcttggtcacagcttccaagcctcagggtaggtgcaggctgagggacaccaggtgcgagcattttctgtttcttgtcatggcaccagtgtcgttcctgtcacccacggcactgagctctgccctggtaacgtccctccctccctcttaggctttggccacctgcattgttgtgctactgggtctccctgctaaaggttctgcttcctggttcctgcaagagcagatctcagtttttctgttgtgttgttttgttttgttttgttttgttttttgttttgaaacagggtctctgttgcccaggctggaatgcagtggcgccatctcagctcactgcaacctccatcttccaggttcaagtgatcctcccacctcagcctcccacatatgtgggattacaggcatgtgccaccatgcccggctaatttttatatatttagtagaggtggagttttgccatgttggccaggcccgtcttgaactcctgacctcaggtgatccacctgcttcagcctcccaaagtgctgggattacaggcatgagccactgtgcccggccagatttcggcttttctaagctggccttccagcctctccatgcatcttgcccaccccactccacggcacagacctttgttccagccaaacgagttcttctccctctccacactgccatataaaaaaaaaaaatctgtgaaaatcctccttcagtacccaattcaagcaccacctctcagtgcattctgatgtttgggaacatagaaatgttaagacccattcttgaaaaatatttcacatctgtggatgttaaggtcacactatttcatttgtttcaaacaaagtgaacgaaatttcagagttgaattttttaatcttctcaaacttatttttggcttagagcggtctctaatcaaatggttttcatctgatgggcagggatctttcagaccctctcactgcatgcaggatacccctcgtggactgctctagaccaatcccaggtgcacgaggcttggggcaggagaggcttctttgtttctgtaggagccctttgcggggaggacattttcctgtttcctaacatgtccctgttccctctctttgtgcccggtttattcagcagacgtgttttcagcatcaaacagatgccaggcttgctcctagccctgggaacatagtcacgagaagtccttggccctgtctttgcagtggccccatctggagggagacaggctggcacagagggtagggtgcgtgtcctggggctcccctagaagcaggcgcagtggacagagatgtctcagaggaagggagctgggtctgtcgcagatgggtgcttcagaaagatcgcacctgagacagcacggaggatgcgtgtgggtgtcagtggggaactgggcaggtagaataagaggagttcaggaatcacttctaccctttgcaggaactgtgctaaatattgcgggctttaaaattaagtaagacattggcctatgttgaaatacagcaaaaacgtaagatggattaatgaacgagtaaaagatggatgaacagatgtgcgtgtgatcaagcagatggagcacattgctcgtggtcgaatctggtggttgaaatgggtgttcactgtagaattctttccgttttcctagatgcttgaaattttccaaaataaaatattgagaaaaaaattcgtgcaagaccaagttctctgccctcgaggcatttacagctgcaggccttgaggagtttctttggttcctgaagggctgcttgctcaccacgagcagtgtttgcacaaatagatgcgcttcttgttgcctggctccatggctcctcctagagcattgttttcttattcaggttagttcagtgtctaattctaatgggaaaattgttttttctaggtttatttatgaaacagagcatcataatggcatagcagagttactggaaatattgggaaggtaagcctctgttatgggtagcaaacggctgtagatggaatttataccagagtgatccatttcattgagtccagctgcccgctttaaagcaaggcagtttaaaccattctctaaaagaattcaaatacaatttcactgaaagcaggagttggtgagctcttagattagagcacgccaaatgacaaatctctcccatttttatggttctgtacgtagattctacttcgtatacctcagtatcattactatggaaacacaattccagttatttcctcaagagcaatgttaaaaatagttaacctaagaaggtttatattagaagcttgaaagaagaatagattgtacatttggggtatcatgtaaatgctaatatttttaattacttcagttttttatatgtatatttataaaataattaacatttcaaaactttcatcatctttatccaagtaaagtttttagttgcccttttttttttttttttttttttttctttttgagactcttgctctggcacccaggctcaagtacagtggcacgatctcggctcactgcaatctctgcttccctggttcaaacgattctgctgcctcagcctcccgagtagctgggactacaggtgcccgccaccatgcctggctaatttttgtatttttagtggagatggggtttcaccatgttgcccaggctggtctcgaactgctggcctcaggtgatctgcccgcctcacctcccaaagtgctgagattacaggcatgagccaccacgcccggccacttttatttaattgataacccgtagattttatattagaccttctaacccactgtttcccagagttcctcagggtcccatggttagtaagtgtggaagtgctttttcctgcacctttttagggatgtagtgtagatgggcagttccgggttctcaggagcctgtggtggagaagtctggcactctggatggatctagtgacgctctgcagctcctgagcacaagactctcttctcagggtggatcaggtcctgcccagtagttctgagaaaagctattcttgccactttagatgtaatttgaaaaaatgtcctcgctgacaattcttttagtttagacaaacttgggcggggtttctccctcagtgcagtgcagtgagtggtgaagaggatgcctctcttactagatgtgtgaccatgggcaggtacttctgtaagataggcgcatcctcgcatttccctcctaggttgttgcagggaccggagcgctgtatgacatgtgttccacagcccgccatgccgtgtgcgtagggcccccgtgtgcatagggccgccgggcagctcccgccgagaggctgattagttttatccttcttccagatgaggctgagccttcgggtgaccctgtgagtgagcacaccctccttgatgggccgctccaggctcgcccttcccgcattgtccgctgtgccgcgcagagtcagtaatggaagaccaagttagagacagctctgtctacttctgcagctcagtggcagtcactcccgtttgcctaattacaaaaccaagacaataaactagttgtttgagacaaaaactttgctttggaggctctaggtaggacctcttttcttgcacaagggaacagctttctgtttttttgtttgttttttgtttttgtttttgagatagagtctcgctctgtcaccgaggctggagtgcagtggcccgatctcagctcactgcaaactctgcctcccaggttcaagcaattctctgcctcagcctcctgaatagctgggattataggagcccgccaccgcgcctggctatttttttgtatttttagcagagatgggctttcaccatcttggccaggctggtcttgaattcctgacctcaggtgatccacccacctcagcctcccagaatgctgggattacaggtatgagccaccgcctggccctaactgatttttaaccagctctcatccagcatccactgggtctctgttaccaacattagaataacatacctgaattactccaggcagcaagaatgcctaccagatggataaggctgagggaaggtgttgggtggggggtggggggggtcccacgtgaactgtcccgtcttcctggcctgtttagggaggaagattttgccaccaggagctcctgctgttgagccagctccctgctgttctgggtaacacctgtaaacccagaatttttaaattatgtagttacaaagataaaaataactatacttcctggtaggcatttagcatttttaaactttttgctggtatcctcttttttctgatacacacacacatacacacacacatatgtatatatataggaagaatcctcggatttccctcttaggctgttgcagggaccggagcactatatgaagtgttccacagacccctatataggatctcgctatactacccaggctagagaacagtggctcttcacaggtgtgattatagcgcactacagcctcgaactccgggttcagatgatcctgccgcctcagcctcccaagttagctggggcacaggtgcatggcaacatgcttggctacgtatattttgcctgctgggttttgatggtgaaaacaaaaattgaaagacggcaagatatttgtttaaaacctggaattcgtaaatgttcaaacctaataaatgttctttttacagtataattaatggatttgccttaccactaaaagaagagcacaagattttcttattgaaggtgttactacctttgcacaaagtgaaatctctgagtgtctaccatccccaggtaaggggcagcaggactctaggaacacagctgttggcatttgatcaggattgaacacgagatagtgaatccggccttgactgagagtgctttcttctttataggcctgtactaactttggtaacaaacttctggtgataatcgaaagaataagggggtaaagagagattccttttaagaaattcagaaaaatctctgtaatacagaatttttcagttttaagcattgagaaaggagtaactctctgaaaggagtctaggaagacttctgagaggagttttctgtagtgtaatctaaaattcagtaccttaaagagaaaagcctatataggtccatggccaatgaatggcctatgaaaacgttttttaaaaaaataaagctgcctataatcccagcactttgggaggctgaggcggacagatcacctgaggttgggagttcaagaccagcctgaccaacatggagaaaaccgtctctacttaaaatacaaaactagccgggcatggtggcacatgcctgtaatcccagctcctcaggaggctgaggcaggagaatcgcttgaacccgggaggcggaggttgcagtgagccgagatcgcgccattgcactccagcctgggcaacaagagtgaaactccatctcaaaaataaataaataaatgaatgaataaagctgtgaattttttaaactgtagtaatctaagtacagctgtactgaaaaattggtcaataagtggttaatggactgcatttacctggatttggttttctctcactctttggctgcagtgggcgtctttgttcacttccggctgtcacagggccaggcactgagcagtcacgccccagcacaggcacaggggtgcacaaggctcctctctgccaggccccactttcagagcttatggtaggggctaaatgacaaaaagtatattctttaattgattcttcctagaacatatttattttctctgactgctcttaactggtaatatctttgcatccagccagattatcatattgttgtacaaaagaaattaatagttcagagatttaagatggaaccagattttaatttgttgttccccactgttagatgactcgttgattgtagtctgcacaaggaccccaagaaaatcccatcatactggattgacttagcggtggttagactaaaaagactgtttcctgatttatttttcttatttttatttttcagctttctgatctatcaccaattaatgggcataaatgttaatgcccgttaatcacacaagggctttgtctgtaccgtgggtccttgtcttgctgtgggaaggtgtttaacgatgattctagaagaagcacagcagcatttttatgttgaaatgttaatgctctttctccttttactttttagctggcatactgtgtagtgcagtttttagaaaaggacagcaccctcacggaaccagtaagtactgatgctagcgcgtcttgtaagatgtgtgcatttcactaaatgtaaatattacaacatctgcttcaccaaattgccattcattcagactttttcatcttaaattgcaatactaataaacaggctcatttcattcatgggttataggttttcaaagtatagtcattttaattgcagattcctttattatagtgattattttatgtaatgagattgccaccttgtccctcgttgcactttactgtttgaacgtaaagcacttgagcggttattgtagccactaaattttagtgtgcaattcagtagtttcacatctgcttggtttgacaacatattgaactgattatgatcagaggaattatagttagggtttgaaattattgttgtactaaagaggctttaccgccttgaaaatacttcccaagttacactgtaactattttatgatcattgaatcacaagtgaacgttagattactgctgttctgtgcgtggatctgtaattttttttcagcctccataattatgtcagaggatttataattttcttaacattttatgtttattaaaataggctatcatagccagggttaacaaagccagacatgtcaggtgccagtttaagcatttaaatacattttttgaaacaactttattgagatataattcacataccacacaattcacccatttaaagagtacaattcaaaaatttttgatacgttacattttgaatttttttaaattgtggtaaaatacatataacataaaatttgtcattttaaccgcgttaaatgtacagttcaccagcgttaatgacattcatagtgttgcgcaaccatcaccactatttccaaagctttgtcatcatcccaaacagaaattctacccattaaacaataactctccgttctccctccctctggcccctgctgacctgtaatctactttatctctgaatttgactattctaggtaccttatataaggagaatcataaaacgcttgtcctttcacacctggcttatttcactcagcgtaatgtcttccagggctcattcttgggttgcgtatcagaacttcattcctcatcatggttgaatgctgttctatcatatggatagaacacattgggtttattcattgttttttcagtgtacacctgggttgttcccaccttttagctattgtgaataatgctgctatttggatactggtgtacaaatatttgctataatccccattttcagttcctttggatatatatccaggagtggaattgctgaatcatatggtaattgtatgtttagctgcgggacagacccccatactgttttccacagtgactgtcccgttttacattccctgcagcaatgcacaaaggctcccatctccccacattctcaccagtgctgatgctgctgctgctgctgttgctttctttttatttattttattttatcttatttttttgagagaaagtctcactctgtcacccaggctggagtgcaatggtgcaatcttggctcaccacaacctctgcctcctgggttcaagcgattctcctatctcagcctcccaagtagctgggattacaggtgcctgccaccatgcccggctaatttttgcatttttattagagacagagtttcaccatgttggccaggctggtctcaaactcctgacctcaagtgatccacccgcctcagcctcccaaagtgctaggataacaggcgtaagccaccacacccgacctgttgttttaattatagccatcctagtggtgtgaaagagtatcttgttgtggttttgatttgcagttccctaatgactgatgatgttgagcatcttttcagcgcttgttgaccaaaatctgtatatcttcttggccgggcgcggtggctcacgcctgtagtcccaacactttgggaggctgaggcgggtgaatcacttgagcccaagagttggagaccagcctgggcaatatggcaaaatcccatctctacaaaaaatacaaaaattagccaggcatgatggcgtgtgcctgggcaacacagtgaaaccctgtctccaaaaaaaaaaaaaaaaaaaagtgtatatcttctttgcagaaatgtccatttaaatccattgcccattttttacattggagtttttttttaattatttgagtatcaaagtaaggaatgttaggaaccaattcaaatgtttgaatgctcttttaaaagtcactgttagactagaaaaagtagatcttgtcactcctgggccctttctctctttcacagttcttttgtgaagttgtaatttttatagtgaaattgcatgagaaattcttaacattgaatttctgagttaaactggcttttgggctctgctttcttgtaagtttttaaattctatgtgtagattccctccatttcacccacaaaattcaagaagagctcttgtcctatgactgcagaggtagcaggtgctacagagccacgagctgggcccgccctgtcctgccgggccctcgtggaaggacgcatccctgcacactctccctccagcccctagatacctccgcctgagattttggggacctcccaaggaaatgtaccaaatctcatcacacttcagcatcaagcatagtcaaggcttagggtgaggaggtgttatttttatccttcttaacgactgaagacatgtttaggtaggaaaaagaaaaatgaacagtgttaataaaactcattggggattttttttttaaactgtattttctccagtggttacatgccctaactcttctgcctatatctgaggtattctccaaactgaagggtgagaggttgtatttttttttttttttgagacaggatctcgctctgtcacccaggtcccacaatagcccgtctgcaagctgaggagcagggaagccaggcccgttccaaagctgaggaacttggattccgatgttcgagggcaggaagcgtccggcacgggagaaagatgcaggctgggaggctaggccagtctagtcttttcacgttcttctgcctgctttatattctggcctctctggcagcttaggtggtgcccacccccattaagggtgggtctgcctttcctagcccactgactcacatgttaatctccttttgcaacaccctcacaggcacacccagtgcatccttcaatccaaacaagttgacactgagtattaactatcacagaggttttactggagaaagtaatatgtaaaaaaaaaaaaaaaatttatctctcccctcctctcccaccttttcctattcaaaaataaaagacaactgggcacagtggctcatgcccctaatcccagcactttgggaggccaaggcaggaggagcccttgaagccaggagtttgagaccagcctgggaaacatagtgagacctcctctctaccaaaaaaaaaaaaatttaattagctgggcatggtgacatgtacctgtggtcccagctactcgagaggccgaggtggaagagttgtttgagcccagggggtcaaggctgcagtgagctatgaacgcaccaacttcactccatcctgagtgacagagtaagaccctgtctcaaataaataagtaaatacaaatggaagggaaaaaaagctatggaaggagagatttttgaaagtatgtatttttctttcatgaattttctttgtgcgtatttctcatatcctgtagtggctgaacaattcaccaaatgccacattgcgtttaccacagacagaggctgctcccacctaagccactgtcccagcatctctatcccgccatccactgtctgtcagcctgaccctaaccttctccaccgagggctcggtgaatgagcctcaccctattctctcttccaccgaaaagtaacacaaaagcagagaatgtttgtaaaagtttttaattcccactaatatagtaaataaagtgaatatcactttgcaagagtgagagctgttaattgcagtcctgtctaaaagagggcaagagaccccgtgccggcttcagttgggtccttccggcgtaaatgttacatgcaggactctgacttggcaccagcacaaaggaggtgcaaaccccaccaacctaggccccgatgttcccacccggggacacttcattgcttagtttcctgctgcacagataatgtaatagtaccgtcctggctttagaaagcagattcaatttcctacatgttaagaacattcagaccctcatgtcagtaaattccctcttttgaaatgcctatttatgaaaacacaaaggccattttgtcttatttcagcattgaaagcttgttaatgagatgatcaaagtataggctttggtgcaggtgtacatctcttggtagcactaaggacacctggtgtccacgtccatctcccaggcctgcaccaaagggactcctgaagccatcaaatgtccaggctcaggaatgtttaaagtaagatccacttagaagactgagatatgaaggacatgtgttgccccatttgtagcctgtaattagtatttttcatttgctaattgtgtacagtgctcaaaagctttctgggcacatgaaacactttctctgttggaagaataacaaaagctcatcagagattttacagaagtaaaactgtgttccgttttcacccacctgcctcttcagtctcatcacattttactacatggcatagtagcggctctcctttctccttggtctaccaggacaggaagggggctccccaagactcaaggctggggccactggctcgcctgccctctgcagggagcgggcagtccttgggcttccaaaggaaaactcggggccttgtgctgcacccagcagcacacagccattgttgcctcggattcacattccctgagtagacaccctcctccacagagcacgccacactgacgcagcaaaatagctgataccgatcacagctcattccaaacaatgtgaacaggaaggcccgtgtgtgaatccgatcccagaaatgataccttttccagagaaatggaatagctaaatcggttgtgttgtatagttcacaaattaacatatttctcctaataaaattccatttgacaaatgaagagaaatagatgtaggaagtgatttccatctgctgtgtccttaatagtgattccaatacacgcaaagtgtggtaggaacacaataaatacttattcaatagttttgagctaggagaaccattaaatgatgcatttttagaaataattccttttaaagacacttgtatggtagatttttatgtcagacttgaaaactagcagcacttccttttttatttttatttggctcttttggggtttttgtttgtttgttagattcttggagtacagtggcgcagtcatggctcactgcagcctcaacctcctgggctcaagcaatcctcccaccttagcctctcgagtagctaggaccacaggtgcccatcaccacaccaggctaatttttaaattttgtgtagagacaggacctcaccacggtgcccaggtcggtctcgaactcctgggctcaagcattcctcccacctcgacctcccaaagtcctgagattacatgcgtgagccaccacgcccagccttactttcctttgtttcatgaattttggagttttataaagtgtaatatcataaaagattacctgggagcccaaatgccaaagcatcaaaacaaaatttttctaaatggatgttaaatgtccacctttttaaaaaatcactgtaatgactaaaaggctggcctgctaagccatgagttggtgcgatctactgagctggaaatgactagtgagtgaaaacgaccaggcggtcccgggggccagcacttgtggcaattgcacagcacaagagtcaggtagaagccccgcggtgttgctgtgacgaggccaaagagctgctctaacgcaccggattgcacttgtacaattcagtgtgtaagcacatatatgcacttcatatgcaaatgcctgttttggattgttgtactcttttagaactaagatggctaaactctaaaaatattatgaaatctgcatggattcacattcagtattttgtactggtatgattgtggtaagacatttggaaactacaggaacatataaagaaaggttgcccagtggaaattctttctagctgtctgacttggccaaggaacataaaacatccactatccacaaactgggaaaccactgcagtccgacgggctgtgcctggcagagagctggtggcacagaccctctgggtggtgacaatcctggctacagctgccactgcagcctgctcaccgcaggcccagcactgctcaggctgttgtatctgacgcccacaggtgtgcgcacagagagcacagtacgccctgcccgggaggtcccatcgcagtacctgtggatgtgagttaataaggtcagcttaattcacatcactccttttgatatattttaacacagttgaaaacactgtctatgcatacagaagtatgtgtgtttgtgtataaacacatatggatggttgataaatttgagaaagaaatgggttgtgtacacgtggcccacagtttcagtactggctgcttccacaactaaaatgtacacatgaattgataatgctctgtgttttctccgttgatcttattctttctaaattattgtcctaacttcttatttttttttctttttttaaaaaaaggaatggactcttactgaaatggtgtttgatcagagaaagtgggttatataaactaaaattgtgtaatttctgaagtgtataaaattaagccaggcaggtggtacgtgcctgtggtcccagctactcagaggctgaaagaggaggatcacttgagccaaggagttcaagtccagcctggacaacataatgtgacccatctctaaataaattgattgatcagatagataaccagacagacagacctacttctcaaatacagaaaatcacatatgatgactgagtcactgttccctctgtaaggaagatggcaccatctccgtgtgttgccttgcagtggggccaccgcagtgaaaacacagacttcttaccatgcaggtgttggggcctcgtgggcatcagtcactccacgtgtcatttcttttgtaggtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtatgtggggcttgggggacctgattaaattcttccagtgttcatttgggaaaggaaaagttccatgcgtagctggccatgctttgcctctcatgcaatttaaaggtaaaatccaagtttttacttgaattatacttcaaatacgatgctgtaacttgaattctatagaatacccttgagcatcttgtcccttctgccgcgatactttttctcactaagagcagtcatctggcttctctgtaaagctgtctttatcttcatgttcagtgtgcttccaagttcataaacaccctcctttccacacctgagcatcaatattgatagacaacgggtggccaaagcctcggctctgagatgctcttgctgccgaggcccttcgttcctgacactgtgtaaatctgtctccctttaccctttcaaaaaggctgagagctctgacttttgtcactgccaaattcctgtgcgagaggacgaccttggtcagagctactttctactttcttttcccaatttccttaacccttcaagccagcctcggctcatcacctcttttgaaggccacccccacacaccttcccagcctgcctgcctctgttggacgtgctagccacctgtccttttgcatcattgagcggattttattgtgcactcatcatgaacaaggtgaaaataggcacaaaataagcaagacctcccggtgcccagggagcaggccacacagtggaagagagtgaccatgtcacaccaccaccttacagccaaacgtgaagggccaggtggcgtgtgcagcaggctctcagaaacacatgggcagttaccttagcacaagtctaagtggttagaaaaagtccacaagaatgaggggtcctccaaactgagcctttcaagatggttttggaaagagatcattgaaaccaacaaaactaagacaagaaggcaagtgatagaagagtaagaagctctggagcacgggcagccatagtaaagtgaggccaggctgagtcgggttaaaggaaggaactgctgtggtgtagtctcttccatacaaatattcaggttattttcattttataaattccaatgagttttcacattaggaactaagaaaggaaaattatgttttgggttttttttttttttttttcatcaatcctggcctacagagaaaataatgtttctcaaggctttcagtgtgagcactttgcacaaaggagcatggtttcctagaaactgtagagaccagcgccacggagccctggctgaagtacagggcgttcgtatgccaaggagagactggcagtcgtgggaagtgtcccaaaaacttgagccccttccccagatgcaaaattagctatcgctatgggtaacgttagaccttcaagagaagacagggacaagtggactcacaatgtgctgttttgcataaaagcatgtgacagggcaaggaggaagggaagtccaggtggggaaagcagagccaaggtggccgcgcagctgccagtggcttgggtgccactccacatgtcacagaagccttcacgtccctgccaggaacagagcatgaaggctgccagggcggcctgccatgcctctgatgagggagttcagtgccaggacccactcaggccttcagctgcaggcccagccccccaactcgccctcgtctgtgtcccccacgcacgcttgcgcccatcttggcttctgcttcttagaggacctgatcagcacagagtacattccagaatcttttccagacacatatgcataaggccaactcattcttaattttttttttttttcctttgagatggagtctcactctgtccctgaggctggagtgcagtggtgcgatctcggctcattgcaacctctgccttccaggttcaagtgattctcctgcctcggcctcccgagtagatgggattacaggtgcgtgccaccacacccagctaatttttgtatttttagtagagacggggtttcaccatattggccaggccgatcttcaactcccagcctcatgatccgcccacctcggcctcccaaagtgctgagattacaggcataagccaccgcgccagctcattcttaacttttagatgtttttttcacacccaaaaaaagtaactggttttaaaaactggaaaaatttaaagtttaaaccatcaagcatcttaagcttctgttttctaaatcaggcttaaaatattacccccaaatatattggtgggtggtgggtgggtggatggatggatggatggttttgtttttggtttgttttctttttagacaaagttttgtgcttgttgcccaagctagagtgcaatctcagctcactgcaacctctgcctcccaggttgaagtgattctcctgtctcagcctcccaagtagctgggactacaggcgcctgccaccacacctggctgatttttgtatttttagtagagacgggatttcaccatgttggccaggctggccttgaactcctgacctcaagtgatccacctgcctcggcctcccaaagtgctgggattacaggcgtgagccaccatgcccggcctagatggttgctttttaaagtacaaggtattgaactcttaagtaagaactagcctaggagctgtgatgcgattgtgccttgttttgaatccacgccgcactctcatgcatgccctcccctcccccattacctaactcactccttttctgcaaagttcatcccagctcactgcctctgaggaatcagccctgattcctgagcctggcacaggctcacctgccattctctcagcatcccacccatacacaccgcaccacaacctcaggatctctaagctgtaggcttctggcaggagaagcgtcagccccatgctgctcagagcctccaagtgctgctgtgagttgtgtgcagatgaagggtgttgacagtagttatacaggtgaagctcctcttcccagaggcatacatgctgtgatggggacaggccaagtgtcctggtgactgcctcgaactcccagatagttctgtggaacgtgcacttgtgtgctggtttactacggagagaaaaagcaaatagggtagggtatgaacagtgttgaatctgggtggagggaggtgggcactcattatgttagtcttgcagctttgtctgtttttgaaagttttagtaataaaaatggggggctgagtgcagtggctcacgcctgtagtcccagcactttgggaggccaaggcgggtggatcacctgaggtcagaagctcgagagcagcctggccaacatggtgaaaccccgtctctactaaaaatacaaaaattagccaggtgcgatggcgcatgcctatagtcccagccactcaggaggctcaggtaggagaatcgcttgaacccaggaggcagaggttgtagtgagtcgagatagcaccactgcactccagcctgggcaacagagtgaaactccatctctttttaaaaaacaaaaatggatgggctaggcgtggtagctcacgcctgtaatcccagcactttggaagaccaaggcaggtggatcacctgatctcaggagttcgagaccaacctgaccaacatggcaaaaccctgtctccactaaaaatacaaaaaagccgggtgtggtggcgtgcgcctgtaatcccagcccctcaggaggctgaggcaggagaatcgcttgaacccgggaggcagaggttgcagtcagccaagatcacgccattgcactccagcctgggcaacaagagcaaaaatccatctcaaaaaaaaaaaagaaaagaaaaatgggggaaccaccctctagtggcttcccgtgagtaagcgccagtgcactcaggccctgttcccctgccctcctactgttcatgcccccactgccctctgcagtggtcctcagccagccccgtgctgacaactcaggacctctcctccctctggtccttgctcagatgtcacctcctccccattgaagccaccccaccgcacacgcaccgccgctgcctgttctcctgccctgctgccctttgtatgtgacttatcgtttctagtaaattaataatcatccatcacctgtctcctccccactagaatgtaagctccgtggagtcaaggatttctgccttgctttgttcagtgctgaatgctcagcagaacacagcacgccctcttgacctgacagatgggggaggcgggtggataggtggaatggcctcctttgagttgtctcctcagcatctagccagcatctagcataaatgtttacggaataagtagagaaataggtgacaatgttcttgatgagttgatgtacaagaagttgtctgcctctttgttgaaggctcttcagggttacaggttacagtctagaatattttgaatttgtagaaataatcataattttctggtccaaggtagttcattacccgactcacaggtttaacagcaaggacagccacctgatgtctcaggcacaacctccagcaagccatccacttgtgtctttcaggtggcagagcgagctctctattactggaataatgaatacatcatgagtttaatcagtgacaacgcagcgaagattctgcccatcatgtttccttccttgtaccgcaactcaaagacccattggaacaagtaagaaagaactggctgccatctttttcagtcattttaaaatatggcacgttttactgctacttcagtaagaataaatatcagaattttaaatatcaattaaaaaacaagaaggtcagttgctttgtggactcataaattaagtagcagcgtgggttgtttctgtggccgttgaatttaccaccttataccttcattcctgccagtatagaggcacattggtttgcagccacctcccagtagcagcagtttctaggcctcttcctgagcgtcctgcagagaagctgaaggtctctgcagagcccagtggggctcagccccggcgggggcacagtggccactgcattctcggggtgtctattgagctctgctgacatgcaccctggatgagcccctgtgtgagacccaagaaccaccccacagtggtcactacctggagaagaagagggaagccaggtgatctgaacacagccccatagtcccagcagccaaaaacatttcctcctactccgctccttcatcttttgacttaaagaggatgaataaatccgtttactgagcaatagtcttctgagactttaaaaggaaactgttgatatgggtgccacattatttatttatttttcttttttaaaatttgtattttatttgtttatttttagacagggtcttgctatgtccccccggctggagtgtagtgtcacgatcatggctcacttcagcctcgacctcctgggctcaagcaaacctcctgcctcagggtcctgagtagctgggactacaggcacccaccgctacgcctggctaatttttgtattttttgtagagatggggttttgccatgttgcccaggctggtctcgaactcctggactcaagtattccacctgcctcagcctcccaaagtgctgggacgacgtgagccactgcgcccaggccatattatttattaatatggtatcatctaatattcctgctatttaaagaaatacgactgagtttttctttccccaccttctttcatctctttccattgtatattgtaattataactcagaacttaaagaagagcaggttatgctatccagccctcctcccttagtttatgggtgaggaaggtgagacttggagggcattcgcagcccagtctgcggtcccaaagctggtgagcggcactctggcccggtgcggtctcctaactcgcagtgtctattgggcacccctctggctgtgctgcacagtcaccctgctgccggcggaccagccctctcccatgcaccctctctccttgtccgctcgaggctgcaggtggcactgcctccttcccagaattctgcagggcagcagccagacaggtgttagccctggagctctgagccagacccccgagcgagcgtccagccagtccactcgcgtcaagtcttctgagggttgccgcccagaaattcaacagagaagggcaggcagatcagagtgaggatgactttggttcacattcctgccttcctcctgagcagctgtctgaacccggggaagttagctctcaccaggtctttcttagccacagtttctctttggaaaaactgagaaagtaaagtgctttgccttgcaacaatcttcacttggttgtgaggattaagataaagttaatatgcgtaaagtacctggcttatgataggcaccaagtaagcatttgctgtcacttagtggttgtagggccagcagccatgctgatagcagtggaggcagcagccaagaccctcatggcaatagcgtggtggttgtagttgttaatacagcacatccaccctcaacaacctgttctttgtagcattgatttattttatttatttatttatttttgagatggagtcttgctctgtcacccagactggagtgcagtggcaccatcctggctcactgcagcctccacctcccaggttcaagtgattctcccacctcagcctcccaagtagctgggactacagacatgagccaccactcctggctaatttttgcatttgtagtagagatggggtttcaccatgttggccaggctggtcttgaactcctgacctgaagtgacccacccgcctcagcctcccacggtgccgggactacaggtgtgagccaccgcgcctggcttgcattgatttttttttttttaatcgcaacaatgacaacaaagcccctggagtgtcgccatgtttcttgtgtgtaatttagtttagtatgtaagtcagcacaattcataactgacttccaatccccgcccattgcaaagaaaaaaatgttcttttaagtgttttctaagtacaacttgggttttattacaaagtggattaagaaggaattatgatttgagggttacgttttttgggatttatttgtttttagctactggcacctgttgctcacagtcctgcgggtcgagcaggtcctgctgcgcaggctttcgctggtgtctgctgggggatcggggctcttacagggctgcagtcccatggcagctgggactagagtcacccagaggctcagctggaacaatttggcctctttccctctccatgcgtgtcagagcctgagagctaagcattgattaagctgttttatgctcattttattttctctttcaaagctctgtgttgccattattaaaattaatttttctgtcctcagggaataagatgaaaagaaactgacatttataggaaatcaagtattgccattattgtcctctttataattttgtcttaactatatttgttcaagtttcaatgtttttaattcagtttctgagcaaggtcgtttttggctactgtcagctggagacagtgagtggagtggcctctgtggctatgtgagagccactgtgaagaaagtctcgggatgtgtggctgtcagaaaacaagtaacgcggaatgagcaggccttgcattttagaccttagggatcctgtgcgatgtgggactgttggaatatggagcagcctgagagtggagaggcgagggctcagcaggaatgcgtgctcccaggctcaccgtgcggttttctttataggacaatacatggcttgatatacaacgccctgaagctcttcatggagatgaaccaaaagctatttgatgactgtacacaacagttcaaagcagagaaactaaagtgagttgttcctttcacaagttactgtttccaggatttttttcttaatcctaagtaaacctcttccactgttttgtcctaaaacggtattcttcactcgaaagcaaaaccaagcctttcatacttggaaagcaaattaaaactgtgttataataacgtattttgaaagaacaggtgtttaaaggtagctattctccccccttgtattgccagattaatcatctttgcaaaaagtgcttatgtaagcaagaatttaacattcagaattttttcttttcttgggctataatgggcttaaaggctataatgtgtagtccattttcatgtttataaggcagggatttgaattatatcctataaggtttatcccagagagcaagaatcttcatttcaatgtagctttattctgatttaatgaactcagcgatgtgggtgttctctggaatctagtctgtcctttgcaaaatcagggtcctgccctcgtgcctttgagcccacatgtgtccagggatgatctaagtgacaaagtacttcgtccctaggctgtgcaagtaataatgtgattaaatagttgttggaggtcacttcttccaagttgagtatggactattggcagattttattttttgcttgtcacttaaaactggctaaggtagataagctttgcacgaatgtaattcaaaatacactgtatacatatgtgtgtatctatgtgtgtgtgtgtgtgtgtatatatatgaaacaactgccatttagtcattccttagacaaatatgtgaatatttaccttatacaccaggccctgttttagattctggcaatatagcaatgaataaaacccacaaaaatccttgcccctgggccgggtgcggtggctcacgcctgtaatcccagcactttgggaggccaaggcgggtggatcacaaggtcaggagattgagaccatgctggctaacacggtgaaaccccatctctactaaaaaataccaaaaaagggccaggcgtggtggctcatgcctgtaatcccagcgctttgggaggccgatgcaggcagatcacgaggtcaggagatcgagaccatcctggctaacacaatgaaaccccgtctctactaaaaatacaaaaaaaaaggccgggcatggtggctcatgcctgtaatcccagcactttgggaggccaaagcaggcagatcacctgaggtcaggagttcgagacaagcctggcgaacacagtgaaaccccgtctctactgaaaatacaaaaaattagccgggcgtggtggcaggcgcctgtggtcccagctactcagagtctgaggcaggagaatggtgtgaacctgggaggcggagcttgcagtgagctgagctcacaccactgcactccagcctgggagacagagagagactccgtctcaaaaaaaaaaaaaatacaaaaaaaaatcagccgggtgtggtggcgggtgcctgtagtcccagctactcgggctgaggcaggaggatggcgtgaacctggaggcggagcttgcagtgagccaagatcacgccactgcactccagcctgggcgacagagcgagactccgtctcaaaaaaaaaatccttgcccttttggggtttatattctgggtagtgtggggaaataaaagaacacaaaatacacctaagtgaactatagagcatgagagatgacaagtcagtcaggaaagggccggggagacagaccagccattcctctagagctgccagctgcatggtctgttctcatctcagctctcagtgcagttcgcaggtaggaagcatgcaagcagcagggccttctgatggcagatcctcctctcgtggaatcccacagctttcccaacaggaccttaaaggttgtgtagtacattttctgggttgaaaaacttggatcctggccgggcgcagtggctcacacctgtaatcccagcactttgggaggttatggctggtggatcatttgaggtcaggagttcgagaccagcctggccaatattgtgaaaccccatctctactaaaagtacgaaaattagccgggcggtagtagcacgcacctgtaatcccagctactcgggaggttgaggcaggagaattgcttgagctcgggaggtggaggttgcagtgagccaagatcctgctactgcactccagtctgggcgacagagtgaggccctgtctcaaaaaaaaaaaaaaacttggatctgagttaagcgattgaaagtcatgtgactcgcagtggagtcagtcaacaacccaggtctcctggctcttaagacgtttcctttttaatattataggaatgggaatgctggctccttttacagtactggtccctttacactgtactgcatactcgttttttcagtggatatatgagcttcttgtcaaaattatgtgggtcccatgaagaaacatctaaccaggggaagggggaaggattgagacataagacgtacttatataagatttcttttaagaattccaatcttggacatgttaaatttttttatattttctcatgtttaaatctcagttcgtttttcatgctgtgctcagcacgtaagtgtggggaaatggagcaggggggctgcgggaggagccgctggctgggctcaacatgcctgtgccttttccccttcagtgtgttcttgtgtctgatgcatctctaacacagatgacattttactgtttttcagagagaagctaaaaatgaaagaacgggaagaagcatgggttaaaatagaaaatctagccaaagccaatccccaggtactaaaaaagagaataacatgaaaacgcccagggttacttgaatgtttttataagataggaatatatgtcttcaccatggggggggtctcgatttcactaacgttgtatatgaaaatgtctgcaataaaaagtacttttaaactttgtaaccctccttttgtacaagtacttattttgccccatatcgttttaccacagaattgacttttttcctctgctttttaaataagatctgaatcttatgcatatactgtggtaaaaagaaaacttgaatacagcctgagactgtgcctcctctctcagatatcatagatgctgtcactcaaacagcatttccctttctttttcatatgaaattagttctaaaagaaaggaaattagattggaaatagattaagtatgacgttttgatgtcctctttctttgtatgaggtttctgtaagcccagccttttatcattaaaaatcagctgaattctgccacattagcagccaaccctccttcccaccccagcagcgggtgccagtgtgctctggtgagtctgcgccgatggccggacgtcccggagctgccggcagttccagctgccggggctgccagggtccgggagggtttcctggtgtcatggtctttgggtttgatgtacgctgctgtaaatgactagagcgttatgacagtttcttcacgttctgtgtgcctgattataacagtgcctcttaaaaagaaaatctttttcagaaaatcttttgtctgaatctttgccactcttaagaattctcaagctttccttcaactctccagaaaagattttaccgaacaatgtatttcttttagtgagagatatgcatagttacctaagttggtttttagatttctctgacacttaataaaaagttatacatgaatataaagttaaaagtatatctttacctatataacaacatactggtttgtatactctgataaaactgcaatcaggaaactcaaatcaggaaaacggaatgacatttctaattgtgagcccttgagtccacctaaaacaggtagccagcatttttctagcagttatttactcatgctgacagaaatgctgttttaagattactgtctaaaactgtataatccttaattgaggtaggtagctataggcgtctccttttaacgaattgaatttatgttgaaagtgtggttaaaatactgatatttgttttaaaacatggtaacactataaacctgggcaagtttataaggcccagccctgcctgacgctgccctgcgtgtcttgctttgttctgaagagcctcaggcaaagtgggtgctgatagccctcaggattgtcaaggaccccagtacacatgcagttgaaatcagtagcctcgaaaacatgtgagaaatgaatacacacacacacacaaacacacacacacgaatcagaaggtctgattttatgtacctagaatatagagataacttattgaaaaattgcataaaattgttacattacaaatcaagagctggttgtttgtgttgacaaacatggcccagtttcactactgcacatactgtacgtaaccaatgtttcttctgaaatacgtattgttctcttttttctttttctcaacttttcctgaatgttctcaagtaactttctgtattctttttggttgctctctttgcaaacgtctgtggtggtggcaggcatgccgtggttctgcataggagctttgacgaactgtgatgctgggagcttagccctgccttgtcctcatgtctgtgttgacgccatctgtgacgcagtccccatgagtctcgtccacatgctctagtcgcatggcacatggtctcctaaacagaaaatacttcatgggtcaatacctcagagctggaaactctggcctcgtacttgcttctcattctcaggagaaaatatctaaattctgatcactgcttcccattacaacagcaacaaaaagtcaataattttgtggataatacagtctggttatttctgtagtgaaaatagttgggttttcaaagtttggttttccatctcagatctgcctgtggagaattggtttgcgggctttgtttttaaggtgggttcccagggactcgctgtgtgttccctgatgccccccgtccttgcagaccgagccttcgtccactcaaacgtgtgacagcacgtacccagcaggcgttggggacccgggaaggctgcggtgccctcaggagtgtgtcttatttgagcagttatggcaactttattggggtttttaatgtcacagatgatttaattttctaaaatcatgaaacattggcagtttctaacataaatgtgtttctcctaatccatcaaaaggggccatataatattttactactcacttcccccagcttttgtgggaatcatatgaaatgaagacaggcacttctgtgagactcagagtagctgtggctcagtgtttgcaacgaccaaaactgccatgagcaacccagggcagggtctgggacggatgcctgcctttccttcgagagaggagctcatgtgcggaatgcacctcagtgaaggtttttgttttggtttggtttggtttggtttgatttggtttggtttgtttgagatggagtcttgctctgttacccaggctggagtgcagtggcgtgatctcggctcaccacaacctccgcctcccaggttcaagcagtcctccggagtgcctcagcctcccaagtatgctgggactaccaggtgcacgccaccatgcctggctaatttttgtatttttagtagagacggggtttcactatgttggccaggctggtctcgaactcctgaccttgtgatctacctgcctcggcctcccagagtgctgggattacaggtgtgagccaccgcacctggccttcagtgaaggtttttattcctagtcagaaccctctcctgccagtgcccgctgtgtgaggtttattttgctgtgaacatctggtagcattcttgtgtagggacactctcctttgccccgagggccagagagccgtgctccaagcggaggctgttggtgggtcccatgaagagcactgcttgttgcctggagtagtcaaaagcagaagaagcgttggtgtgaaacagtccccgcaagtctcaggagtcttgcagccacttaggtttctgtatctcccacctgactgtgagccccctcgaggaaaggtgctgtgtcctgaattgtggaaatttctagggatacaaagatgagaacaagacatagcccccagcctcagggagcttacagtccattaggagaggcagatgaattcagctcagatgatcagattgtattaataacatacctgggggagtgtgctggagatggcaggaccagcttattcgttcccatctctaaagaaagacacacacagtacgggggcctggcctcttggtttgactgaaggggcctcacccagtcagacttgagggaaggtgcccgcggcagaggtagagaaaagcagggacacagtgggtgacaggtgtcggtcctggtggggtgtcagttatggggtgggccggtgcgatctgctgagaggtgagggtggagagggagcagaattcccccaaaatgtcagcagatattaaagagccataaagggcaaaatggcccagcccgacttgcatttttgcaagctctttggcgcagcatggatggagtgctggggctgtcggggtagggtgtggagatgtgtggagatcgtggtgctgggcggagctgtgggagtgaaggcacagggcgctgaggacctggtctgactggccttcaaggaaggaacccagctgagggtgtgtgccccgtctgtttttgggggacgtggaagccaggtgggctgagttgagcagcagggcctgggcctggaggcatggaagccagggtgaataaggagggacagagggtgtgggaaaaggccgaagacagcccacagaggaaggagcccaaggcacctggaggagaggctggggtcacagagaccgagggagggtgcaggttcagggctgaatgatggcgtccatggtcatcattcctcagagaggcccagtgaggcaaggccgggaagggcttagcagccagagggcacccataggcctcatgccagaggtggctccgtcagaggatgagggccaacaccagacggtggctgagaacggagctgctctgggctggcagggtgtgaggggcaggggtgagggggcagggggtgagaggcaggggtgaagcaggtcagcaggagggcgctgctgtgacaggagctcagcctgaaagaggccgaagctgtgggactcactgggcagagaatggaggggtgtggatgagagcagcctgggcaggaacccccgctcccctctcctgaactcagaggccctgagcaagttccccagcccctccatgtcccagttcccccatcagccaggtgagggtggcagtacacacacacgaccacgcaggacaaacaggcgccccacacagttcccagctcacagcagacacagatgccacttccttcgcctgtgccctcagagccagcagacgctcgtcacagtcatactgtcctgtgcaccctgtctcatggaaccctcacagccaccctccggggtgaccttacccccgcactacactcatggaaatggagtcaaccaggcccagtgactgagggctgagccatctgtgtttcaatccagagcacagggagagtggagaagtcccagggccgcccgtagggaatggagagggagcgtcaggctcacccaggctgcgtttgttttggtggagagcaagtcacccgggatgtgatgagagggtttcataagcaagccgggaaaatgggataaaggggagagagaaccgtgccagctgtctcgatgagaggacatgatcgtgagaggaaagggaaaagaatcatgaggttggaggtcgctggcaaagaatgggcggccagaggtgagggttccagtggtgagacagctcccaccaccgagcccagggtgcgacctcgcacttggctgctcacgtggagtcagaactgcagaggccatggggtgtgggccagggtatgggcgggccactgtccatcagatgcagaggggtcaggaggggaccagctgctttactgtctccactgagtgctttctggtttcagaagtcagcagccgcatcatgttgcaggtgtaggcgagtctcccactgagtgggcttcctgcgggagagggccctggggggcggcaggggagatgagtccctagccaggatgagaagcttggagttcagagcctgggcacctaacagagcgactccacgctttgcattgcagtacacagtgtatagtcaagccagcaccatgagcattccggttgcaatggagacagatgggcctttatttgaagatgtgcagatgctgagaaagacagtgaaggacgaggctcatcaggtaaaagtgcaccgagctcagctgggcacccatgactgatttgcttaagaaatgcacatttttgtaggcgatgtgatttgcatcagtgccttctgtttaagctgaaattaaaacttaaattttgctagtcttataggaaacattgtatcgatagatcttagtgatcaaattactagaaacagtttttaaggattaagtatgtgcctgagatgtgtatctccatttactaacagcagtagtaatcccaactcttaactgttctttaaatgttcactccagcaaaatcgaaagcttcacagccatatccacccctcgctgttttcttcacagccctctggcttctgcttcgacccagagaggctcccttagctcttcacagcgggtgctaacaacccctctccctaggacacctcaccctccttgcccctccccctgtcccctcacccccttgcccctccccccttgccccctcacccccctcgccccgtggccttcccccctcacccccttcatccccctcgctcctctggccccccacccctccccccacccctcagccttctcccctcgcccccctcatccccctcgctcctctcgcccccccacccctccccccacccctcagccttctccccttgcccccctcatccccctcactcctctcgcccccccacccctccccctctcccccctgacccccctcgcccccctcgccccttcccgggcactgtctttcagtgctttggtcacaggccacctccaaagagagcctccgaccactgttactcctcagctgggcctgtagacacttaggacaactgactcagttcctgcctgggttcaaggagcgtttcagctgccgtgtttccctgagcgtccctccctgtttcaaatgcctgtaaactaaaacagtagtcccaaatggcctggggacattggcctttctcactgagaaactttaacctctttttgaccagcgaaagaattccaaaagacatccccttctaaaattctgaggtaagaagtgaaagtaggcgccccgcctgtggagtagccattgttttactcctttactgcattaaataaaatatgttgtttgaatgaatgccccccatttcttttttacttcttgaatgtgactgctagaagattcggaattagcacatggctgacgccatatccccggctcctttccggagttgcacaggaaagggctcacggcaccaagtccccacggcagccacggtcatcggcctcttctgcccctctaattcctcaactcaggttaagagcaaaatagatgactgaatgcttttcttagctcatcaaagcctgaaaatactagaaatacagtggaaaagctcactgaagacttggaatatcagtaactaattttctatctaatccagttggttccatattctcctcaccatgaatgttcttagcaatgaatagatgtcatcaaaaatatgaaaatctgtatatatttctctctttgtgggagtgttaatgttcttcttgatatttttttttaactcaggaatttaaggttgcctttttataccattttgattttgtggcttcaaatttgctcaagacttgttaagttgaccttgttactgcacacagaaggaaatcacagtcggtgtctcttctgtgagggaacctgcctgggagtttgtggccacgtgttcatttttaagacacgaggctatacacagttaaaaagccaattcttggccgggtgtggtggctcacgcctgtaatcccagcactttgggaggccgaggcaggcagatcacctgtgctcaggagtttgaaacaagcctggccaacatggggaaaccccatctctactaaaaaatacaaaaattagccaggcttggtggcaggttcctgtaatcccaactacttgggaggctgaggcaggagaatcgcttgaacctgggaggtggaggttgcagtgagccaagatggtgccactgcactccagcctgggcaagaaaagcaaaactccgtctcaaaaaaaaaaaaaaaaaaaaaaaaccaattcttacacattaaatagcttagggttggggaatttttatttttggtatagcctttgacttaggtcagaattaaagctagacaaagaataaactaggtccaaaatgtgatgtacctgaaaggtgtgtgcatatttgcaatttaggtcctgctctgtagtagatcaagaacttgatcaagaatgcaaaccaaaatagcattctctcctgagtaaagctgcctttgaaagtcaggcctagtatctgtgtgatattcggggccccagaacgtccaactgcttggtctgtccactgcccttagaaaggggcacgtcccctcctgggagggttaccttatacagtgacaggaaggaaccagtcctatggccatccacgtgtctacttgtaaatacacacacaggcaggacagttcttggagaactcctgtagcatgtctgcttccttgttttcacaactcttgaaattgtattctgtcaccgggtttcctgtgtgactgatattcttacaacagtgattccctcacctcatccttagatctctatgaattatgttcctgagtcagaagactcagaagagtcattgggatgtctgttttccccagattaacgtgctctccattagaatctcagcaggctttttatcctcaagaagttgagaaagctaattctaaaattcacatggaaatgcaaaggatctagagtagccaaaacaactgtgaaaaagaacaaagttggaagactaataatactatgcaattccaagacttcttatagtttttgtttgtgtttggagacagggtctcactgtgtcacccaggctggagtgcagtggtgtgatcacagcacactgcagcctcaacctcctgggctcaggcgatccttctacctcagcctcctgcagtgctgagattacaggtgtgaggacctgtgcctggcctgactccttgtagatttctgtggatcagttgaatcaattgaattcagttgaattcaacctatccagatgaaggtatttatgaagtgcagtctctaggtgtaatatttgaaatgataaattctgctttttttttttttttttttttttttttttttgagacagggtcttgctctgatacccaggctggaatgcagtggcacaatcttggctcactgcagcctcggcctcctggactcaagcaatccgcccacttcagcctcccaagcagcagtgactaccggcaccaccacactcagctgatttttgtatttttagcagagatggagttttaacatgttggctaggctggtctcaaactcctggtctcaagtgatctgcctgccttggcctcccaaagtgctgggattatgggcatgagccaccgcgcccagccaataaacttttcttaagttgaaaaatgtttggagtcgttttctggaaattctgaaagcactatggttaaagcaaaaagaaggtaccaattcaagtctgcagtgagctatgatcgcaccactgccctccagcctgggtgacagagccagactcggactctgaaaattaaaaaaaaaaaggtaccgggatgcaggaaaaacgtgcacaatttggtgaccaaattgacgtaagaaatgatagctgaaaattaagcttttttggtttttatatatagtcatttgattatattcagtgcccttttaattttattttcagctaactttatttttccaaaataatttcacatttctttgagatgatgtgagtgttgggtagggagaggtgtgagaggtagttgaaggaatagctggagagtgggaagcaggctctgatgctgatggatggagtaggctggatttttgtggagaaattcaaccatgtatctacctatcctttatttacatttccttcaagaaactagtataaccctatacagaacattcaaagaaaactagcaaatatcatgtgaataacatttatattatagacattttaaatgtttgcaattctcatttttaacagttggtcgggagaaaagcagtgtcaaccacgcaagtaaggaaggtgtagagagacggaaggtgggcagtgcaggctctcattactcaacgtgtagagcacattgaaggcctgttctccaggagaagaattgacgagttaacgtggacatgaagtattttcccttttgtccatgtcattccagattgtgatggtcaaaacaaagaaagaaatttggcagctgggaggccgggcacaatggcagatgcctgtaatcccagcactttgggaggccgaggcgggcagatcacctgaggtcaggagttcgagaccagcctgaccaacatggtgaaaccccatctctactaaataacaaaaaattagccggacgtggtggcaggcacctgtaatcccagctacttgggaggctgaggcaggagaatcgcttgaacccaggaggtggaggttgcagtgagccgaggttgcaccattgcactccagcctgggtgacagagcgagactctgtgtcaaaaataaatataaaataatttttaaaaagaaagaaatttggtggctgggcaccatggctcacacctgtaatcccaacactttgggaggctgaggcaggagaattgctcgaagccaggagtttgagaccagcctgggcaacacagcaagacctcatctctagaaaaagaaaaaaaaaaaaaatagccaggcatgtggtgcgtgcctgtagtcctagctactcaggagactgaggcaggaggatccctgaagcccaggagttggagtctgcagtgagctgtaatcatgccactgcattccagcctgggtgacagagaccctgtctctaataaaaataaaaaaaaaattttaaagaaatttggtcccttaagaaatgttgattatttctatctgaaattaagtagtaaagtttgaagttacacctttataagaggaaggaaacttgcatagccatgtatgcccaatgcctggtgtgctttcagcatttacggtttacattgagccttccgggtctgcccgtgggctgcagaagagaggccacctctctctgacttgtgtctcctgtggtccgctccgcccctgccagcatgttcacctgcacatcccctctgccaggccgttcatcagcctgccatctgcatgctgtcttattctccctgcctgctgctgctctcatttttttgccttgtggatggtaaaattattctctgctttacacatcaatttaaaatgtctaagcagaaaggcccagatatatccaccggttttctgtcctttcagaagctctggggtcatgtttgtgttctcagtttgcattcactggttccagctccaagctttttactgttgcctttttctatgaatatgtttcttctctttggagtgcctatttcagctgtaattacatatttcaagtatataaaaatcttggttttgttttgcttcactttgttttacagatcaacatagaatgggcataaaattcagggtagaatttcacctctgggttgaaggtagacatgctttacatcctcacacgttaacacgctcttacaagtaccgtgatgggtgaggggaccgtgaccttcaccatctccagagatggatgattctcctaaaaccctcacgctggtttccagggaaacaagaaaccaaaagtcctgcccctaccatgagtgaatgttaatattcaaataacatttctagaaataatcctaaagtgatgtgacaaaattctttttaaaccttgacattattgctgttttcatcggtaaatttgcaaagaaccctgctgagaaacacttagcaaaaatttgaactttacattcaggacttctgcaggtccttgaatttttcattaaagcgaaggaaaatgtattttacatccatgtcaaaatcagacatctggaatttgtaaggcgtttttacgcttacgttctttttgttgtcaaaagactgacttaaattttgtctgctagacataccacaaaagtaacttagtctttttcaatacactgaacaaaaaggaagacttaattttggtgaagaaactttatccagaaaagtttctaactaattggcagtcagtcttctggcatatacatcatgtttgggtgatttagatggtttattgttttgtttcagaatattggtattaacacagtgtctctacttttaaactgaattatgtgtttattcatggaaatggatgcttttgatatgtaaactctccaaattaagtttcccttttattgcagatacagttatccaaatcctcatgcaaaaatgggattcacttaatttttttttaagtgaaaccaaaatttcctagactttagaaagacaatggattggagaagagagtatatatttttttcaatttgatagaagtttgaaatccaatttaaatatgttttttattcattctttttctttacctccaaggaaatttctacatcttttttttttttgagatggagtctggaggccctgtcacccaggctggactgcagtggtgcaatctcggctcactgcaacctccacctcacgggttcaagcgattctcctgccccagcctttcaagtagctgggattacaggcgcgcgccactacacccatctgatttttgtatttttagtagagacggggtttcactatgttggtcaggctgatcttgacctcttgacctcgtgatccgtccgcctcggcctcccaaagtgctgggattacaggcatgagccaccgcacccagccagaaatttctgcttcttgaaatgcttctgtaggggacatgcccatgaaatggctttaatgacatttatgaaataggaggttacttaggaaatttactaaaatgcatgaattctgcaaattagaggtactgagtcctttgtacaagcactgcacatttcagaagaccagaatgccagtattgaacacacaggtcctcaaacgagtcacgatttttagtagcaagacatttttggcaaatttccatgataagacctacgccgtttccctgtggccagggtgccgccagcgagtgggtgaggcacacgtgcctcgcggttatcctttgacttccacctcagaagtaagcttgcttttcagatagcttagtttgtagccaacgccattgcatttctaattccaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtctcttcactttgatgagtgacatgaacaccgtgtctccttctcttgtgtgtacctaaagccatatttccaagtctgtggtactccaggattccaggagtaagcctgtagaagagatttattttaaaagagattgctctgaaatttatcttaaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttcatattttgtacaaaatgtcctatgtacagaataaaaaagttcatagaaacagcaaatataggtaagtggcacaattatttttctttagaaaatatctgtaactttatgcattagtgaaatgttaagtaccgacatattttttaacattttgtaattcaaaactttttgttttgacattgtttatgaagagaaacttcatacacttgccatttaatatgctcttttatctaattttcaaaaactctaaaaaacggtgtatcatatggactaaataaagaacatgtgaattttattgctcatcatgaaactaaatttagccatggtgttgagcaagctggctctgacgttatcgggttcccgttaggtcagggccgcccacacacagggacgctgactgcagaggggctggccatctccatccagcccgcctggagcgctggctgcgccagatgctagccacagctgttcaaagctaagtctatccactgatttttttacttacttagtggaaaaggcagtgtgactttttatagaccgcctcttggtttggtttgggttttggggctttttttgagtaagaaaaggtgaatcaatacaatttatagaaatgaaagtcttgaaaatagggaattgctgaaagtatgaatttaggatcctagttcgcccacctcctcctcagtggagagatcattatcctcgctgatgctcttgcgagaagcccatggaaacaggactaaagtgttatctgctcgtgtcgtggttataacctcacctctccatagctgcgtgtggtcagcacgccggctggcgtgggagggcaagctctgtgcttagcttccttctctacccagtggcgtctgtgctcccttcgcactgacagaggtgcagacgccgtcactctgcagctgggggcacgtggacgaggctgagacccaggcagagtgtggccttcgcccaagggtccggtaactttgctggctgtttcgaagaaccgcacacgccccacttccacctaaaagtggactcgccagccagaagacttcacatcctgcaccgctactcacgtcgatgtttccgcagactagatgctcgcccgctgcggtccttatccctcatcttaaaattggaggaaacctggtgtttagtaacttcctacagcacgagagttcgagaggactcactcacagaggcatgctgcgatttcagcccagctgcatgctgctgctattttggggtagcaagaagcataaaggcaaaactgtactggcttcgtgtctccttccgtgagggttggcagcacccatcagcagtaatgacaaggagaactcatatttcttagcactgcctttatgccaggagctgtggtgggtgcctcatttccctgggttaatttacttagttctcacaacccaccaaataatttactactattatcctcattcacaaatgaggaaactgaggcacacaaaggtgaagtcacttgaccgaggtcacacaaatattgagtggagccaggtttcgacccaagcagtgtggcctggggtccaagccccgaccgtcatgttacatggtggaaatgccttctagatgggcagcatcatgggtgacggtgaacacaggtgagggcctggggacatgcccgcagcaccacgccaggccataaggaacacacccaggtggacagtgtgaagttacggtattgtcaacctaaaggaagaaactgagacaaattaatatagggagaggccaggccccacggctcatgtcggcaatcccagctactcaggaggctgaggtgggaggatcacttgagcccaacaggttgagactgcagtgagccgtcatctcactactgcatgccagcctgggcgacagagcaacaccttgtctcaaaaagaaaatacagggagagagcttatttgggccaaggttgagagctgcggcctaggaaacacttccaagttgccttgagaaatgctctgggggagaaaaagagaggcttctgcatttaaaggaaaaaggacggatcaggaaaggggcaattactcaagttgtttttcaggagttctcattggttgacagaaacacttggttagttctcattggttgacagaaacacttggtgaatgattggctatacattgttgaactacaggccacgagttaccgtgtccaacgtggcatttttagctacatggcgtagctattggtaccagtctggaacccacacagcaggtttcaggagacgatctcccaaggcaggagggggagtggggcgtggctgctgtctcattccagtgcctctgggcctgatcgctgaaagggggctcaccttcctcaggtaaaaagtgtttccttcttatcctgaactccaggtgaaacccttgcatctgcattcaccaccacttgacacaggagaaccccgggccctgcaaggtcgaggggtgaccacggtcatgggccccagggtctgtccttcatgaccattgccccatggagacacccagggccgcccggagcccatgctcagccccgatgttgcattggggaagcagcccctatagagacagtgtcaagggatagctgtgacagctgtgggctctgatggtgcacttgaccccagaaccagaagagcttgattccagtccagtggctcccgttcctcggaggctattgtttttttgttttgtttcgtcttgttttgtttttgagacagagtctcactgtgtcgcccaggctggagtgcaatggcgcgacctcagctcattgcaacctctgcctcctgggtttaagcagttctcctgcctcggcctccggactagctgggattacgggcgcccaccaccacactcagctaattttatatttttagtagagacggggtttcaccatgttggccaggctggtctcaaactcctgacctcaggtgatctgcccgccttggcctcccaaagtgctgggattacaggcgtgagccaccacgcccagcctgaggcttttgtttttatgtaagtttagattgcataaaactttttttttttttttgaaacggagtctcactcggtttcccaggctggagtgcagtggcgcgatcttgactcctcacaacctccgcctcccaggttcaagtgattctcctgtctcagcgtaccagggagctgagattacaggcctgtgccaccacacccagctgatttttgtacatttagtagaggtggggtttcaccatgttggccaggctggtctccaacttatgaccccgtgatcctcgtgcctcagcctcccaaagtgctgggattacaggtgtgagccaccacgtccagcctgaggcttttgtttttaggtaagtttagattttataaaacgtcagcatttttttaaacaaacgtgctaaatttcagcatatttggagaccaccaacacattagcctctgttctcattatattactaatgtgaacctataaaattatcaaaaattcagctcttatttaacatgtagttttatataagatttcatttggaggaaaaaaaatggattctactgtcaaaaagtttgaaatgtactaagcttaattcagttccttttttagagacaggaatagacctagaggtgcagagatgggcccaaactgactggaagccaagtgccccctactctcataagactttctgcttcgtatgaaaagcatgatgtaaattccacagaacttgggggtgggggtgggggcaggggccacataaaaactccataatctctagaattcctattttcctacttacaggtcttactggtcatgtctggtgtagggtggttgctcttgaggggcttttagaaatacacagctaagggcacagcaggggagccctgatttttaacaaatccagaattgtatttaaaaaaaaatacacaggtaaataaacaagctggggctggcccaggtgtactgatttgtgtacttttataggataatatataacaaattgattactggccaatccaagaggggtttttgtttatgttttggggcctttgtttttagagatggcttcttgttgcccaggctggcctcagactcctggactcaagcgatcctcctcccaagtagctgggaccacaggcctgtgccaccacacctggcaatccaagagtttttttacctatcttcttaatttctgtaaaagcaatcagtaacagatactgttggtgaacgaacacgcagcacagctgtgatggaaaaagaatcgtggagggggaatgaggagaaccagtgctcaggagccccagagatgctaaatgggcactttacagccaacagcgctgctcaggtgcttctgcctcccagaagtgtctctcacacacacacacacacacacctggccacccccaaatcagaatatggatcagagggggtgccaagcaaggggaggattaggctggatcctggcgctgaagcataacattgagaagccaaaggctgccattctcccctgctcctctctccctccctttctcaggtgtggtggcctcatccatcttcatttctgcctccaaaacaaggctcccttcctgctggtgagccccctgctgactctcccttgggttcccctctgtgcgctgccctgagccggagcttccatgtctaatgcaacgcaggtgagcccgtccgccaggtacttcttgggtgtttaggtgcctgttgaaaatgggtcctcaattggccgggcgcggtggctcacgcctgtaatcccagcactttgggaggccaaggcgggcagatcacgaggtcaggagatcgagaccatcctggctaacacggtgaaaccccgtctctactaaaaatacaaaaaattagccgggcgtggtggcgggcgcctgtagtcccagctactctggaggctgaggcaggagaacggcgtgaactcgggaggcggagcttgcagtgagccgagatggcaccactacactccagcctgggcgacagagtgagactccgtctcaaaaaaaaaaaaaagaaaaaagaaaatgggtcctcaatcaaagagtgacccccagagtgagcgccatgcctgaggcttagagcagggtcacctcctcctttcaaacaggaatccatgctgaggctggagcctctttagacccacgtggccccacagcccacagaaccaaggctgaccccaaggcttgagctaaagcaaacagtcacgtatatcacgtgttgctatcagatgacttgtgagaagctgccttgtttccagtgctatcagagcccgggtgattctctagcaaatgctttgccgggaaacctggaggtttcttctttcgggattgcttctttgtgagtttcaaacagagtaaaataaaaagtctgccacagaaaattgacatcataattaaaggcccagaggtcggcgtgagactggcatgaggggcagaggaaggacatggggcccacccggagtctccgaccacccccaggctcaagagttccctctaaggactcacggaagtgagtaaagctgtcggacacacggctacaattatgagagtgaacggacactgatgaaaatcagcaacaggacaagatgcacaaggcagggccatccaggagatagcgggctctgctcagagctgccagccgtcctctccccgtggagccctgcggcgcgctggcttctcctggtgacggtgtgcaccagctcgcatggagtatcgccaaccagggaagctcgcccgagccttggcgtccacggttttactggttaatcatgtgtacatggtggcctcagtgtccagcccctccagaggtggggccatcctgtgtggcccaagacccccagcataaatcacgtttgcctagactgtccagcagggcccaaggcccccagctaaacaaagccactctcaccaggcacagcatgccaagggcctctcggctactgcaaagctggagaaaaggccagacttctctttggacaaggttgaacctttactgaacagctgtcctccccacaagaggaactagagcacagaggggctcatctgctgggccaaggtagctaagggcaatgtgagggtctcacagtcaacccaggacctccctaactcaaagctcttccctaactcaaagctcttcccgctacacagcaagaagaagggacttcccagctaaatggtgacatctgctttccactgaatctgagaaaggagaagcttccagaatgagactaaataatttgcagaggagaaggaacagaacttgccttcagaatgtggaccactccccgtaactcagagacaaaacaatcccataccttgaagtagcttggagatgagctttattttatatcaacattaatacatatgggtatacctagctttatttcccccctcaacttagagtctgaatgtgtggtaagcatgttcatcgctggataagcatctggtatggtctaatcggcaataagtaggggagtggaggccgggcgccatggctcacacctgtaatcccagcacttcaggaagccgaggtgggcggatcacttcaggttaagagtttgagaccatcctggccaacacggtggtgaaacccggtctctactaaaaatacaaaaaaattagccaggtgtggtggcaggagcctgtaatcccagctactcgggaggctgaggcaggagaatcgcttgaacccgggaggcagaggttcagaggttgcggtgaggtgagattgcaccattgcactccagcctggcaacagagcaagagtccgtctcaaaaaaaaaaaaaaaaaataggtgtggtggtgcacgcctgtaataccagctactcgggaggctgaggcaggagaatcacttgaactcgggaggtggaggttgtagtgagccaagatcgcgccacttcactccagcctgggtgatagagtgagacttcatctcaaaaaaaaaaaaaaaatgtaggggagtggaaagttttcagggaacccaagagcctgagtcttcctgaatgagctctccagcaaggtgaaagcccagcagagtctccggtgggcaaaaatctcaggcagaagaaacttctgtgactgcattcacttattcataagagaacacccacggccccactgccccagctgaggatgaggaaagcaaccacagctgccgctctcactagcttctttctccagcctagagactggcgtgactccatctcgccgtgaggtgcccagggtgggagaagacctcatggccatggtgggcagcccgtggctttatgagtgaggacagccaggagcaccgaaccccaatacccggaacactagcacagcaacagtgccaggcagaccccaatctctcaattcctggccccgcacttgcgtcaatatggtaccgcagtgagaccctacatctgctccaccgaggctgaccctggaaccagtgctggatctctgatgactaggaggacccggtggttaccagggtcccacagccagtctgcagacctgcccaggcatgacagtgtttccatgtcctcatcaaaacgagagaaaagacggctgggtgaggtggctcatacctgtaatcccagcattctgggaggcttaggtgggaagacagctggagcctaggggttcaagaccagcctgggcaacacagtgacactgaccctgtcactaccaaaaaaataaattagctgggtgtggtggcgcgttcccacagtcccagctacatgagaggcttgaggtgggaggatcaattgagcccaggaaattgaggcttcagtgagccgtgcacttcagcctggatgacacagcaagaccctgactcaaaaacaagagagaagagcaatggaatgggttcctctggaaactcaatttgaagaaggaccctttttctgacatgctcttcctctgcttttagcattgaaatatacctttggaaatggcaagtgtaaatacgagtttcttttataattctccgcttgaaaaaagtcggcaataccgttttaaaatttgaacagtatgataatgctgatcggcctccagaccaatgaaatctcaaattctaggaacccctggtctagttcaaaccctggttttacagaaaatgaaatagagaaataggaaagccccataactggcgagccagcccctgttgtgtatctaataagatctcacagagttagccgggcgcagtggctcatgcctgttatcccagcactttgggaggccaaggcaggtggatcacttgagataaggagttcgagaccaccttggccaacatggtgaaaccccatctctactaaaaaacaatacaaaaaataagctgggcatggtggtgcaccccagtagtcccagctactcgggaggctgaggcaggacaatcgctggagacagaggttgcagtgagctgagattgcgccactgcactccagcctaggtgacagagtaagactgcgtctcaaaaaaaaaaaaaaaaaattcacaaagttgtgcattcgtgggtagtactgtatcttgactaccatttggtttctttctagattgtgaatttctttaaagtctctaggaaaatgaggccgggcgcggtggctcacgcctgtaattccagcactttgggaggtcgaggtgggtggatcacaaggtcaggagttcgagaccagcctggccaatatggtgaaccctcgtctctactaaaagtacaaaaaaattaggcgggcatggtggcacgtgcctgtaatcccagctacttgggaggctgaggcagaagaatcgcttgaatccgggaggcagaggttgcagtgagccgagatcatgccactgcactccagcctgggcgacagaacgagattctgtctcaaaaaaaaaaaaaaagtctctaggaaaatgcacaattgaaagatttatttgagacaggcaatggacctcctgtagaaatgctttactttaccaagtaaaaattcagatatttcttacatagaaaacatttcccatattaaaaagctaaattttggtcaggtgcagtgcctcatgcctctaatcccagcattttgggaggccgaggcaggaggatcacaagttcaggagtttgagaccagcctggccaatatggtgaaaccctgtctctactaaaaaaaatacaaaaattaggttgggcgctgtggctcacacctgtaatcccagcactctgggaggttaaggtgggcggatcacaaagtcaagagatcgagaccatcctggccaacatggtgaaaccccatctctactaaaaatacaaaaattagacgggcgtggtggcgggcacctgtagtcccagctactcgggaggctgaggtgggagaatcacttgaacccgggaggcgggggtttcagtgagctgagattgtgccactgcactccagcctgggcaacagggcaagactccatctcaaaaaacaaacaaacaaacaaaaattaaccagacatggtggtgtgcacctgtaatcccagctacttgggaggctgaggcaggagaatcacttgaacccgggaggcggaggttgcagtaagccaagatcgtgccactgcactccagcatgggcaacagagcaagactctgtctcaagaaaaaaaaaaaaaaaaagctaaatttctcaagatacttgagaaaagatctttggaatcatcttcagtctgccatacacgatgtaccagaaatgctcagtcatttatagccacacgttttctatttttcacaaagtgccctagaataaataaataagaagtggccaagcttggtggctcacgcttgtaatcctaacactttaggaggccgaggtgggtcgattgcttgaggccaggagttcaagaccaacctggccaacatggcaaggccctgtctctttaaataaaaaaatatatatatatatattttttttaaaaaaagaagtacccatgttttccacaagttgaccttgaaaaactagggtgtaaaaagtcaaatctggctggacacagtggcccatgcctgtaatcccagcactttgggaggccaagatgggcagatccccttgagcccaggaattcaagaccagcctgggcaacatggtgaaaccctgtatctacaaaaaaaataaaaattagccaaatatggtggcacacacctgtagtcccagctactcaggaggctgaggtgggaggatcacctgagcctgggaagtcaaggctgcagtgagccaagattgcgccactgcactccagcctaggcaacagagtgagaacttgtctcaaaaaaataaaaaataaaatccaacccccttgggtgaggat

SEQ ID NO: 137 - DNA, 4645 bp, Homo sapiens
ggaaactgaagcagagaggttctccaacttgtctgaggtccaagaaggagctggtgacagagaccagataccggaccagcacttgggttttctgactcacggttctgggctcacccctctctgagcatgcactgagcctgctcttgcaggtttctttatcacagggatctatctacacggtactttctgctctcagctttttacagtggtgtagagtgcagtgcagctgaaaccaggttagttgatcttatggtgtcatctagaaaaacaagagatgcagattctgggtcacgaaggcacagtgcccacttgttccgtggcacagccccagagctcctgttgaaggaacagactccaggactgactttccacttgattttcggagctcgcacatcccgagagattcatgttcaagctgcattttagacatagctggcaagagtattttcgtgatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccagtacacagtgtatagtcaagccagcaccatgagcattccggttgcaatggagacagatgggcctttatttgaagatgtgcagatgctgagaaagacagtgaaggacgaggctcatcaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtctcttcactttgatgagtgacatgaacaccgtgtctccttctcttgtgtgtacctaaagccatatttccaagtctgtggtactccaggattccaggagtaagcctgtagaagagatttattttaaaagagattgctctgaaatttatcttaaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttcatattttgtacaaaatgtcctatgtacagaataaaaaagttcatagaaacagcaaatataggtaagtggcacaattatttttctttagaaaatatctgtaactttatgcattagtgaaatgttaagtaccgacatattttttaacattttgtaattcaaaactttttgttttgacattgtttatgaagagaaacttcatacacttgccatttaatatgctcttttatctaattttcaaaaactctaaaaaacggtgtatcatatggactaaataaagaacatgtgaattttattgctca

SEQ ID NO: 138 - protein, 508 aa, Homo sapiens
MFKLHFRHSWQEYFRDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQYTVYSQASTMSIPVAMETDGPLFEDVQMLRKTVKDEAHQAQKDPKKDRPLARRKSELPQDPHTKKALEAHCRADELASQDGR

SEQ ID NO: 139 - DNA, 79831 bp, Mus musculus
  misc_feature (1)...(79831): n = A,T,C or G
aacactaaggaccagctgtaccatgatgacctataagaaagcaaggtaatagaggcctgaaggccactggatcaatttagcataggaaagggaacagttggttctctgcagctccagtctagcaggctaccattcattgccggaagccattagtctctacctggactcatccttgctcacttctcctatattctaagctgtagaagcaagtgaaggatgcctgggagaaatgtaactagacactttaaatggaatttttaaaaagagaagctaaaagccaagtcaaactcattgtgcagaggctgtaaggatccctggcattcctgtgcagagtttggcgatggcacaagagagtttcatttgggaacactgattgcaagatgtcattagatgtgtctctgcaccagtgtttgatggagctctttttcctgtgtcctcctctgttacactctggcaggaggagtaagtatggtggccctctgtgtaatctgtcccctttcgtctccgggtttacactggggccgtgaacacagttaaagggaacacactctgaaggcagcaggcaggcaccagattctcacttagccacctgtttccgttagccctgttgtgcaattatctaagttctgtcctgtgaatgggtggaatgaggtgtcacatggctgttaggagtgaaagtagtgatgtatgtccatgacaccatgggcatgtttctcctatttagcctgtgaaccctgaggcacatagttcccaagatttaacttgagtgccaaacggcaaggagaacatctgctttgtcttcagcagatatgttctaagaaacccagcccacatctgaaactgactgttgtaatcataaaaagagaaaaagatattaagatatgtnnnnnnnnnnnnnnnnnnnntcagtcacatatagtatagtatagaacagagtttatttagggcacagggagttaagagggtagcagaggcagagaaaggcagagaggagagagtagacagttagaggctggaagggaagacaggggaagcaagggggggaagaggcaagagagagaggaggggccaagcagccctttttatagggccaggtctacctggctgttgccaggtaactggggaggagcatacctggctgttgccaggtaactgtgtgggtggagtccagacagaataccaacactggctagtaccaaacattgttatactgtgttttttttttctgcatgtatgcatcatacagtaagacttaacttacaaattatgcacagtaagagattaatagcagtagctaataagatagaacctttgtaacctcattctataataaaattgatctctcttgagtcaagacagtatgtttacactgtggttaattggaagtgactgaaactacagaagtgaattcttggataatgggcactagtgcacttagagttatgtatgagagaccctgagagaccccagtaccacaaaccaggacatatatgtatgtgattagcatgcagaaggttgaaactcagctcaggtgtgagaggaagttctgtctgcctttgatctgtgctacttgaagtggtagagccatttagaatagaacctttgagtgttagaaccttctaaaggaagccagttaagttattggggcatacccttgaagaggacatggggacacaagctccaagctcttgcattttgtttttagttttctgattccatggggtgagcagccttgtttcacttctgttctcattgtggtgttctgtcttgtcttcgctagttttatgtcaacttaacacaaactagaattgtgaaaagaggaaaccttaattgagaaaatgcctccataagattctgttgtagaacattttcttaattagtgattgatgggaaaggctcaacccattgtgggcggtgccatctctgggctggtggtcctggtttctataggaaaacaggctgagcaagccagtgagcagctctctggcatggcttctgcgtcacctcttggctctaggtttgggccttggtggagttcccatctgacttccttcagtgactacagtgtagacgtgtaagcccaataaaccctttcctctccaactagcttttggtcatggtgtttccgcatagcagttgtagccgtaactatgacaagttatgtatcatgcagaagcaactgaccaaggcctgagctctgaagatgaaccagaataaacctttgcttctttgaagtttcttttctcagatattttaacacagtaacagaaagcagactacaccatctgctgctgcaggagtgtgctaaatcatctggagttttgttggctatgggtaggagtgatcttcaaagcagagcatggagaaggaatagaaattcaagggggagagggttgtgttcgtaggagagcccttgaactttggctgtgaaatgagtgagttccctgttctttgggggcagggtggcgtccctgtggtgttgtctgagggacgttggagaagagtgcctggagagtagagctttgtaaatgttctctttttctcagtggggggaaaaaagacagagtcagaaaagagacagcggagcattttctaacagagttcaacctggtgaattattgaccctctgtgttttctgacactcgtgcactggtttgatctcacagtagagtcgactagcgttgggtcctgggctggcaggtgttttctcaacttgacacaaactagggtcatttgggaagaaaggaaattaattgagaaaatggctcggttggattaacttgtcattaaatctatagggcatttcctagttgatgatttatgtgggagggccctgcccattgtggacaggtggtcctggatggtataagaaaggctgagcaagctatgagaagcaagccagtcagcagtaccgttctgtggcctgtgaatcagtgcctgcctccatgttcttgccccggcatccctcagtggtggagtgtgacctgagcattctaaactgagataagcctttcctccccgagtttcttggtcatggtgttgtattgcaacaataggacccctacatgcatggcatatactcggttcactctatgctgtttaatgtttacaaggaagcaagacaatcctttctctttattctccatatcacgtgaggaaagtttactttctaactcggttttaagctcagtatgtgttctggtatcagataacagtctcctctttctgcacttgtgcacgtgaaggttgatagcatccggtctctggtatttgttccataatgcttgtggaatggaagaatagtgttagcacgatgacacttgggaaacctcatttttacttggcaagttaggaaagtttttctctgcgaaattctcggaaatgtcgtggttccttttgttttagatgtcagtctctgcagaggaagattagctacgctttctgagatttttatctaaaataatcatgttaatataaaataaaggtcctggggttgtcttcataggatgtttactgtaaggctgattgatagtttgaatgacacagcagttttagaagcaacctaaaagtttttttttttttaatagacaaactttcttatagcaaatcgaattgagaagccaggctgtgtgttcctgtaattcactttgacccctactctcctgggcttgtttcagaagggtagggcagtgtctgtgatgtgcctttttggcatcattttcacttggcaggcatgcagtacattcaccttaataagtaagacttctcatgtagtgctgccaacagggtgactgatgtagtctctgaggaaacctgcctttatacttaagtagtagcctcaacatcatatatacctgcaggctgtagatcagggatttgtttccggtttgagtcttctgcatccccatgcctcatgcaggccagtcattctgttcatagtgtgaggtgtctccagttggcttttgttcgtttcctcttcttggctctaaccactggtggtgaacactgggacctttggtcagcagcgtgtgtgtattctaattctgtaggtctcaggtagggtttgcttgggataaagatggagcaacatccttctcattggcttgttgccagtggagcgtttctgcttcctgaatgcctacttccagcattctccttcctcctagtgtaacctgtggatattctgctttgccagttctaagttggatggcaaagcgaagcggtcatttaattcatcattggaacctttcccagatctctgtctgcctcaggttttcctggttttgattttgttggggttttctttgttttgttttggctttgctcgaacattttcttgtgagactgatttcaagaatatacttcataaggttgatgaataaaattatgaattcagagagagttcaaaatctattcttgactatgtttttccagtacaccacattgctgtgtggagttgaagttgatcatttcagaatgtgtaaatgcaaggatttacatgggatgaggattatctgagacctgctcggacaaggatggggtttggtctggtgccaggtggtttttgacttgcctgttggtcctttgtgcctgcctaaaaggctcgccacgttgatctctgggttcttgtctgatttccgtttcagaagtgctgacacagctaatctgagtatttatgcctattaccacttgaagctcagtgggtgtctctttggggatattcacacagaaatggcttaattggatttcagcccagacacagtatctgaatggttctttatgaattgcattaattgggctactgccataggaagtctaccctgcccccacccccaccccacacacatacagagggaggggggagggannnnnnnnnnnnnnnnnnnnnnnnnnnnnnnnnnnnnnnnnnnnnnnnnnnnnnnnnnnnnnnnnnnnnnnntagaatagaatttagaagtgctgtgattcagttcttttcattggcttgttgctaatttgtataataaatgaaatattttagaatgtggtagctcatctttgtagggaagctgaggctaaacaattactgtgcgtttgagatcactctgagctgtatagtgaattccaggctatttcaggttaaagaggagcaccctatcacaaaagtcagaaaatcaagacaggcatactagagaacaatgaataggccaggtatgttgtgcataccttaatcccagcatcagaaggcagaggcaggtagatctgagtttgggactagcctagtgtacatagtgagttccagggcagccagagctacatagtgagactgtgtctcaaagggggaagagagatgaagagaatgagaacctgataggtaaatacagtttgtaagtataactctccttaggttgtgcttttgtgtcattttctaaattctaggatcatgtggctattcacaccggattcaagagtatagtctgtatggggctgaacctttgaaaggaaaagatttagggcctgagtgacactgcctgcttaaggccatttggctattaacagtgcatcttatgatgtaattgagaagtgacagttttctgagtgtggtaggcccaacagcattggagagggtgatgtaggactgagtttgaggtcaggctaagctatatagtatgttctgggatagcctggactaaagtgagaccctgtctccaaagcagacacaagcagaacaggcagacagcaaacagtaccagcacccccccccaaaaaaaaaaaaaaaaccaacagcactctccccaaaactatacaaacaaaaccaaaaacctgaaagtttattgacaggtgaacatgccgtggtagggttctttctggagccacgtggaccggaaaagttctcttcatggtggcttttcctctctgggtagttgtgtaaatgttagactgtagtctatgattttttatgggaatagaaggtgatcttccagaagagcctcttggaatttgtgtctcaacaatgagggtttggttggaactgaaggcagagatgtttccgagagagagaaaacactgcagacactgcggtctggcatgaaaaaaagaatgtgggcgcttatgcttggccaatattagggatattttaaaacagctaaatataagcacaatatattaaattttaattcacatataataattagaaacctccatgttaaatttttatatccattagcctcttaaaagacttcatttgttttttagttaaaataaatttgaattagagctacagaactttttttttaactaaagttacctgttggctcaaatccccatccagactggcaggccaccagcttcctactgttgtatgcgttggggctgcagtgtttgactttgtgcacctgggatttctcactgagcataaagtcctccaagttatccatgttgtagcatgtggtgatcccgttgttgggctaagtaatgttaaactgtgtgcacccatctcatgttttactgcccgttcatctctccgtggacactgttttcttatttttattagtcttaagatttttaaagactttgttactacttaatagtgcaaacttgaaggcaagcttttgacacacaagcctgatccagaccatagcagcttatgtagcagtgtgttgtagaaaaagggtagaggcccagcagcacttcctaccctgacttcctagctcttttatctgaagactcagtgccttaatcctgagttaatgagaacctgggtcctgaccagcataaggctctggatatgttcactctgggatgtacagatgtgcggcggcaggcttcacaggctccatatttgcctggctaaattaatacatgctttcaaatagcatgcaggagctcttactgtaaaggtttgtggggtttctggggtgattaactgtaggctatagggaaactcttgggtttatataagacaataaaatattctttgtgtggaaaaaaaaactatttgacttttcattcccagaaaaaccacagagagtctcaggtacagtggtatatctctgacccttgaactagggtggcagaatcagggccgtgagtttggcaccagtctggattgcatagtgaactcaaggccaacctgagctatttggggaggctgtcttttaagactagtaggaaagggaaggaagtagttttgctgtgtagagataatatctgcatataatttggtataaatggtgtagtgtttcttagtaaggtcacttggggacgtaaaattccgcttttccaaggtggtgtgggttttcagtaggcatctccctgaatcactctctgtagttctccagcctctgcagaggcttattggccccttggtatggttaaaaacagaaaacctgactttgtcaatgtatcaggtgattttgtaatttttagcctttgacttcatatgcctttacccagccagaaaaatacagtatgcacttacttctttctagaaggacctctaagccaagtggaaagaaagaacagagacttggcccttagggaagtcttaagtaaagttagagggggaggtcaggtctgaatgaagggtggattgctcccatttgctaaagcaccaagtgaacaggcaattctccatgtctagtcatcagtcagagccaaacttctttcctcaagataatctctcccatctgaggggtctctaggcatgactgctaacctattagaaatgttgggggttggggaatgtgtggaaaataccagcccgaatccacacggtgcagaatgccccacctctgcaggatggacaccttagcactgtatcaccatcatttaaatgaaatagagttaaagtggctttaggagacagaccagaaattgtagtttatactttgtaaacatgacttgcacccccattgtaatgaattagctataaaaagattattatgcacaatgtaggtaaattcatattaaggaatcaatagtcattttgacgtggtagtagagttgtatttggttcctttggggtgtgctgagttgtctgtgccaattaggttgtatatacgctttgcttacactcacctggagaggtgcctgtagttgttgaggctggatgacagtgcatatgggggtgtctgctgttgcatgtgtttaagcatggttgtgatatggcagtggtgggggacacagatacttaaaattcataacagtagcaaaattgcacttaggaagtagcaacaaagatgatttagtggttggggttactacaacatgaggaactgttttaaagggccacagcattagggaggttgagaaacactggtttccaagaaggaagttaggtccttttgcctgagcccttgaaggactattagaacccaggccacattctcctttctttactttctattccatgtgaggttagcaacgttgttatatcatgtattccttctgtcttgccctaggcccccaaacaatggagccagcctgctatggactaaatgctctaaaaccctgagccataataaatctttcctctatcgaagtcaattattttccttaggtattttgtcatagcagtagaaagctgacctacacactccccaagggaattaatgctttgtaaaattcatgtctgtcctggaagattgctagatccaacagctgcacaagtattctttagaaagcctgacttcagacaagttccctatcaattaaaatattttttaaaaatctaattttcttccagaatagatctgaaacttagaaatatagaggtggtcggtagggccatggccaagtcacatgtggttttaacaggagaaataagaacttgaatccagataccagctcttcatttcatcttatagtaaacacctacagaaagaaagacattaaatattctcatcgtagttgcttatgggtttttccttacagtaaatcatactgttaaaaccatctgactcttgagatagagaatgcataaagaggaattcatttttaaatcaaaatttatgaacttgccttgtaacacatcatgatagtcctgcttgaattatcacttcctatttgagtaaaatagaattcgttttttctgtgcggcttttaccattttggggacataatcatcctagggatgaattaatagatctcctccaagtgagctgccaggacagatgccctctgggtttgaaatgattaaagatgccaatgaactctcaggggaatctgcagagtgcaccagagttcccttgaaaatgccagaggaaaccagaagtgtttgtccaagtgtgtgcacagtgactgcactgccaattccacaagcagctcggagtgtgggcacctgtgttagctgcttgcctcttaactaccttgtagctttgaggtgcgagtctcagatttcccggtatgggcaggtgaatgcttttagccttaggattggggattcggttggtggcacctgggcacatggcaatgcaagagactatcagttgtagataaggctctgtgtggccctcttcctatgaacttgcctctgctgcctctggaagctttcctaccgtttgcggcagtgtgtagtagtagagaagagggctggtgatacttgggagcctttaccccgttaagatttctttacctgctactcgtgcagtatgaatgtgcctgtggggtgtgtgtgttgctgcctgtgagagcaggtgtctaagcccagaagaggatatggagtctcctaggagttacagttacaagcagttgtgagcctccaatatgggtgctgggaaccaaactctggtcctctgcaagagcagtaaacacttttaactgctgggcaccagtgtcttttttcgtttttctctttttcttttctttttgggatggctaattgagctcaaacaagcaagcgcacttaatatgtgttccttttaatttctctgcagatcccacgggttcctctcctatagtgtcatcccagctggcttaagagcttggacgatcactatagctctgtcaccttcaaggtgtcctcagacagcagaaaacctcatctttttgaagagtgctacaatttttccagtcacctcttgtaactgcgtgccaaaggtaagcctatacatttctgcatagaagaggcttggatggttttttttgtttctttgtttttattttttgtttgtttgtttgtttggtttggtttggtttgcttgccttaaaaacttaatttgcctagtagtttttcttttttaaattaagatttttttactttttctgtatgagtattttgcctgtatgtatatcaatgaatgtagcatatgtatgctctaatgtctgtggaggtcaaaagtaagtgtcagatgtcctggaactggacttatgggtggttgtgagccatagtatgcatgccgggaaccaaacgcaggccttttgcaagagtagcaagtgttcttaaccaatgagccatctccccagatccctgcatagtagctattaaattagtaataatggcagtagaaatgtccctaatttactgaactccattaaatttaagcttttaagggacatagttcaaacaccaggttgtcattgttccaacttgagagtagatggtttagaatatttagatagaagtaagtatacagaccagttgacagttctcttccatgcagggaggttctggaatctgttctgagcagaggttgcctgtatgctggggaccaacagcttacagtagggaggaaagagtagtctttagtctggtcaagttcaagtcctgcttggtgctgagaagatgagttcacatgactattaaattcaaacaaaaagatccctaggactgtttcacacgtttgtatgaaagatgtgtttgagctataataaaaggaaatgctgaccttacttaaccttgtgcagccgggatcctggagcccccaaagtgatactggtggacaaagatgtggttgtgtaacacaagtgtattaaagagagagaaacagagacataggcagagagctagagagggacggacacacacacacagaaagacaagacagacagacacagtgtgtgtgtgtgggggtgggtgggtggggtgttgctgggatggatacatgaaaaataggcattccatacctgaactatatccccagctcacaaatatatctcagccatgactggtagcttgaggcctttgactttggacgtgacgcagctcatccagtgctccctctggctgacagtgagaaacaccttgtaagaatgtgtattgtcatctgtagagtaccacctcagaatttcagggataacacccacccatcacccttccctctcccacaaatctcatattatttctgtcatttagattgcttaagatagtctcgcatctattattttggcataatggagtttggcataatgatttctgtgaatgtatttctatgcgagttggaattctctttcatttggtctaaagtgatcactcaaacactttgctgtttcaccttgatgctttttaaaacacttgtctagaaacttgttcatgcccttaatcctgcctggtacaataagtgctgtttgcagtgttgctatgctgtatttcatgagggtgtagttaatgaagtgccctagcactttacactgatgtctttataatttcctgtggagagagaggctcattgtcccgcgtatgcggggtgtgtgaggtgctgtcctagaatccatagctgatgctcagctcaggctttggacctggattcccagcctccccaaggttgttatcccatcaccgcccacagagagcgctgttgagctctcttccttcacagggctccccacccacctcatgacaagcccatgggcgtactgagcatgcccatcacggcagaactgcttacaaaggaagcctctcaaacgccagtgatttagaaatggacattgacgtgggagccctattaggttcaagtaatttgcgaatgttcacctatcaatccgtctgtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctggctagggctgaggctcttgtaggaccagttagattacacagatttatactctgtgtccatagccagtctgtctggggcatggaagcactgccctttggaaaggagtctaggaaggccctggggatgtacactggaaccagtttgaaggaatgaagggacacatgggtagagacttaatagtctgcttggcacagggcaggcttggtagcctgagtgggtttgagtgctagagggagtggtgtctggcgctagccatgtgctttctggtcagcgatcttttgaagtgctagtaggaaacacaatggctggacagcatcatcagtgtgccagagggacaccagtgtaatgctgtctagaagagtggtgattgggatggcggtcttgggtgtgttctctagttagtggctacccaaggaatatgtcatgtttttaggcctacacatgggctgggtagaggagcatttagagggtagtgggatctcagagctcatttctagggctgtctttttctgcccgtggtcttactccattaaagtaatggcacaaaattttggagacctggcgtgcccgctaggagaatggagaccatggagataggatgctaacatacccttttcacactctctctcctcatgatcactctcagaatttcacttggaaactgaaattgatggaggtgactgttgtttagcggggtggatgctgtgagactttcgtgtgctatgctgaagggagagcggcccccattggatttccccagtgtgtagaggctgctaggattatattgagatataaatgctagctgtgatgctacctgaacccctttcctcctgcacaggtactacaggacaggagacattaacacacaagcctgccagttactcttacatttatactaagaggaaatgaaggaaagtttcactactgacattcacattattcttgatttgtatgcaaggaaaatttcctccagcttaacatctcacagcctgttttgtattattgcaacaaaactccagaggctgggagaaggaagcttacttagctcacagttgtgggtgcttcagctgtgatgaccttgctggcagagtccaaggctgtgcaggatatcacacgcatcttacacgcgttctcgcgaccggccaggaagaacgcaacaaaccggaatcttctgcggcaaaactttattgcttacatcttcaggagcaagagtgcaagagcgcaagagctctattgcttacatctttaggagccagagagcaagagtgcaagcgctttattgcttacatctttaggagcacgagagcaagagccagagcaagagcgcaagagcaagagcaagagcaagagagagcaagaaagcaagaaaaagaacaagaaagcaagagaaagaatggcataaggagaattatcctccgcctaggacgtattactccctgattggctgcagcccatcagcccagttgtcatcacgagaaaggcagaacacatggtgggaaaactgcccctgcacgtgtgcagattatgtttactacttagaacacagctgtcagcgccatcttgtaatggcaaatgtgagggcggctcccaacacacgcacatgtaagagacagtatgtctgttcgtctctctccttttttgttaaaagccactagcattcatgcatggatcagtacttggacaatggtgtctaatcccaatcagtcatcgtaagtgtcatagattaaatcgaagcctccttagtacctcacaacagggatttcaacacatgagccctagaggagcctcagcccacatcccaaccatagcaatctatttagataagagactttgcccaatgaccagggtttacgtagaaagtctctgcagaagaagctagttgacgaatacttaagttttcagggttccagctgctactgcaggtatacagctggtggtctctctctggctggaggtccctgcatgtctggaaatgactccttgagttcctgcagaaacagaagaggccatgagagtccaggacacagtctctgcagcttggactgatttctttctgtctagggtgatttctagcaccaagaaaggacaacagcatttgataccttgggtcttatagtcactagatctgtaataattgattatattattacttggtaaacatttagagctgcatacaaaagcccgatggcattgcctcctctatagttaacataatgtaatggttgtgcaaccctggtagggttggtatgaggtttgccttctatggtgtgtctctggcttttactgcagttgaattacctcattgactagatgaatagaccagcagttagtttttgaaccaaggtctgctgcttaaaagctggacttcttcctctcctaatgttagtggctcctggtatcttagagacgacagtggcaactgtgtggctcccttaaacgtggactccagctttgagagacaaaggcctgggccagagcttagtgctcttaggcatcccagcatgaacacagacccagcagtcctctcctctatgtgtgtgtctcgtatcagctggtgtgtgctgcctgtttgctggtccagtgtttgaaagaccttgggcatccagattaattggaactgctggaccacctacaggatcgcccttctcctcagcttctttcagtctttccctatttcaacaacaggggtcagctgcttctgtccattggttgggtacaaatatctgcatctgactctttcagctgcttgttgggtcttttgaagtgcagtcttgctaggtccctttttgtgagcgctccatagtctcagtaatagtgtcaggccttgggacctccccttgagctggatccctctttggacctgtccttggaccatcttttcctcaggcttctctccatttccatccctgtaattctttcagacaggaacaattatgggtcagaggtttgactatgggatgccccccccccttcatttaatgccctgtcttcctgctggtggtgcgctctataagttccctctccctattgtcaggcacttcatctaaggtcctccctttgagtcctgagagtctctcacctcgcaggtctctggtgcattctggaaggtgccctcaacctcctacctccagaggtttcctatctttctgcttgtccaggtggatcaaggacctcaacatgaaacagagacactgaatctaatagaggagaaagtggggaaaagcctcaaattcattggcacagggggaaatttcctaaacagaactccagtggctcaagctctaagagccattgttgtttccctaatttctttctaagcctgtttattatttctataaaggaaggctactgatttatttgagttaattttatgtctggcctctttgctgaagttgtttatcagctgaagaagttctctggtagaatttttggggtcatttatttatactatcatatcatcttcaaatagtgataactttatttcttctttacaaatttgtatccttttgatctcttcttgtcttactgttcttgataacactttgagtaatatattgaataggatggggagagtgggcatccttgtcttgttcctggtttcagtgggattgcttcaagtatgtctccatttaatttggctgttggtttgcagtaaattgcttttattatgtttaggtatgagccttgaattcctgatctctccactacttttaacatgaaggggtgttggattttgtcaaatgctttttctgcatgtaaggagatgatcatgtgattttttttctttgagtttgttaatataatggattacattacattaatggattttcatatattaaaccaaccttgcatccctgggatgaagcctacttgatcctggtgaataatggttttgatgtgttcttggatttggtttgcaagaattcattgagtatttttgcattatattcataagcgagattggtctgaagttctcttttttggttgggtccttgtgtggtttaggtatcagagtaattgtggcttcatagaacctgttaggtagtgttccttctgtttctattttatggaatagtttgaggaaaattggtatctggttgtctttggaggtctggtagaattctgcactaaatccatctggccctgagtttttttttttggttagtaggtttttaatgacttctatttccttgtgtgatgtgggcctatttacctggtcttgatttaactttggtatgtggtatctctctagaaaaccatccatttcatctagattttccagttttgttgagtataggcctttatagtaggatctgatgattttttgagtttcctctatttctgttgttatgtctcccttttctgattttgttaatttggatgctgtctctcagtcctttagttagtttggctaggtaggggtttatctatcttgttgattctcttaaagaactcacttttggttttattgattctttgtcttgttttctctgtttctgtttggtttatttcagccctgagtttgactatttcctgccttctactcctcttgggtgagcttgcttctttttgttctagagctctcaggtgtgctgttaagttgttagtgtaagatctctccagtttctttatcagagcacttagtgctatgaactttcctcttagcactgctttcattgtgtcccataagtttgtctatgatgtgtcaacattttcattaagttccaggaagtctttaatttctttatttcttccctgaccaagttatcattgagtaaagagttgttcaatttccacatgtatgtgggctttctgtagtttttgctgttcttgaaggccagccttaggccatggtgatctgataggatgcatggtattatttctgtcttcttgtattggttgagggttgttgtgtgaccaattatatggtcacattcaggcttgctttggtgaaagaactgggttctgatgatgctcacgtatttttgcttctgttgcttatattcttgtcttgcctttcaccatctggatatccctggtgtttgttggtctgtgtgactgtctgaagtctgcctcttttgtccctgggttgcttcacttcttgaggcaggcctgtgggcctggctttagcacctgtggggccttccaactggggtccttcacaggggcagagaagctgctgatctgttgccctggctgcagtagatctcctgggaggccttcagattgttgggtcttcagtggagcagtcaagctgttgtcagctgctctgagtgcaactgatcttcaactactgtaggtgcagcggatcctcaactgctctgagtgcagagggtcctctaggatgggtctggatatggtatcttcacgggagcaggccaactaggagtctgtcccagcagcaaggaccaggtgaaaggggagtggtattgggggttatgggtaatgggtcctgagtccaccaggctcctggcagcagctcctgaacttgggggcgggggtggtgtggtgtgtaggggtaggggagtcttactaactgctctgagtgggtcctctaggatgggttggaataatggtgttttctttttttttaatttcttttttaattagatattttcttcatttatatttcaaatgctatcccccaaagccccctatactgtcccccaaccctgctcaccaacccacccactcccgcttcctggccctggcattcccctgtactggggcatatgatctttgcaagaccaagggcctctcctcccattgatggccaactaggccatcctctgctacatatgcaactagaaacacagctctgggggggatactggttagttcatatggttgttcctcctatagggttgcagacccctttagctccttgggtactttctctagctccttcattagggtccctgtgttccatccagtagatgactgtgagcatccacttctgtgtttgccaggcactgacatagcctcacaagagagagctatatcagggttgtgtcagcaaaatctttctggcatatgcaatagtgtctgggtttggtggttgtatatgatatggatccctgggtggggtagtctctggatagtccttccttccatctcagcccctaactttgtctctgtaactccttccatgggtagtttgttccccattctaagaaggagcaaagtatccacactttggtcttcctgcttcttgagtttcatgtgtttttcaaattgtatcttggatattctaagtttctgggctaatatttgcctatcagtgagtacatatcatgtgtgttcttttgtgatttcatgggagcagaccaactaggaatctggatatagtgtttctaaatcaagctttagaatttgcaaagaaatgttcatgagttttctttcaagagtaggcaatgtagataattcctcccatcacccccaaaggaacaggtaggcctcctcatttgcctagtacagtacaggatagtaacatgtactctatctttgtgaacccatgggtcaggcacatagatgctgtgcacatagaagacaatagtgaggaagcacccacttatttctaaatggtgaaattaggaagaatagagtggtctgtctatgataaccatgtcatgtgtgtcagggcaaaaggtatacatatttctgttacatgtatcagtgcagataatgtagtcatttagcaatggatccttgactaagtaactaaaaaatgaattgttttgttaatataaggacagtggatgggatcccccacatctgttcatcccaagagtacacacagggaaagcagtgcctggtggtgctgtagtcttgggagttgaggagttaggggcagcatggtacctacacatgcccacatgctctctgctggagccaagcgagcctgagtttaagcttcttcctatcaggattaattttccttttgacaaccctgcccctgccccaatcattagaaagactgctaggttccaaggtttaaaatggctttgaaaatgtgaataaatcagtgtatgtgatcataagtttaaggagacacttttggggcattgtgtggatatttgagcaaactataaaaaggtcctttggatggaaacaaaggacaaccctagtatttgctttggtgaaaggtggccctctcctctgtcaggtctgcgaccctggaggcagctttagcttcctgcgtagccactaacattccccctctaggacacaccaaacagccctgacaagacttttggtgagctttgagtgtagccaattgtaggaaggaaaggtgatcctctttttgaaaaaaactgcgacccttttttcctgtgtaggcacaagccacaacactctgcctgtgtggacaccaaaccagaggggatgtagcagtggcctcctcttaagtacctaggcggtttgtctgtttctgggacaccagtggagagtctccaggcttggcagtcctagcggtttttctctatggcttgtttcttctaccaggtgtcattctgggttgattgtaactactctctttggtcagtgtgtaagcagcagaccctacaccttctcctgctgatcaggcagaggaatgtttggtccacagaagctcacttcatatgcagtagcctccccagcaaaggagacatgttgcaagaccgccacttggacacctggatagcactgaaacttataaatacagagccctgtgcgtgaaaacaagggttgtttgtttgtttgtttagtaaatgctgattgggacgttttcctaggccaccacaaagcactgaggatgaaaattgttcagaactttctgagggcagtggtttgaataagaatgcctcctataggtttgtgtatttgaagtcatggattaggaagtatgacgttgttggtgtggtgtggggcagagtgaggggtgctttgtgctggtgatatctctctcctcctcttcctcctcctccttcttcttcctctctctctctctctctctctctctcccctccctcccttccttccttcctctctcttccctccctccttctctttctctccttccttatctctctctctcttctccctctctctttgctccagcaccatgccttgttctgtgccatggcagtggaccaaacctctgaaactctaagcaaaccccccaatcaaattttttattttataagggttgccttgttcatagtgtctcttcacagcaaaacaacagtgatagagacacctcatggctgtcagttatgtcatttcctcaagacagtagaacaacattgtcacctaaccagaccctgctgccttcaaggttgcagtccttatgtcactgtgccctggtgattagaagtgaaactcttaagtttgatgagagcctgctggagctttggagagcccaaaagctctttagcaggctgattctgtgtcctgtctcctcaagagttttgcttaacagtttggatattgcttatgaagagacatgttattttgactgtgtcaagagcaaaaccttaacaaggctgatacagaatactttgtcaatcaggtgttttctatgtaaaaaataaaactaagaaacatcatgtacccacattagatccaagttttggtaggttgcatgataaagggcctggctcggaacttgtagttcctcatatttgagctgatcctcactagtccccacaggaccactatccatcacaggaagtcctgggcactgactgttcctctgaaatcattcttctacctctttcttatcttggcacattgtagagtcattatatacatgtatatgtatacaaatttatgcataatgctgcatagggaatgatggtttaagtgctgatcaaaatagagcaagggaggggttatactaatatttcctaggaaatgtccccagaggctcatttgttaaaactctgcccctagctgctgccactgttgggggtggtggaaactttagtagtcagagtctggttgcgatcactggaggtggacattggaaggatgtggctagtcctctgctgcctgtgtgccatgtgataaggagcctcctcgcttccttattctggctgttgtgaaactgctttgcacaggctcatagaggtcaagcgagcaccccacagatgactgtgaccatgaacatgtatgagagaaaggtctcttgatggctggtggctacaggaagccatctacacatcttaacagctacagtgaactgacagctctgcttatacagtcttgctatttgtgtctttatctaggtcacttttaatccttggaaggaatgggtgctggatacaaatagttttctgccatcctgggaatttcttgggcatctctccttactatagattggaagcttaaaagttgtttaaaagttgcagtgggggaaaggccatctcgttttcccttgtttcaggagccagtagtttggagttttaagaattttcagtttacatgattgcgtaagtgactcacagaccagaggaaataaggctggggtaggcatggagctcatctcacggttgctgctcatggttgtaatctacagtaaaactaatgttgaccaagtaaagaaaatgtaggccatgtgtactgactacagaaatacttcagttcaaggtccagtcaacacacacacccaatgtggaatgattgcagtgtctactctctattttgactgctaagtctaacaaacaatggctttgcaaattgtgtcacttattgcaaatgaggtccttctttttatagatcaatggactctagatcaggagacccaggcttcgggctcacctggtttttgattggctgtcacatcttgagcaggtcactggctcacatagtttcaatctccttggctgtagattaggcctgacacaccccaaggggctgctttgggataaacttgctgcattgtaagcacctagtgagcttgaagtagatcatgttctatgggaacacccaccactcctgctcctattggccgcacccttggggaagtcatggtcagtgaaatgtcattttgatagacatctgagtgtgacttcatatactccatatctctgtggctcgggctcttccaaacatgggcattattttatcagatgactaaatgaactgatgacgtacctggaaactatggcccttatcaagagtcaggaggccctgaagttcaaagaggtgctcacggcagtctaccttgaatcccaggaagcttcagtgaaggctgacagagcatgaaccctcttacctgactaccgtatatcgttggtgaaccagtattgttgtattactgctaactggatgtttgacgtcattcaggtttttaacagacatccagtttgtgtcccaggagtccatcctgcataccactcttcaccatgtcctctatgactcctgggtgtcataccccagaataagttctgacgattcccatggttgtaaggggctcagcattttgcagaaggcccttttgttatgttttcccatgtttttctgatgttcctatggggtcctgggaggctaagtgtacacacacaatcaacatggcctcagtgttggcactcactgtagggcacctgtcacatgtctgctctgcagcgatgctgtcctgcttgaagccctgctctatggaagcagggctgaatatacagtcacactcccagcaggaggaggaacctcagttattccagattcttcagtttagggttttcccctgtactcaattaattacttgctactcatttgttttttaaaattgattccagcaactgtatatacaagcctgtaagcctgcgccatactgcctagcttcgtttgtgttagcgcattataaatgggatcttggtatagacttttaccacttttgcgggaagcaatgagctcttcttcctcctcctcctcctcctccttctcctcnnnnnnnnnnnnnnnnnnnncccatctgttcccttggctgctgattggctatttcttgtctttcaccatcatcactactgcttctgtggtcatcattgtgcatgttcctcagcacactgaaagcatctttacagagtattagtgggagtgggaccttgcagtcatatgcacatgcagctctgtaggatcattctgagttgtttttcttctttttaaggagtgtatcccctttcttcactagcagagcatggggactcacttccactagcggccttttctgcttttcccactggtgttaacgtggactcattgtggtcttaggtgatggatggattgaatgatgttttatgtgtgttcaccatctgtgctgtctatctgcagcaaatgtatttttcctgtcttttcttttgtcgtggtcgttttctctgcattgtaggggttttcattattctagacaccagccatttgttatatatatcacttctttgcaaccactggcaaacagctatattcaatcctttgatctctatagccataattcctgggtacacatagattgtggctctaccaggtttgctcaggctgtggcgtgatgatggatttgcttttggagtgtgatggatgtggcccagcctaagcttttaaagagcatgtgagactgggggatcagctgccgttcagaggactgcactttggtccccagcacccactgtggcttatagccacctgcaattccagctcaagggattaaacacccttttatggctggcctctgtaggtacttacacacacacatatacacaccacatgcatgcatagacacacacacataaattttttttaaaaaattatttgtaaaaagaaatctttgctttttattttttattcttatttttggattgtaccattctgaagcttgagcttcttagacgacaacattgtatcatgttgtcagaaggttagattcttatgctagatcctccgcttaactagaatagtctttgatcttttcctgaaccaatagtggaggccactcagtaaacatcagcatttttgtgtcaaaaaatcctatgtgctgatggttctgccgaggtctgagcacctttcttgtttcatcgttccatgggctatctataaattgtaggcttggtgaagacaaacacgtgtttattttaaatgctagaattttattaaaagtatatagttttttttttaatcaggtagacactgagtctcaggctgtgtgttggatatttgcatttaaacctgttccatgataatcacaatcacttgctggagaaccttgggaacagcctgtgagttatgagaggggtagagatggcgaggtgcagcagatctgcagggcagtggagggagagaaaggtgcttagattccaggcacagtttcaaggccagcctgcctgcagggttttctggtacagcggctggggaaagaaaggagtcttgagttaggagtcttcagatttttggcctgacactgggtgagtgattgcatgccatttcgtttgccagaatgggaatccctgtgcaaacaactctgggtttttggtttgttttttgttttttgtgttttgttttttattgtattgattttcttttgttttagtgaaagaatctgaatgcttttagacatcccagatgtaaagcgaacgttgcacatccatgtggagatattctctaggcagctgagcgtaactgtccagcagtagggatatagaactggaaaacacatgtaatgatataaagctaagagtgtgggtggaggaaagactaggacagaaatacaggtgacgaagaagaaatagcaaggaaggaagcctgcagggcaccctgtgtgagaagatggctttcagcagggctgatcatagtgaccactgtaatgaagacactgcataggagtgagatatcgtggaagggataaaagcctttagtagccttaccgtacaggtagagttagcagagtaaacggcttttggaaatgtgttgtggttgtgttgctctgtaggaaggagatgctatggacatgatttggggtaggagatactattttgtgcaacataggatagttcagaaagatgcttcagccaggggagctgagacaagtagcttccatttaggaggtggactgcctcataggggctcaggtagcttactctagtagcataagagactgaagtgttcccagatacagcagtggccatgtattcttctgatatctcctcacccattacatcagaattcagaaaggcaagtagatcagagtaggttagaagaaaggttttgagtagagttctgggcacttgaatcaagctcacagcatagctctttacactctacagggctgtgacccaggagctagccaaaagtagcatacaagtctgaaagtatttctgccttattgtcaccaaaagaggaatctctaatttgtaaagaatgtgtgtataatagtaggtatagacagtgctaggttcaatgggatgagctacacagattctgtgactctggtagaaagtgtaatgagcttggagctgcttgtgtggtatttagaaagcaaaacaaaacaaatacacacagactcaaaattctggggtgctctgataggcaaaggcactggcttccagaactcctggcagctgcaggcgacaagtgatcaaggttcagaccaccagccatatttgtgttgatctgtgtgcaccacacactgtggtgaagacgggtgctttccttcccagcccaccacccagggctcataaggagaagaaaatatcgtggaagttctacagagctcctgaccggactcctcaaagcacaaagtctgggcattgtcaaagtcaggaggcccctaagaacccacaaaacatcatctaggatcctggataggatgcaaagatagaaacaggacactggggaggcactgcccgtctcagtggtatggatgttggttcattaattgtagtaagtacactatactaatatcagatattaattagaaataaagctataattttaattagcatatataattgaacacaaatgctagaagctgttacttcctcattctgatttcttagattataagtgtctttctgtagcagtgacaaaataccagagggcacatgtaagggtgaaatgtttattttgcagttttaggttttcaaccaacagttgtctctaggcctgtgtgagactgcacatcaatgatagaagactacattcttttataaggaaagcttctcctcggcccattacattgtgagcccttgtgatccaccccaagtcacctctgaatactgttgcagtgagaccaggtctttaacatctgagcattttggggacttttggccatccaggccataagagaataatatccttttaaatgacacatgcagttggaatgagcaactaccattcaagtttccggaattatttgtagatgtgtgcaagtcggcctgtggtagctcatgtctcctcacctgtactgcgtccttgctgagcaaatgggatgagagtccctgttcccagagccaggtacccaccaaggagtaggtaccctctttttataattcccctcgttacatgagaaactctaaaacatagacagatgcttagaaatgtggtatcatcatttaaacacactgagccaaggtgaccttgaacatcacaaaacctgcatcatacggcctgtgcattttatgttctgcctgttcctaaattacaggcattgtgaataataaggcagtaaggggaatggccaggtattgttgagtgtagctgaatagatatgtttataagatgtttaaatgattgaaattgcaggttcttttatggttgcaaactaaatagcaaagctcaataaaccaacccctaaagtatggtgcctacttattatttgtcttgggtcactttggaaacacatttttctgagaactcttcatgtgctctggcgtttcacccaagcttgatcgagcttatgctcacagatgggtatttccagttgcttttgtttctcttggccccattattgagatggcctccatgtggaagaaggcagagctctgtctcaggcctttgttgtccacagtttatataaaattactatgctgaattagcagtgattatactaactggtgtctggaaggcatgcagtacacaatacccagactttctcctgttgtctaacctgcccaagagggcactgcagaaagttaggaaggtgagcaagcttgtggctaaagtagtcaattatttgtaaatagtatttgctgggttttgaggcagcgggtatctattctgttttctttgaaaagctttccaggcagttgtaggttctgttgacttgagtttagtctcaggaatgtgcatgtagcaggcatttcagacccacatgttaaggaaattttcttattctctgtttcatcttggaggggaagggagcatgaccctgactgtaaagataattagaaggcatcacattggttactgtggaaggaaccattcacaacatcacaggccatcatccaataattctagaaaacaaaccacagaaagagcccctctgtgataacccaccgaggcaagctaacttctgctctgtaacatccagcctgagtcttgctctcaggagactttgcctctctctaataaaatgttaaaaacacaaatcctgttccaagtcatcaccaagagatcatggcttgctgtttctcccgaagtaatgccacctattcatttgtcaaaaggaaattggatttggcttttgtttatcagcatccatcttccccctgggatttatttttttagaacaacagcaaaattctacttccaagtggtacgagcaggcagtgggaatagtaaatgaagctttgggtttgtggaaagcgccttctggtgaatttgaaccccatatattctgctttctaactctgtggacttaggtgggtcactgaacatcccaagcccgcctttcatcgtttctaagtgcatctgtagataacatctatttcaaaaggttcttgtgggcatttgatgtactcatccttatgaaacactgtgacacgggtctcagttggctgtcaccatgcactccttgacgatgcagatggtacagggcactcactcctcttagggatattatatatattctcttttatgtgtggtgtgtttttctgttttaggaaggtggagagaccttgccttttgtcataacttaattaacttagagttggaacagccactaggttccatagtgtatcctagttaggattaaagtgtatttgctgtaattagtaacagtgctgcaaaaagccaccaactggcctttctgttccccaacaggagatcagggtcctgccaagtgctgtcccatgagttggccgctggcaagtccatctacgcacatcttgaagttaatcaagaattttagttggttctataacccattcatgagtcagtctctataatgcaaatgggcttttgcagatcacaaatcaaggaccaggaatacttcaataaattgagaatataggatgctcctgttttcaaagaaaaactcctcactgagaccagcttcctgttgctgcaggagtaaatgcccacagtgcgaatgtcctaaaacagtgtcccctacttcacttgtggttctcagttcagagtccttacaagttccactaggtgacattactcggtgtcaccaaaagctcactgctggggctctaggacaactgtcttttctgctgtctggagacatctcttggctacagcatagcatccttaattctttctctgattctcttgcctcagattagcaaggatgattgtagctgtccagagcctgctggatcatccaggattatctgcacatctcaggggaaacagttcgtgaacttacttcatgttggtcttgtaatccaacagatttgtaggtgctctttataggatgcagacacatactcaccacatcttgcaaagcctgcgttgagtgagtttttgtgagttgatagttgctatcttccaccatctaaggcatgatatgttacatagaaaaaaatattctagagaccttccatgaagttgttacataatttgaataattcaatttttgttgaaaattggcattgggatggcatctgtctccatttggtctcagtttgcaccctccaccccctgttctctctgtcttactcacaggcacacactctggtatgtctgtatacacatgcacacagatgtgtttttctgacatttcaagtcaatatcctgccagtaaaaatgttaggcttgctttgccctcctgcttgtctatgtgtatgttttgaattttgtttgtgaaatcctatgtcttccttctcacatttagattggcagtcctccaatagttaatctttattaagacctttttaatcattaaaacaaactaagtcaatgttgttattattctttttaaaatagtattttttccttagagattttcatatatgtttggaatatagttacacacaccccagccaccctttccatcctcccgtcccttctcatgtaacttccagttttcctccttttcttcctcttgttcttcctcctcctcctcctcttcctcctcctcacccatgaattccagtttgtattgcctgaccgatatgggtgccgtagtcctggtgaagatcctggctctgtaactacacaaaccactctatctctaattctcagtctcctaagagatgctttccagaatggggtctgttctctgtgttaaatgagggctatcatgtgcccatcccatatcagaatttaattcccatgccagggcttcttaaacatttccctttacaacctcatgctgctggagagtaagtttgcatagtaatgagatgagcttgtttatttttcatggagaattaaatctctacttagtatttgcttttacataataaaggtcatcctctgataaagaacgtttttcaaagttgatatttttattttataatcatcaatgctgcgctccctgcttgacatacattgtacaaagtagcagaagtgtacatgggggccatgtctgaaattgttggagattctgttgggattgccaagtctgagcttttaacacttctatgaagctcatgcttgtgctaatttggaacttccatggagagaggaccaacagcagggacctgttaaggcttctcccccgtgattaaaaccgttcggctactttaaaaacagaagattttgtatggacaggaggactctcagcctagtctggaatctgagcggaggtgtttgtatagtgtgttgcacataacggtttcctgcaggaagctctgattcactggggtgaggaccttcttgattctcaattactctttggttacacattcataaatcttattgttgccaaatgggccatgaccttcatactttatgcagtcccttctatgcttccaactgacagtttaaaagctgatagaagatcttgccttggttcttgttgtattcacagatttgacccaagggatgggatgagggcacaggagaagatgagagggtatcctggcacctggccttttttgggaggttctggtatgattggcagaggaagggctcccaagcagtgccaactcccataaaggaaggaaggaaggaaggatttgtttggcctggtagttcagaacaagatagttcaccgtggcggggaaggaagggcactggaagcagcttggtttgtggcctgaccaggaaggaaggcagggaatactggggctcagctgcctttcaccatttttttttccttctgtatttagttcaggatgctaacccatggattggtgccacccatgtttaaaatagatcttccctcaactaaacctctctggaaacaccctcataaaattacccactacatccttgtgcctcattaatgccctgaaggttttctagtccagttaggttgacaatttgaacaccacaaggcacccaaacacaacacttggactgtaccattttacccctgtccccagaggcttgtggccacctcttaatgcaaaatgcattattctaactttgaaagacttcatactcttatctcaacagtgttagaagttcaaagtcttttccaagacttgagacaaatcttagagcataacaaggaaagatcccactaaaacaagactgaatcctagccagaaaaacaccaagtcttgcacctccgtatcccgcatctgggacatctggcccctctgcctctagtttggcttccggcagtgcatgtggctttttcttggctacctgcacttggtgcctgctgcatcccttagcaactgctgcacatttctggcctctccaacaccctgttctgtggcttagcaggaagctgtgtttttataagccttatgctttcagcatgcactgaaataaacgcatccaagtcctctcataacgactgttgatgcagaaggaaattcagtagagagcgttggttggctggatatcaactgatttacatgatgatctgctcctatttaaaatcattttggaaattatataattcggcagcagacctggtatttaaatggaatcccctctgaacctcttttttattactattgttcttgtccttgactttaaaggagatgctcactttgatgcgtttcgggtctaatctgatagagaaatcagatgtgtgtgctacaagctatggactggggggaggggggggggtcctctgacagcaggtagttagctatctgtctccagctttgagaagaactttgagtaaactctaccctcttgcatattatgtgcattatgtatacactttacaagaattttcattttcccaaatgatttttttatctaatatggtaattcataagtgagaagatacatattatttttatgtgcctgaatatggtagaatgtgtcattcatgcctccatgggtcaggtgcataggtttcctgtgactctgaactcatgaggtaaaatcaggggaactactgtcaagaggagagaggggtttgggtcacgtatcctgtcattactcctcaataactgaagggtgtgtccagtcagtagaggggctgactatgacttttctgctgcaagaacacttgtgcattttctacctgagaagggtacagttgctgaggtaggtggtacctctgtgtattgttttctttcctatctagtacatcccagattgacgtcatcggatttctactgtttgttttaataagaactagttaggagacagcaaggcagactgttcaggggttcctacaacagagttctacagtcaggaagacagttcagctccccgtgtggagataagtgggagtttacagccagaggggaggaggaatatgctgtggagggtcctgaatgagctcatctaacaggaagcttgctgaaggagaccaggtgaccaaccgtcacatgcagcatggtgggagtctaggaacctgctcaggtgtcagggctggatggttcttgctaacactgggtgatccagagatggacacaaaagcaatagagagcagggtcccagggacttcagtaaagtttgctcaaaggagaccctatgtccaaatccacctcgctgtctgccttcaattctaggaagcatctgcgtttcctcgtgctctttgcctagcacttaagtaatccactgacagttggtttatcaggtcacctactgaaggctatctttgtttatttcccagtttggggaattatgaataaagtggtaaatatctaagtgttgctttgttttcgagagtaatcttacatttataggaaagttgtatagttatttgtgcagaaaattagcccttagctaatttctccagtgttgaaatatgatattgaattgtcaaaactaattaacatgggtacattgctgttgtttaggctttgtttacatctcaacagtgttttcacaaattttctttgtatattttactctccgtctcaggataccacattggcattagtagtacattaagtgaatctgagtttaaagcagtagtttgaatgtgttatatttactaaatatcttcaaaattctcagcatatgctgagaataggagtgtaagcgtgtcagctataaggggccagtgtcacttgtcaaatgagcactttaaatatgagattattattttgagtgtttttccccccaagtttgcatctagcttcagtaaaacgtgcagtgtgtttaatgcactgagaggggctgcaggctttgattacaaaatgttgtttctcagcagcattagagctgacgggtaggtcattctaagggcaagtgcttcaaggggctggaaggacactggtggcagttgtggtcctaggagctgtcgttgacaatttttcagatctgtcagaggagaggtgttcaggtagctaatgagcatctttaaatgttttgctggcagaaggactccatgaaagatgacagaagaagtcattgtcatagccaagtgggactacactgcccagcaggaccaggagctcgacatcaggaagaacgagcggttgtggctgctagatgactccaagacgtggtggcgggtgaggaatgctgccaacaggacaggctacgtgccttccaactatgtggagcgtaagaacagcctgaagaagggctccctggtgaagaacctcaaggacacactaggtgagtgtccatacccacaggaacactcgggatagcactgttgcttcagcgtgtgtgtatctgtatgtgcctgtgtgcgtgcgtgtgtgtgtgcatgtgtatggggtgtgtgtgtatgtgtatgtagtgtgtgtgtgttttggggccaagtgttaatgttgatagcctcttccttgtgttttatattgagatcaagataaagactctccttatcattttctggataagttatacagtttgggatcttgggtaaatcaactcttctgtgtgctatggacccctacacagttgtctgtctctttgtagaggaccctgacttagaatcatgacaagttcagtagtttttcctgtcagtgtgccagccttttatcttacaaactcccgtgcattggcctctgtgcacacagaaggagaaggcgctttcccctcgtcttagttgataggatattttattccacagtttcaggcagttaatgtgtagttgtggtgattagcaacatgacatcagaagcctctcaaatggacccctccatcagccctgtttggttatctcgttcttcacagctgtgcctcttttcttcctctggtatattagttcctttcttgtcactgtaacaagctgcttgaggttaggttactttataaagaataaggcttaatttggcttacactcatggtccaaagtcaagtggctgtgtttgtattgccctcttggcaaattttcagtgtggtgtaagtacaatatggcaagagactaggggagatagagaattgactgtgtgtgttttctgatactgttccctctgtaaacaccagtatttatgcagtttctatcacccaaaggccccacctctaaccactgtgataggaaccagtttcttctttcttacatcctctgtaggggatttaattcagcacacggtaaggagatacattcaaaccacattagtccatagtacctggtcagacagggtcataccacagtgatgggcaaccacacctgaatgtgcacagcgtgctcaccaagcgtggttactgcttcagattatctacgaatagaatcgggagggctctgtggaaggacagctgaactgagctgacagtttacaattgttgcctcctcaggtaagtataaagttgtttataggcaacaatggcagcttgccacttgaggtttgtcatggaagtgagccagtatcctcacctgggctaagtgtctataggctttctttgtgtgttactgaaagaggattagtttcattggagggggcagggtgaaggaaatatggggaaactgaaaacaaaatcacactgaatgtggtgggtgttgcacagtccccatcttcttccttgtagagtctataaagatcagtgcgcactcttcagtgggtgaagccttcagtcatcgggaggtgttttgtgctatggttggtttttttcagaatgtgtgtggctaatgtagacgctgaggctgctggaaaaattccattggttattagcattctaagtctttttccactgaactctctcccttgtgtattttttttccttgcttgagacagtcactggaaagaaatgctgctgtcctattcttaggactcttagttaagtatgataaataaagaagatgttgaatgggctggtgcttcagtgttgttctgagaatatttgattttctagcctcctcttaacacgccctctgtagtaatgttgagcattgttgatatattttgccttaaaaaaaaaatcttgagaagtctataaaccacaaaatgcacaggacttggaggtagaataagtgagcccccaagccctcaagggctgcagttgactttcttagaaggaaagataaggcctcggttggagctccagccttatctttgcccagtgtattcagatttccctgagtgcgatcagttcctcttgtttcacaaccctagttacagagcaaaccagcacatcttcaccctggtgctgggccggctcccctgtcactgacagaccgccatctagccctgctggaacacttacactgctagaaagggccaattccatttttggagaatacagattgttagaaagtgcttccttaaatagaatcgaaattttacatttctccgacttcctccccttggctctgactctgccctccagggctatgccaagcagaacaaatctcttcagtgagtgacagctcttctgtgagcttctgtctcagcttcaacacatcgttcttaggaaacatttgcattaagcatgaaagattgcaaaaatacagataagctatgttttagatatccatatttattaataggagttgattttcatagccaaggggccttgggatttagggagaagtagcctgattaatttttttccacattttatgtgtgcatgcacatacagaatggggtgtacatgtgccacaacatgtatgtgtgggccgaagacagcccatgggcatctgttctttctaccatggaagtcccagggattgaactcatcagatcttcagatttgatggcaagcttccttatccattaagctacttcactgtcttgctctccatttttagtactttgttgttgtggtctgttcatttgtttttattacccgtcatgatcacctttgccattggacaaagagagacctggttatcttaagtacaggcttcctgttgaggcagtacctagaagaaggggaggcatctttaccacgatctctatgtgcaaatctctatgtgcaatctctatgtgaaagaagcaatagcttctttcctctacagcctgtctttccccagtttgtaggccacagaaagttgagagttctttctgtaattcctcctgtctcccagatatcccttttaatataaaccccagagactaaacgtaaccatttgggcttttctgtgcctatccttggtctgaataatgccagggagacttatttttttttaacaatggttttggccttatcttaggcttaatcctcaactatcttttatattaacccatttattctattaaaaggtctgcaatgctgccgataccctctccgtttcatacttccaacttcctctgtggcttggtggtgaatcttcttgtgcctgactctcttccagaattccttctcagtcagtgtcctaccttctagtctgccttttgctataggccataggcattgtcatttaaccaatcagaaagtgccttaggcaagcaaggaagaacagagacacttcttgacatagtatgtataaacattttatccctacaactgtttatggcttcctgtttagttacagactctggtgtgtgctcagagttgagttttagattggaaagtgtctcttctgtggggaggtatcaaaacaatactgacttacactgcctacccattcttgtaactgagtgatgtcattcatgtaggctttatacggctgtgggaatccacctgaatctgagggccatggtagaacccccatagttcattcccagtttgaagtaaatcacataggcgtcaccaacagagccacagtgctgtgaactgagtttctatctgtgaggagaggagatggtggtgtggtgggccttacctctcctccgttggaaacttatgtcttgtgttttcttagagctgcttgaaggcaacagtatatttgacaaaaacatctcttcaaagtattaacattcttttcttttaataatttgtagttgagtaaaacaatcttatcttacattttctttcttgagggcaaaacatttatccactggatctcctttcatgctctgatcctgatcatgaacagtcaagaaaaaatttcccatgaagaatagggattgtcaagannnnnnnnnnnnnnnnnnnnnnnnnnnnnnnnnnnnnnnnnnnnnnnnnnnnnnnnnnnnnnnnnnnnnnctggttcagcaggcagtgttctgacatctctgagctcagcagtgagtcagcccaggctacttctggccttgacattacaacttgatctgtataactgaataggccagatatcagccttatgctaaaatattttgagatggagaccccctcctccccagagataactttcaaagatttctctgcaagtgcctcaaacacaatttttgttaccattctggttttagctagaacccaccacagccccaaaggagttgaaccatgcctgagtgactacgaacagtagacaagttaagcagaagcactgtggcctctgaaaggatgagaggaaagtgtgtgtgtgtgtgtgtgtgtgtgtgtgtatgtgtgtatgtatgtgaagaaaggcagaggtcatgagtcagacataccctgatccagaccagggtggtacatgttttctttgcttttaccaagttccctctggcagccctcaggtcctaggatgcttccctgtcaggggatccagcctggtatgggagccctctggcagataaggaccagagctgtgtgaatattaaagtaagttttacagtgagttcttagggaatattaaggattcaatgcctctcttgtggagagaaattatacttatcagtgactttcatacttctgtcaggtttggttttaaagtttgagggaactagtaaagaaatttctttatgtaaaagttaaatgtttagtttaacacttggcattcttataactaatcccaccaagacagaaaggacttgccttgtaagctggtctggtcttggccttaccatgtatcccaaatgaccttgaattctcagcagcccagcagtccttcttactcagctttctaagtgctgagattatgaacattagccacatgtggcatctcacgttttcaacattaggactacagagtctttcagggcaccatatgcagacttcatgtttggagaaaagtaaactagtttgtgtactgattatcacacctctcttttggctggaatggtcccctgtgagaactgtaggccagatcacagggccaggcaatttcttgcctgttagtaccattagattttgcttgtcttcaagcatacctgtttcccacaaaggatacttaaaactcctttagtcattttaagttttgtcagtgaactagtagtgggtaggagccaggtgtctgtcacagagtgccagggccactagctgcctgcaacacttatctgatgagtgaacatggaacagctttcaagtctcaccgcactctacccttgccaaatcagcttaccgcacatacatatttcctgtcaacagtaaagatgccagaattctgcctagaaaggatttgggagcttcataaagcaggaaggggctcttgagccagtgggcatgctaatatgcttttttgacttaacattgaaagacataggttgttaagcaaaatgtgtgtagtcagttggaaacagaaaggtaacactactcctgccctaagagtgaccctgtgtcctccctaagaacaccatataggagagccagagtatacttcagctctgtcgggttttgcctacgtagagttgaccatctggattgattggcaagcctctctgtgcagtagattggaagctgtctctaagtcagcatttatggaatgttggagaacagtttagaaacaaaaatttctcattctacacatgaaaaactagggcctaattaaccacaaattgagtgaggtccccaggttaggtgataataatgaataactgtaaatttctccagtttgatgaacacccttgtttgtagtactggggtaatggaatatggtctcagcagctttgtctacaatggcccttggaaacagggttcctgtcacttcctgggtattctttagagacctccctgggctaaagaaaggcatctcatagtcaagaggatgcagtgacatgaacccccagctctgtaagaacatttgcagcagcgtagtgacttcagtttagaattgacctttgagagaccagacaatatcatgagtatgtactgtgagtgaatttaagacctgggaaaactgcaggtgcctgtgcattcttctgacttctcaccaaaatgacgtcctgcttgatttgcaatttcctgaagtcaacctctctagggtgagaacaaggaatgcctgctgcttgcttgctgcatctacccagtctggtttttagttctctctctctctccctccctccctctcccccctgcactccccacctctcactctcattattacaaatgtgagggtgtgtccgtggtagtcttcctgcttctagctctcagctcccatggttgtgaggagacttatcaagttctcatttaggcatcagaacaataactgctattgtggttgtaaacattcccccatgactccgagcatggtggtaactgagtctgggagaacctgggagatgaattcagcagcctggctctcatggaagtcaagtgtgagtgtgatgactgttgggcatcccttctaagccactgtatttcctgcaagtgactttgtgaaacaaaaacctgggggggggaggagtaaaagcagtttatagtaaggatggcagtgtaaactggatgctttcagtaaggatgacgtgatgagatatggtcagatcagacagggtgcctgctcagatgttacttcattcagctgtttgaggctcacctaattggagtaaatggtggttgtcttcatctaagccatagcattgtctttgcctggtctaatggatattaggactgaattgggcagcttggcaaccatctctgttgagtagaagggagattctagagcagtggttttcaacctttctaatactgcaaccctctaataaagtttcttccgttgtggtgacccccaactatttctctactgctaagtagtgtaaatagctgatatggggatatctgatacgggacccctgtgaaagggtcgtttaatctccagaggggtcgtgatccacaggctgagacccgcttttctcaagtcaagtcttagaataccaagcacttgccacacaaatttgaagaccagaatgggtatccttagttagtgcccgcataaaacagcatatgggcatgagagcccacttgtaatcccagcaccaaggagatagagataaggaacccttggggcaagctggccagctagactagtcgaattgatgaactgtgggtttcgtgagagaccctggcactaagtatagtggagagtaatcaaggaaagcagcgtcttacttccacacatgtgcaaaagaaattttacaaaaaaaataaaataaaattagaagggaatacctctggcacgggttaagtcttggggtggagttttagtacaaatgagagtctggccatagggaacctgaataacagcagggcttggggtctagacatatgggaggacaaataagccaaggactggactgagtcagaccaggcactggcctctgtacagtgcagcctgtacagagccccatgaaagaaggtttagaggagtcccactttgctgatagaggttacgtttatatggatggtagatatcctgaccctagtcttcaggctaggacaacagaggacggtgtctgtttttagaggctggaaacagggcctcaacatgacccatgcatgactttccaagccctgagctcagtagtgagaatggagaagctcatttacagtgaaatttacagtggtgctttccagaccttgcggctcaacgtggaacacagaagcatcagtcattgattacttggggattctgaacccaaaagaccagcagaaggacaaagagaaatggagagacaggaaaaaataaaaataaaagtaaataaataaaagtggcctggagaggagacctgtatgagttgagtagagagggagtgggtgtgtttggtggaaatgacaggtggggacactcctgcatgactgttaagtatagagagctcacggcttacatttttgttgctgccagagtaaagtacctcagactggttcctttgtaaggaaaagaaaatgtattagctggaacgtggtgacacatacctgcaatcctggcaggaagatcagaagaagttcgaggtctgccttggaaccatagccgagtttgaagccagtttgagctgcatgaggctctgtttcaaaatagaggaggggaaatggcctacctggtcagaacacttgcattaagacctgagtttgactccccaagcctgtggaaaatgtcaagtgtgtttggatgtatatgtgcgcccctaacactggtggggtgggagtggggtagggtggagccggagcttgttggccactaacccagctccaggttaagtgagaggtcctgtctgaagagagcaaggcagaacatggtagagcaagatgcccgctgccctcctctgacctcctcatgtatactggtgcttattcccagagtctgctgttatacataggtctggaggctaagccatggaacatagttgctttgtttctgtgaatttcgggttttagagccatttaaatcatttttatttggtgactacagcagagacctgatatttctgaggtgcatagtaagtacctcaagccagcctttccatcattttctttttttgatggctaaccttcagtatccagtcctcttcagggtttgcttttgtcttttctggatgtggctttggcctgctgaacgcagaactcctgagctttgtgagtgcttaaggggcagctgctcctcctatctttgattgcagctaactgaatagttaacaccaatagactaatgccagggaggggtaacaaaataccacatcctgttagttaaaagctgtcacggcttcactccctggcagaaaggggctagagaactttacaatagcatgcaggagctgatacacaggtgtggactccttctacagttgggcattgtgctgtcggtcgctctgaagcccagcagaaagctcccacagcagaaaacccaggtccccacctgacctcatgtggcttttcagagaatgatcagcaagggcttcacttatttaatctttgcctcacccataaaagagaagtgagtacctcatttttcagaagaatattgagtcttggaagttactgttgtgctgaagaacacacacacagtaagtcatgaggttgaaattcaaacccactgaagcctgcctgcactctctgccgttctccagtctcttaggggaccccagggagaaaggagtgagctgtctagttgattcctgtggactgttcatattggtgacttggttgctccctggctgttgtttcgatttaccctttgtatgcatttcagttaagttgcttggatggctccttgctgctctcaatggagttggtgcaaagcacatgggctgtctctgcagggtgcctgatattcgccagggcatttaagttttctgacaggccctttacttcttggttctttggagtgcttgaggtttttatcctgttaagggagatattgatttgtggcagtgcatttgctgtagaagtcctgggcttttctgtactgactgaagtctgcttgccatcttgccttagaacatgattcctagccaagtcactctgtggaactacttcattaaagatcaggacacagcccaacacacccctggaaaattttaacattaaagaagcaggacctcaattctgtctcagatgtccagacttctctagaagtctgtcatgacttcacccactctgtggtgtcattactatctacccttgtgcacgtatgagttaaacgcaaaagcattcttatttagaatccattacaactctgtctccccagattgttcacagtagaaacaggctgccacatggattgctgctggaatactatggaaacttctatactgttgtgctgccagacactcagaataattcatataattcatatttgtttttgtatcacatgcatttccaagtatttagaaccaaaaatataaaacagcttataacagatcagtgggaggataattaggaaatagagaaagattttttttttaagttaataggacaaaatctaggagagaccatgagatgtgggaggggtatagctaagaaatcctggagaagcaggtgtggagctagcagtagagtgcatgaaatccgtgttgctccgcccactaggctgccgtagccccttgtgtcttcatggaggacagaaggtcagattcattactgtgagtccctgtctctgtttataggttccacaccaaagattctaccaaacagaagcaagttgaaaataatcaggaatattactgtgtttatatgagtgtgtataggtctctgttcttgtctttaggccatacaatatagtatatcatctacatagcacttgcattataatggattgttcttgtcttcactatatgggaggatgtgtttagattctgttctatgcaaatagcctgctgtcttacataagggatgggaacagacatggtgaccgtggcagatcctgggacttggccctggggaccctaagatggactgtttttctggataactgacgtgttgattgcttcttacatcttaccatgtggcaactttctaaagaactccccccctgagctaaagaattaaatcaagccatggaacagagggacatgaactgaaaatgcctaggaatatgtaaatctgtcttacatgtttctgattgtgtttccccatatggcctgcatctttgttagcttctatccatgtgtctgaaaatggtccttttctctactgatgtttacctcggtggctgaggctccttagggcattgctacctggcaccatgcggctgtacggactgctgaactccccatactgctctgagtccctactggttgttgctttcctctggccctggccttgtgttcactgttggtgctgtggagagggttaagtgggcatccaaaggctcctgcttaatacacagagaggccattaagtacagtataggtgatgctaggccctatgctaccatcagccaaggtgcacacatgtgtcaccttttgcctagagaagtggttctcagcttgcgggctgtgtccccttgggggcaggaaatcaagcaaccttttcatggggttcacctaagaccgtcctgcatgtcatatatttacattatgactcacaacggtaattttatgatggggtcaccacaacatgaagagctaaaggaccacagcactaggaaggttgagaaccactggcctccaggctgctgttgctcctctgctgcttcagaattcacaggttttccaaatgcactcgggtggtggtggtggtggtggtggtggtggtggtggtggtgtttcccagctttggaatcgaatttgcagggcagtttttaccaatttttgaggccgtaccaactgtgtttcctcaaggactcttgcatgagtaaatggctgtttgcaggcaatttgctcaattttttgccttttgtttcctttgctatgaaagttgaagcttagacgaagccaggggagaagtccctgtgttgcagcttgcagagttgactgtggaccatcagccgccgagggcttaggggcaggagcccagggctctggaggactgggcatagattacctctatgtgcttcacccagaattgcaagtagtctgtccagctacccttgccttgggaatggtgcctttatcctcccaacactaaaaccttttgttctgtaggctgagcagcctatcttattattcctgaacactgatacttaagccacttctgaccctgaggccaggaggaaagtgacatctgtccctgagtgtgtttgtagaagacaaatccatgcagctcagttgagaaagtcctgtttttccagttaattcacctctaagtctagcattaactgatcaaaatccttgtttacagcaagcccctaggcaactgccactgggttcttgctgtgtgccagtcactcactacacccagggctttacccaactacttaacccacctagccctgccatcctcaccatgcatagctgctgtagatgatgacaaaaagaacaaacgaggttctgtagagttcccaagaccaagagctaggcagcgtgagaactgaatcccaagtgtgactggggcagtcctgcaggaatggcgttcgtctgtgtcttccccatgaccatttagttattttaatttataatgtttaatttttgttgactgagtacagtcttagatagcgaaggtgttttgctggtggtttggcacctctagtcataatggagaatgtcacgtgtaatctgtgctacattttaacgcatattttacatactcaaaatattcatgctcttggattgggtacatgtgttgagagatactgaatatgtattttcatcaagaattgtaatgagaaattaaggtattttcattggcatctgtgttagtttgacttttgctttttttttttttttaatctctctaaatcatttttcctccaatgtttaaatgtttagtcacattacttaccagcctgctaagaaaagaacatatgtgctgggagtggacattcaagttcagaactggatcttcccagtggaagagggactgcctgggcacaaagaagacaagcactgacagctctcacccagctcacaaatacaccctttcttcctagccttaccattcagctctgaacttgggagttttatatggcactcggtagagtaattcttcataaggcacgcacgcctacaaagaaatccccattagtttcagaagaaagaggaaccgagtcaggaattagtgcaaccccttattggctgcaccttcccaccctcacaggcacactgtaagattctgagctttctcaaagggtgggaaggaaaaagagctgtaggacaaaggctcctagcagtcaccagcactggtttagaagggctgacattgtatgcaatgatcatggtgagatagaacagtggaattcactaattgagcgtgtatttgtttttgatggatcactgaaaacctgcagggaagaaatacatacaagatggcttcctcccagggtgctccactgcagtgttctaatgatcctgacattaggagttcagcagacttgggggtaagccctcacttctgtaaagagaaaagcccacattgtacttattccttggacaatggcattgcccattgtcttagtcagggtttctattcctgcacaaacatcatgaccaagaagcaagttggggaggaaagggtttattcagcttacatttccaaatcgctgttcatcactaaaggaagtcaggactggaactcaagcaggtcaggaagcaggagctgatgcagaggccatggagggatgttctttactggcttgcttcccctggcttgctcagtctgctttcttatagaacccaagactaccagcccagagatggtcccacccacaagggtcttttccccttgatcactaattgagaaaatgccttaaagttggatctcatggaggcatttcctcaactgaagctcctttctctgtgataactccagctgtgtcaagttgacacaaaactagccagtacacccatgtacatgcccaggacatacatgtagaatttgggggatcaactcagcattggagaagacattgattttcattttttttcaaagctggagttaatgtggaggaaaagtttctgcctaagtttcctgccccactctcagtctccttggatttacacattctagctatcagaggatacatactctcccctctatagagcataaatgatagtgactggagacttgggctgaaatgggatgcttgttatccaagaagaagcagggaacgtgttgctgttagtgccttgcctctaaagcagtttagaattcagaattcctttaagttcctactgatagttccccggggccaggtaaagaggattccctaccagcacaacactgaggtgggaaggtccagttgtcaagccttttgctttgccctatgttgttctgccagcctttgaggagaactctgcctctcccttgtctgctctccgtctctgtggtttctaatggcttctggagcctcctgctcatgcacccctccctcctttgatttgtgtcccctgttcctgctctctgtgctgaacccagacttccatattttgcagcatctcaaagcccatctgctcgtgactccagataacctatagtttctgccaaggacagtcctggtccttatcttggtgggcccctctgcttccttcagacttaaaagctacacactcacagggaccttcccttttatggtacttgccaccatggtgacatttagtattaaaagcttctcagaatttttagttgactttaataatggggcctaactctaatggaggagatgcccacacattaatagcctctggtcataacagaataaacattttagcataaataaaaattttggttaaattcgatgtaggttacagatctaattagtggcaaaagttgttgttggcatctgttctttgagtcttcacgaatgactcttctgcactggtgtgtaatgtcctaagggccagagagacattctttctgtttggcttcaggctgctctgaagagcaaataagcagaaatctttcatgaaaagacagaagaaaggctgtttatagaaatgtacattgtagtcatagctgaccctagctcagtgctttgatggttattgagagcagctatagtctgatagaatgtccctgaagtctcctgcagcctgttgtccaggagatcattcatgcaggggtgaacagatgtgggaagacatgactctgcccgaatatcattctcttaagcccacactgatggagtggtgaatagatagatatcaggatactacactgggcaataccttgtcttcctcccaccttcggtggttatgttatggccgaggtggcctttcagatcccacttccaccaccctgtcaacatctgaaaagcgttactggtgtagttgggtatctgtaggaccaaagcaactgaccacaattgtgcctgggcccattttgactttgcctaaaattggtttgtgttcaattccctgtcctgctccctaagtcatgattggggtttctttgatactttctaagatagtggccacaatacaatgcagtttgactactctccaccaagtcagatagcttgcagaacacaggctgctttgtgaggaaagcctcctggctgtaaataccatctgtcatagattgctcatgagaactctgggcagtgaaacctaagaccttgtacgctcagaaaacaacgtgcaccacctcggtggttcatggagcccatgagcatggtttacggaccgtctgtttgccacctcctgtctctcccacacccaaactcaggaggccccaactcttaagtgttgttttccagttgcttgtgcacagacagcactttgacaaataggcaccagtggtttggtagtttaaagaaggtgggggcagggaacgaagatgagggaaggctgttttattttctctggactctcaattgatgtgacaaaatcagccgaaaccaaagtttaaaaagagaaaaatgctaaagtcagcttatatcacaaggatggatgtaggattctgggggtgtggttcaggctgtgaggactctgtgtctttgggaattattttgctcacctccatcattcattaagtgctgaatgctactggcatctgctgcctatggccctctctcagggtccctggagagcttggataccatatgtatttcctctggctcagcagtgcaggttgaatgagccctaataacccaggtggaaaagccttgactatgaaagggttaggaagtgttgaccaggttaaaacttggaggcagcgttatctatcttacatgatcaacctgtccaaatattcttacgtttattgtcatagttgtaattcataatttaaatacctgtggtttttgatggtcttaagacaatccccgtgaaaaggttgttcaaccccaaaggggatgtgagccacaggctgagagtccctgctgtagaggagcacagcttattgactttcttcccaggagtggcgtcatatccactgagctgggccctcccatattattcatcaagaaaatggcccacaggcttgcccacaggcctgtctgcccgaggacattgttttcacttgaggttctccctgaattactttaacttgaatgagttgacaaaactctagccagaacacatagcaaatttgggggttgtcttttcacgtattctgttaaattttgttaaattattttaaactttattctgaagtaactgagttgattttttttaccagcattaccacaaaactagatgcaaatcaagtcagcacacagtgatgtgaaatcactcaaaagccaaatattaaatacttcctctccctgagaattatagtgggcaatttctaccttccttagtcagatctcatagcctttaataataagggcctttcataatttttagttgatcttaataataactaaatctaatggcagaaatccctacacattaataccctgtaatccaacagcttacagtaaggaatattttttttgttaaatatcacttatgttacagatatgattagtggcaaaattaagtgatttgccccagagttcccaaaattcaagcacactccgtctgaatgagttagcttgagtatatttcagaagtatcaaatttgtttgacgttttctcttaaatcgcagggctccagctggaagatgacagttagagcatgtctcagaggtgtttgttataacagcccttcatcgttggggaagaggggtgcataaaagattttgactttaaaatgatgaacattaataatggatgacatgttcaaacttttattagaactcagtgtttatttaattttattcaggaaagttaaaatgtgcctgttatcatcaataaaaatgtagctcagggctagagagctaacacctggtgccaaaaaatcgtcatgaagatggaaaagcctggcctgccgtaagtccagctcagctgttagctgttacagtcagtgccatctctgttcacagaacaaaaataccatcccacagggtggatgatattacagtacaacttgtggccagtcttttctcaagtctctacagatgtggcttcattagcggcttggtcaccttctacagttggcaaactctacccactttgggcagctttgtgcttggggagggtagttgcctggtgtgggacaactcaactggtccagtcagatcctctgagattctgaaacctgtgtcaactgcgtagtgttggttgctcttttgcttagggctctgtggagaggaaacagcattgtagctgctcgggtactgggggatgagggggatacaaggcacataggtacttgcctccagtcactttggcagaacacaacaggactcagggcttactgcctacaacaggagctggccatgatgctctatgcctgagccttagtggtctgcctcaattgatatattgaaacctcaccccatctacccctgatcttgggaggtataaggcctttgagaggcctcaaaatgaaggactagggaaacttgttttccccttcctgcctagtggggacataggcatgtgaaacaggaggtgggacctcacctagtctgctggctctgtgatttttaagattttcaagcttgcagaatttcaagagattaatttatgtctgtggtattgtgtagtgtcaggttgctcttctgctgggtctctcaggtttaagtgcagatggacagccttatttttctgttggaagaagtaaacccaaggcctaggaggtggtatatccatgcttgctaacctaggccaaataccataatcttatgctaatggatttcagaagattgaagcttttctctgaatacagatcttcagtttaggtgtgaaaatcttgctcctgggacctagaaaacagcatcttgcaagtgttttgtttagggatattattattattattattatttatatgagaacactgaacactgtagctatctttagacacaccagaagagggcatcggatcccattgcagatggttgttagccaccatgtggttgctgggaattgaactcaggacctctagaagagtagtcagtgctctttactgctgagccatctctctggggatttttcagtaggatattctgttccttctttgttctgtgtttgtttatgccaaagtattgcagtttaaagataattgaacaatctgtaaatagccattattttgcacagtgtgatactttacctgccccagcacatagcttgctagcatttggaaagtttctaatgggctaattctagctattctcattcctatgacttatgcaaagcaggctgcagcggcctgccacacacacaactgaaagtctcacaccctaagtcagttttgtaaggaatgattttatgataaacatgagatttggaaagagaaatgtgtggttgaactctcatgcagattggtacagattctccagtgtgcactgtgtctggactggtacaagatggcacatactaggcatgtttgttctgggtggaattcactgaagccaacagataggatcccactgttggtgcctgcatcaggagttggttgttggaaccctagttataaggattctggagacagcactggaaagtacttgtctctatatgtggtatagatggagtgagcagaccctctggttaataggatttctggtctgccatgtttatatgagcttgctgtttatggcttgggtccttgagaaatggatgtgaaggcttgcctcttaaaaaaaatcttttgataaaatacgtcaaattctaggagaaaagtcatacaggttttccatcacacacaatcttcaatgtctcatatttttggttgtgagcctagcctttaccagctgagccatctagtcagagacctgggattagggagactccagggagtctttgaacatgactgtagctgagagtcctagcagtggggcatatggagcttgaattggccacctcctgtagcctaggacctaggacctagcacacacatacacacacacacacacacacacacacataaagcagatgtgcagcttggtcttcatttgggtcctccaacaactggagcaggaactatctctgactctgttacctacctgtggatcccattcccctaattgggctaccttgtctggcctcaatgggagatgtgcctagtcctgcagtgacttgaggtgtcaggatgggctagtacaggacagggtggggagctcccccttctcagagacgaaggggaggggaaagaggctgtgggagggctgggaggagaggtgggggccgatcgggatgtgtgtaaagttaataaataaaataatgggaaaaaagagaaaaaaaataaacactcttcaaagttcttctgcctggatttagtatgtcagtacatcttttactcattcatcagtctgttgtagaaaaagaaaaagagttgagtcttttgtgagcaaagcggttgcaaatggagaaggaagccagaagggccagcttgcagccaggcaatatggcagcgaaatcagaggagcaaagagaaagggtcttggggcaaactgttcaggaaggaggtaaggggatgaagggtgggatacaagctcttctggcctagatctggcccactggaaaattgccacaggtctttaaattcatttagtccaacttctttagtcagtcccagtgcaaaagtgcaggcgcctcccccccacccccctcgcctttctttatgcctttttctcagtcctgagccccgggcgatcactaaagctggccatccttccagaaggttttactttcctctcttcttgttatcttttgtgtcatagacctactggcacttgttaatgggttaaaatggaacagaccacttttggtaagtatcagctttttaatagcttcatatctgtgccacgcagctggaccattttcttttccagctagtcactgtcgtttgtaaccagtctttgtgtgtcctacctcaccctgcccccgctaaaaagttccatactttgatagtgtaggagtgggcatggtgtacaacgtatgtccagtgccagctgaatcatttgccatgtcttcacaggcctcggaaagacgcgcaggaagccaagcgctcgggatgcttccccaacgccaagcactgatgcggagtacccagccaatggcagcggtgctgaccgcatctatgacctcaacatcccagcctttgtcaagttcgcctacgtagcagaacgagaggatgagctgtccctggtgaagggctcccgtgtcacagttatggagaaatgcagtgatggctggtggcgtggcagcttcaacgggcagatcggctggttcccctccaactacgttttggaggaagcggacgaagctgcggctgaggcccccagcttcctgagcctacgtcggggcactgcactgagcaatgggcagggtgcacgggtgctgcacgtggtgcagacgctgtaccccttcagctcggtcactgaggaggagcttagtttcgagaagggggagaccatggaggtgattgagaagccggagaatgaccctgaatggtggaaatgcaaaaatgcccgaggccaagtgggcctggtccccaaaaactacgtggttgttctcagtgatgggcctgctctgcaccccgctcacaccccccagatcagctacaccgggccttcagccagcgggcgctttgctggtcgggagtggtactatggcaacgtgacacggcaccaggccgagtgtgcgctcaatgagcggggcgtcgagggcgacttcctcattagggacagcgagtcctcggtaagtgcccagcagctcctgtgctggagccacattgccagaaggaagctaaatgcgcagttccctgacctgtgaggtcagggattccagccagccctggtctgcggatattcaataatgttacaggtcatttgcctcattctccattgttaaatgtctcaccaagtcatgtaagttaggcttaatcctgggcataacaaaaagccttatttctagggttctgatctaccatggttctaggtgtccactggagttctcggaaccgtcctcagaaagaaccacattgtggaagggccgtgactggtaaccgttcccatggcatgttcactgactatacttgaaatagcaaaatggtatttgagggcacgtactaaagtagccaaatactatgttgacatagagtcagctgctcccaatttagctaaatctaggttgggtagactgtgaagtccctgttgctactccttttcctggttgtgggaagataagaaaagtgatttccagctctcaggggtggtcttggcccaggcttccccttttccagtttggagatgcagggcttcctgttctgtcctggttctggcctgtgtagaaaactcctgtgattacttgttcaatgccctgtgcatctgagtgtacagcaggctctcagctaataggtgtctggcctctgacacagccttgtgttgctggtttgtaaactgtatgatcccaaggtggtctctgctgcaagccgagccaccgagaagctcacctctgaaaagctcgtaaagtacttactagtagaagttaacagaaacctggagtgctcagggaaggaggcacagccagtctccctccagcaggtgtctggctgtggggccctgtggctcaacggggctatctgaaagaaccagagaatttcactacaggcagccttgctgtgtgtgcttcccacgaataacccagtttgtaaataccttcccagtgaccctcctaaacctgtaagcaagggtttagtccagtatctgtaagtgttaccagttctcccaggctttggtttcatgttttacgctcacactgtaaaagcagaatgtgtgggtactgctctgctagctcagtgagcagtgtacacaaaaccgatctgagaggaggtcacaacccctcatggagaggggccgctgaagtctgttctttatagcaaaagaggcattgagctagtggaaaccagatccctgcaccgtgtcagcagcttttcagggccggccttagccttggatattcttaggcaggtctctgaatgctgactgcctctgaaatctgaatactgagatgtcctgatcaagaccagggtgttcatcattgctggcgaagacttcacatggcattgttctcacgccttggagtctctgtgcctggctgcctttaggtcacattctgggcccgtgaggacagcaccagagcagaaacaggacaggcactgggaaatcaattagaatacaaaatgcccagtccagagtgcctcagagcccaatgcttacatttggagtggcttcttgggagagagagagggctaagaaccacatagtgggaagctactgactggcctctttattgacaagatggggtttctaatccaaaaaagacccattcattctctgtgtgcacgtaagcagccttcttcccactgatggagacattggttatttacagtttattttaaccctttttgtagacatcctttattctgccgggttaagacaggcttttgttcctaggggtgcgggggcaatactttattagaacatgtgtgtcacttccagagacactgattgggctgcatctgtgtggggcctctctgaccctacattcttgggactgttaagttgtgtatgtgtgccaaggggtccaagttgtgttaagttttatccactgatgaaagaacgggccagattcaggtttactgtctttctgcttgtccttttccacttcctgctgcctttcccatgtcctatgtcacttctgttcttttgggatttttcaggtcagagccttgtcctcacagccaaacccaggtcacacagaacattaatttgtgatctaattgcatatcccagggttgggatatagtaggtattcccagaggcgtgactctctcacagggctgaggcaggtgcatttaggcctgtagcctccattggggggcgaggtggggcgtgtatgggaagcctgactcctgaatgtgaacagtagtttaggggaatacatcttcctgatacgtatctcaggtgattacaaggtaaatgaataaggctctagatggtgttgtgcactgataaatgcctgctgtttttcttcttcagagtattaaaatttactcttctctggggtacaagaaagtctgtactttgaagagagaggtgtgcattgcaagtaaaataagcattgtttcatctgtgccttccaggctgggagagtgctaagcattgcagttccagttgtactggacttgagagacaaacaagcagacctgtttgactcaaccacccccaaccgcagtacccaccaccctttctcttctgactgtttttttctttcttactctgtttgcttatctataatgacaattcttcctgaaaactaaaagagacacaatattttcccttgtcaaccagcacttgtgcactaactctgcccaaagtataaaattcacagaagccctccctcccccgaatgggcaccagatccttacatgtttgcctacattgattttatgggaatgcttaagaggctgtacttaaaattaatttctggcaagcgggataagtgtcagtgttttattttctggatccctttccttgtaaaaggcatttgatgcaaagtaaggagaccccctgaaaggtagaagagggactgggttgggacagaacagcatctgcaggaggggcacggggagtcctccctctgtagactttaatcctcagagagctaataattcccctccggtgcattatgtgccttgataattattaggtactgatatttgtcatgcgtcacactcatttcaggtagaggaaaagtcctttgataaagatgatttaatattttattgaccacacaggcaaagccagtggttgcttcattttcccttttaaagccaattaataggaaataaaaactaatgagttattttcaaattattatatatttaaattttattttatgcatatggatattgtgctgggacgtgtatctttgtagcacatgtgtagagtgcccttggaggccagaagagtgtgttagatctagcactggacttgcagagggttgtgaaccaccctgtgggtactgagaatcgaacctgcatcctctgaaaaaaaccaacagtattcttaacctctgagtcatcgttccggaccaaaatcattttatttcttctagaaagatttctgaccatagtttaagaataagaataatgggttgtaacattttaagaatttatttcttatagaaacatttctagccaccatttctctgacccatctgtctagatgggattcgtataacgcagttcagatccagatgccctcaggaactgtgactatagagatgagtgcccttccattctctcggcatttctcagaatgaaaggtctttctgggttagcttggaagacagaagcagtcaagtcatttccttagggtttgcatcgtccagcttcctagccaagttggcattaggagtaagcaggttacccagagtagcatctctcgctgtcttagagtttctattgctgagataaacaccacgactgaaagaaactttgggaggaaacagtttatctagcatataccttccatatcataatccattgttgaaggatgtcagggcagaagcctgaaggctggagctggagcagagggcatggcagaatgctgcttcatggctttctcagcctactgataacacctgaaccaccagcctgggggtgtcactgcccacggtgaactgtgtcctctcacatcagttcacagttatgaaaatgcacaacaggcttgtccacaagccaatctattggggacacttttttcacttgaggctccttcttccaaaatgactctaggttatgttgaattgacctaaaactagtcattacagtcttgttttggaaaaagtcattttctcaggctttttgtatggtaccaaatgaaaattttctaactttaagcctacctattcttactctttaaaattattttaatctaatatattctgaccatgcttttccctagcctgaatcttgtccatctctaaactccatgtctccttccccaccccctcaaacaggcaatcaaattttttttttaattttaaagaaaacacacacatacaaaacaaaaaaatgagaaatcataatgtacatccaaaagaccaagacaaacaaacaaaatatggagacaaaaaatttataaaaatgctgttgagtccatttgttttgtgttgatcatctactgttgggcatgaggcttaccctcaagggtggttaatgtatacagttagactccattgagagaaaactaatttttccttttgaagtggctgacagttgcagataacttcttggttagagggtggaaccccatgtccactttctcttcccagagatagggctacatctagcttgaacatggacaggccctgtccttgctgccacagtttcttagcgatcatatatgcctcagtcctgatgtgtctggaagacattctgtccttggggtcctcatcccctctgactctctttctacatatgtgcctaagcagtaaggggaggcgcttgctgaagacattcttgttagtactgagggtcctaaaatctcgcactctcagcacattgtgcagttgtgagcctgtgtatcagttaccattgtgcagttgtgagtctgtgtatcagtcaccatccactggaagagggagcttctttggctgagcaagaccatcgtctgtgggtgtagccggatgtcattttatagcaggggtcattttattactatgctacttgagaacaaaagtatttggttttctcctaggctcatagtctgtccagtcacaagttcttggccacctaaaggaatagccaagtatgagttctgtctcatggaataggcctcaaattcattgatacaatggttgcttattcctgtaatgtttgtaccaggattgctccggcatatctgtgggcaggtcactgttgtagatcgcagtgtttgtagctaggttgatgactgcctttctcccctggtagtatgcagactattttccagtaccatgaacctagtcagtaggtgagaagcctctagttaggttccaacttgacttctcagtgttcagtgtgatatgtaaatgttttcaccagcaataagaacttaccgttgagtcttaatcttagaaggctatatacgtttagaatgggctctttttctaagagcccattgcctggctgtttcattcgcaagtgagccagagcccttggaggcagattcctcttcaccagcctttgatttctagtcctcgctttaaaacagcacgccactctctgggacctgtgtaaaggatatgattagtttgagaggctagctcttacgcaaagacggctcatcatgtacatgcacatactccaaactccagagtttcttgtctcaagtatcaaaggataatagacctacagtgctgaatccatgttgacctctgtgagtgaaatgtagaactgtaggaatgtggaaaatagagaacgacctacaacaacttgggaatcacagtgtgtctgtgagttgagtcgtccaagccaacagtgtctggacagtggtggtaaaacatgatcattaacctggaggtggcctctcagttacctcagcagtgtgtctcgctcccacacaaatcacatactcagctccatcatttccttcagcttggcttttgcctgtccagagctcagtacaaatgtggagggcacaccacacccctaccttctgcagcacagcatacacaccatcttgggaaacataaatctttccaatgccactctgcctatcttctgaaaagtcttggctgacctgcaggcttgttcttccatcctcctgtacacccctttcaatgagagttagcccaaggttatattaggaacatttaacaatgtctaccttgcttggcattgaagcctaaaaaccattactcctcttagggggtaagttgattatgtacagtggagcctaacggagctataggttgcccagttcatcctgcgttgtgttcatgtgtggggctgtgctgtactgctgtctggagtgggtcagatccctggcctctggagtactgttgctgctgctgctaaagggtctggatgctcgctctcaggcctgccagcgcggtaaagggagaggaggccattccctgtccgctaaagcagctctgcagactaagaaaaaaatgtcagattgacagttcaaccttaagagtgttcagaagtgttctcattcaaatcccttagatctgtagctcctttttgcaaaaagacttatatagagttcttgcaaaatggttagtacagggtagaaatgcttttcacccaaaatatgtatgtaaaagtataatggaaagagaaacttaaagcccaggatcagatatgcctttatcacttgactccctgaaatgcccacgtggctaatgtgtgaactgtactaagagggaacttctgaggctggctttttcgatatttgggttttgcctggtttgcatttttttttttttttttttactttactgtggctgcagtagacacgagtgtgtgtcttacatatggagactttcatttacttctcagagaaaggatttgtaagtttggcttgcctactggcaatcccacaagcatgctatgtaaagttagtcttgatatgaaactatacacatggacttggaatgtgtgtcttcaataaaacacgtgtacagcagactaaggacaaatgggtgtgtggaccagcaagcccacttgggggccccttctgctgtggaaaagtagggtgctccctatctcacacttgagaaacgacatcaatgtcctttgaagagttctttcccattccacaagagggctggagagatggctccgtggttaagagcactgactgctcttccggaggtcctgagtttaaatcccagcaaccacatggtggctcacaaccatctgtaatgtgatcggatgccctcttctggtgtgtctgaagacagctaccgtgtacttacatataataaataaataaatcttttaaaaaaaaaaagaaagaaaaattcaacaagaaaggtttatgtttaaaggaactcgcagacaaaatcatcatacagcttgttcaaggcagacacacttaccaggcccagaatacccatctctgtgaccttccataccattaaaagggccatcctgaagccgtggagtgccacttacagctttatacattcactgtcagtttactgttatggacttcgcatgcacagagaataaagaactgtggtagattgaaaccagaacagttagctttataaccactttcacagtttggccttgtgcctacatcccgtccacagcatggtgttaatgccatctgctccagagcggcatagtggctccagcaaacacaggcagtcagtgtccctaggaattttgagaggtagacaaaaatgtatttgtagaagaatgagctaggaagtccagagagtccttgatgctggggccgtctctcaacttttttctggtcccttaaaaaaaaaaaaaaaaaaaaacgaagtagtcagcaggtgtctcaagtgggcaaaatctctgtttgatctccaagaggcagcacttggggacagtgcctcctcgccatgacttcccatgcccgctgttggtggcttctgcggcaggaagggaacagcctccccacccaccgtggtccttccgtttcctggatccccatcagtttctcagatctcttgtcgatcaccacttaacctttaccctttttccttttgtggtaaaacgtctttaaaaccaaattggctgtttcaacagtttttaagtgtgcatttcagtcagtgaatgcttttacatcattgtgcagctgctaatcttcagagctccattactgtcccaaactgaaactctgtcctcattggacactgactccctagctgccctcttccctgagattcctttcccactctgggtttttatacttaggagcctcttataagtgggttgcctccactgaattatgttctggttgtccctgattttatttcagttataatgtctttggagttcatttatgttgtagcaatattttagaaattgtccttcaataatgagtaatattcctttttcgatatctattcatctggtgatagattttcagggtgtttctagttttgtttttaattattaataatgctgctatgattgtgggtatatagatatttctttaagtttctacttgaattctcttaggtgtaccctttggtaggtttgctgaatcaaatggcaaacttattttaattttatgaaacccacagtgatgcttcacaagtccccgccactacacatttccttgacaaaccctgatgccctgacaggagcagcgaagttagaagtagcgtttttatgccgtggagtctgcggtacatattaaatttagtgtgtggtaaccatagtggaatcccacgttcaccttccttgctgtactcggtttcgctttataaagttgcagtgttatgatgagtgtccggcatgtagcagaatcaatccactgccggagctcagaagcagtacttcttagacaggtagcatcattgtcagcaacaaacttgctagaagtacagagtaccaggcccctcctgcagtgaatctgatgctgggacttgaagtcctgccttgtggggtgtatgccccctgaacatactttatggtaaaattataacttactctcttttaaactgggtatagtggtttacacctatggtcccagcattcaggaggctgaggcaggaagagttccaagaccagcctgggctacgtggtaggctccagatcaacctgagctacaacacagcaaagaaacaaaacatgttctttagttctatgaagtaagacactgtggacagacaaagaaggacaataagtctgtacgataaaatatcgtgttggggaaaatctattggggtgggcaggaaagggtagacttctgcagagttctgtttgaaggtgatcttgagagccctgatagcttctacatttttataggcaggggggactttgaagttattctctagttgagaactagttttctttactaaaatgagttcctttcgcactagtgaaatgcatgtttggtgttctgtgggttatgtttaggcccttatgtggaataaagagcaagtatgaccagcattgatggaaacatttcagtcagttttgacttaaaaagaggctgcattgggcagccagggaaggtggcacacagaagatgttaatcagtagtgcccattttacctctcatgcattgggtcttcatttggggatcagtgaacatcttcagacaaagggtattaatgaagtaaaaaggggaaaaatatttctcaaatgaaaaggagggaggggatgtagggtttgataagaaaccaatagattgccctctctttgagatgcagggaataacaacattagtgcagatcactgatgcttgaggcagtaagcagagtcttgctcaggtccatgtgggtggtcaagaacatttcttgtccaaagtggatgataaattttaaggttaattaaaaactaagtatctcagcagcaaagttccctctttctttatttccttacagtcaccatgcttagaaaataaatcactttaatgcttagtaagctctcagagatgaaggagaaaagaacattaaagatcattcttgatgtttgtggttttctatgattcagttttgagtgaggaagagaaatattttcccaagttacctgctaaatttatggggagtccagaggcacttttgaggtttttaaactgggtcaaacaggtacctctgtagaaaccatctgactctgtagaaaacaccagtgagcatctttcaggtgtttttctaaaaatacctatacataaaaattgctgagatgcaagatttaaggaagagaacagtggaagagatggtcagaattgggaatctataagtactctgagcccagtgcaagggtgtgaaattaaatcaggttctcagattggggagtgggatgttggggtgctcataataatgaattctatgaccctgttgtctatagattcacctgaacttcctaaaaagaagagaggtgtggacgaattgtactcagtgttaatgctcttggattccactaggcaatgaagaaaatagaactgtggcttacaaaggaataggccgagaaagagatggacagtgcagtccagcattagggaatgtgaaggaggcccagtcagaggaacatcaaccagattcagtgctgggagaacctgtggagcccagggaggagtccaaatgggagaacaaagagagggcatagagtcagatgtttcagatcagagaaggtgcagtcttagctaagccaaagtgtagtctagccattagaaaggtttgatggctacagtgtatagaatggtaggaaaaaaaatcatccattcttcactactccttcctctggagtgtggaacctattcagtggctgacttctgatgactggaatgaaacccaaaatgggcaaagatagtcttgagttcttgcttggaactccctatctggttgagtcagttgccgtatctcaggcagccttgcagagggccttgtgtggttcctgggaaatcctaaattgagacagatgactgcagcctccaccagtgtcttatgtcttgttttatagatctggggatgaaaggcagcgcttcccacatgctaggtaagcgtcctcccaaggaactacccaccccgtgctctgtgtgtttgaaaaccatgtatagcttctcagacaagctttgtttcagagtattggtatcacagcacaataccctactgtttctgagaggaggtatgtggcatccggctgcttcatctcttttccttaagtctgttcataaagcaggcacaagaggttcagaactgacagggaaagacagacggggtaatcgttctaggtcctgttcccctgcctggtgttctttgaggcagatttgtttgggggccagaatagctcccatctccagtagactcaggggttaggtcacatggtaggaataaatattaaccctttccagaatgtagcccatcaggggacgctctccacagggaatggccagattgaacaaggtgggcatcgttgtagactacgaggaacgttggccgtaagccaccatttttgaactgctttgttcatgaatcacattcccatcttttctgtctacttatacatctatttattagtgatcacagttctcttggtgactgactcaaggtctgctgaaatccaggtggctgtagcctcccacaaaggggacctggtcctgctgttgatgagtttcggtttctggagcaggcttaaaaacctctcttcataaagaccccataaagatgacaccacgttgctggtctggagatcactgagttctgtcatctccaggcagcatgtaaagaggggttcagaggtactagcaagggggggggctctcatttataatctgacttgggccaaagtaaaacattatttttaaatacttataaaaatgtatactgtcaggtttggggatttatttagttcagtgggtttactcctcagatctgggaaaggaaggaagaaaagaggggaggggggattgtcagtcatgctatataaggcttatctaaaacacaaattagtgtttcagactctggtcacatccccaaactattttatatgcaaatattccaattttaaaaacaaatccaaaatctgcacattgtattgagaagcaatagggtcctgtaacatgaagagatgtctactgcctgaggaaagtcttatcaatttgaattaagaatgctcgagactcctgcttagcatgagttgatggtgtgcccttgactttaaggtttcactcaagaagcccatgaaattagaaattcctttcccggctgcatcattttactgctgcactgtagcaagcccttacatgtcatgggatcatattaaggatttgattaaaagcaaatttccctgttcagaaagtcatcttagttagcaaacacgaggcataccagatgtctgctacagccatccgcagtcaccacccctaacaataaagctgctttgtcttggttgattaaagaatcatccaagtagcacagtctgccttgtggctggcacagggaggggtccccaccttagaacagacctacttatagattattaatagtgaggagctaaaatataatccccccgccaccagtgggggagagttgaacagctcctaacttgcgtgtttcattgtgctcaattgtctgatgactgcctggtgaccttagtgccagtatgtgcagtgtgtgccttttaagtagcatctgttattcacttcccacgtgatgtgggcctcccagaacactcaggctaacttgtatccatctgtagcaagctatcttggttatcaggtcaactgttgggatatcacatggttacattcaagtaaccatatttagtattggcatcacaaggcacgagcagtggtgctggcaactgaaatattccaaaagaaaacagacagcacttttcagcactactggggatcttggggcgtgaaaaggtctgtctgttaaagatgttcacagggccagttgccatgctcacctgtgataccagagttccgtgatcctttgaaaaaagtgtcaggttctatgtcttgcctacccagggactcatgcatgatcatgatgctgaaaacctatgccccaaggcccatctcttactgggcctcctcccagctatccaaccttggagataaaaattcaaactgctgtcatcgttcctttctttaagtagctgtgtctgctaggtgaccctgctgcctactaggtttgaactgctccaggctcctatcttgaaatggccaagggcaaacatgggctctttgtctatagaacttgcccactctatcaaacaacccgctgggttttgttaatttcacatggaggccctgctgggagagagggccagctactggttcccgattagcagcaagttcccagggataggagcaagcaggagcagacttagaagggcctgtcatgggtgtggacttaactgctgcaggggaggccggaggggcatcccgaccctgcccaggcaactagacttttgagaatagcctgtagagaatggccaaccaggggacaaagcacaattcagggacaccatgaatgggagtgagaagggttggggtatgagtctcttcccttcctatggagccacactgcctttttagtgccacagaatggtaagtcctcctttccccaccataggtgccatatgcggtgcaagcaagccactgccacccatagctcagcctcagctcctttgactgtagaggtctttcctaactccaccacaagtgctcaaacatatacgtacagcatatgtacactcacgcatacacaaacatacaaatgattcacgctcccattcactcttacatacaactttcacaaatgcacatattctttcatacacacaaagcacacacctaagttgtgtctactcacaatcatggcgtaacctccatacccaccttccttactggatgttatttaaagtgggtggcttaagcatatgtgtagggcataggttgcctggcacatagtcagcatttagtaaacatcaaatcaattgatgcctctattcaatagccttcctgttggctttcaggaaattagctagatgaccagttttatttaaaacactagaataccccaaaatatactcaataagtaaggcactgatctcatcacagaatttaaccttttctcacggaaatttgttctttgaaccactgcggagccatctgtgggacatcacaaactctttcagatacacccatgttgtccactaccttgacagtatctattgttaaagagcgtaaattttaatagaaatcagaagaaacacttccagttttctgcctgcatgaaaaccactttgaataattcccagtttgtcagaagtaatttggggaaatggaaatctcaggtttcttctgtcttgaggttaacccagctgtcattctctctgtaacgagatcctccgtgtcagagacccagcgtgctgtgcgtttacccccgaatccatggaagcagaatttcattagcgcttgattgtgagcctgagagcgctgggctgccagtcagtctgcagacactgggtgaacactgtgcttgttaggcagaccctggtctcctcaggtgcctaccctgctggtaactcccttctgcttcctcctcagcccagtgacttctccgtgtctctcaaagcgtcagggagaaacaagcacttcaaggtgcagctggtggacagcgtctactgcattgggcagcggcggttccacagcatggacgagcttgtggagcactacaagaaggcccccatcttcaccagcgagcacggggagaagctctaccttgtccgagccctacagtgaaagcagccattggccccctcatgccctgcccactgtgggcctcgctgccacctctgcctcccagagcccagcacttctggccacctccacccatgtggcttggatcacctctgtggcccagtctgtccttcttttcagccctgttggtcaaccacggctacctaggccctcacaaccatgccccaggccaccaccttctggtgatgagggtcagagggagcaaagctactcacttctttcctttccagctggaaacagcctgtttgaatccttacacacacatacacagagagggaaggggggtgcagagagagagactgactaaaagactggagctgcttcagagggtcgcgaggctgtatgtagtgaatatgtgaccttggcacacactccgagagctgtgtccatgggtgtttggtgcctctcgtcagcatgctggtccagaccggcagcctgtgtcctgggcctgctttgctttgctttctttctttctttttcttttttttttttttcaattttattttttaattttattttattttggctccaggcactgcaggagtccaaaactgtgcggatagcaatactggaaaccctggggagatggtggtgagaaaactgcccagtgcctttgaggctgtacttgcaataaaagagggttttggtaagagttggtctgcaaaagaggaaggtggcaacacagaaagaaaggtactctggtgatgtcccccaggtgtgccatccacatcgtgcttttgcccttgggcttgtttgaatttcacaattatgtatttaattctcaaagtaatatgtatctgtagctggttgttgacactaataacatgattaaggaaaacagctgatctcttgggaaggggagctaccaatactttatacatacactatatatatatatatataatatgtgtatattatatatatattatttgctttacagggaaatttttcagggtttacaaaagaatatgtgattagtagtaacagaatgtttatgaagaaattgcattttcatttttctttacatttgaacttctttatagtttgactatagagtcttgagatggcacattcctacaattgaagaaggggtcttgggatcccctaaacttgcatacccggttttttgaatattgtaataaaaaaaagtattatgacaaggctgtgtgtttgtgttttgggagagctgactctcttctggggaaggaacagctataggagtcatgggaaattcccctccaaaggaagatgacgtgctggatcctgtgcctgctgttaacccagcatgagaacccgagttcggatacttggcacccacagaaaattgggcattggtcgtgtctaatcctagcactgaacacatccccaggcctgctgctgaggcattcgaatcagtccatgtgcactgggctcaaaagaacgatagtaagagtgaaagacacttggcctctggatgcatgtgaacgtgtgcacattcacacatcactggcacacaaatgagagctctcagaggaccttagcacactgatttctctacacctttttgtcttgtagtatgtatgaggcaggggcttgttgtttgtggaagtcacggaagttggttctccacttttatgtgggatctagggatcaaaccctggtcatcgggcttacaaagcaagccctttgcttgctgagccatctcagcagcccctgctgtccacattctgggttgaaatactcagccttgggtagcagaatgccaagagaacccaatacatcaaactagagtttgctctttggaaatgagtggtttaaaagtcgatagttaagccagagtcctctggctgtctccaaaaaccttgtggtgtcactcagtgttgactgttcagttatttaccttcccaaatgcaggaatgtgtcctatgtgctggcttcctgtcatgcgttacagctttgagaggtagccccgctgacatacccatttaaaagacaaaggcttaaaatcagtttgctggctactctggatgaacaggaacactggtacaggcctgtgccttagccccaaattgaacaacttgaaagtggctgatccctgtggttggctcccctgattatagggaaccggcctccattcagggagtgacacaggtcattttcctagacatctgttctcttcacctgcagagatgacagaagtcactatgaacggtcatgcctacctgctgggtgttatattttgaccttctgccagtatgtttctagtgagtgactgcttagccattcagggagaaagaagtcactaaagaactgaagatacacttttagaacttcggtcttgccacacactgccttgtaagagtcatctggctcaggggaaggtgtttcagatgctatgtcagtgctgttgtgtgtcacagggtctgctcaccattttcctggtttggtggactcctcattagtagactttttttttttttttttttggtatttcaagacagggtttctctgtacagccctggctgtcctggaactcactctgtagaccaggctggccttgaactcagaaatctgcctcccaagtgctggaattaaaggtgtgtgccaccactgcccggcctttctgagaagacctcactggaattgctgtagtgtgtgctcttggcctagatgtcttagaactcgtgtactctagagcctttgactcttaaagatggaagaattactccagccaactccaagagtccctctggctttaaaagtccagggccatgaggccccacagtacaataaatgaccacctcaccagagcttggtaaactatatcctgaaatattcttgaagcatttcagctttcacttttttttttttttgggggggggggtccctacctgaagatggaacaaatgttcagtagtggaaccagtgactaaaaatgaagactccatctccagattatgctcctgtcattctgaggatcctgccattgccctttttaagaacagttccttcaacttgggtttctggttcaccaccaggtttgcttcacaagggtgtcccagccactctaatcctaaggcaggaaacatctgtgggttttagttggggttggtgctgggattgcacacagggccttgaacatgccaagcatacagagcccatgagctagaccccctccaccaccattttggttctcgggggccataccaaggtcttttgtacaatgtgtacttgaccacagagcttcacctcatttctctaaagtcttagtttttgagacatgatcttgctctgtgttccaggctgaccttgtaatcctcctgcctcagcctcttaagtgctgccccccaggtgagtgtataattccacacccaacttcttttgcattttttacaagctcctaggagataccattataagtgggtcaaccttatatttgggttctgttgtagcctgcttgaagctttaggaagatcacttgttctcatgcacgcacacgcacacactggaatcactctcaacatatcttggacagcagatactttaaaccgtagcacaactcccagacagaagcctagccatacaaatgtactagttagttttatttcagcttgttataagctataatcatttgggaaggcagaacatcaattgagaaaacacctccaacagattggcctgtgggcattttcttgactgatgtggtagggcttagctcactggcagtgccatccgtaggctggtgatctgggtgctatttaaaaaaaaaaaaaaagaatgctgagcaaaccagtaagcagaattcctccttagcctctgcttcagttcctgaccccaggttcctgccttctgcacctaccccgactttcctacataatcaactacaactgttagatgaaataaaccctttcctctcccgttacttattgtcatggtgttttatcacagtataagaaatcccaagtaaaacaatacattctggagaaggctaccacttgacactaaatgggtgattcctgaagatagttgtgtctaatgatcctgacagcttttagaaacatagggactagagagatggatcgatggttaagagcacttattcttatagaggaccagggttcctctgtcacccacatggtagttcacagctatcagtaactcaattttcagagggtccaaggacctcttctgacaactgagggcactaggcacatggagcacattgcaagcataatacccagtttaaaacactcaaaaatttaaaatatttatccagctgccattattaaaaaaagaaaaggaaaagaagagtatctgaaatattttaaggagagttctgaatagaaaggtagtttccatgcttttttccccatccctgctgtaaacaaaatgagtgagagttgacctaaaacttcgagcatgctgactgtgatccaagtgaacaaagggtgtctctattcgtttgaaatagaattatgtcagagcaaatatttaaaagggtaaataaagaacaatgttctctcaaaagaaaacattagaataacagcagaataatcccatgagaatgtcaggatgccatcagtgtctccaataaaagcaacccagggtggttccatgactgcccatcacattttatgccattttatacacgttttttaaagaagtttatggaattgtaaaagttatcactgaaatcaaagtgttgtaatttacaaaattgattatatatttgtttacaaattaagatacattgctgatttgcttgttttgaggattgcttaccttccattaaaacagttctattggcaaaaaaaaaaaaagagagagagagagagataatgatggacggatggatggatggatggtggatagatggatgcatagatagatagatagatagatagatagatagatagatagatagatagatagatagaaagatagatagatgataggatgggtgaatggtaggttacctttcccagaggtaggcattagatgatcaaaatttgtaccccaaggcatgagccagagtaccagatcttgtcctcagactgctggtggataaagatatgagaccttacaggcttagttagtgacctgaggaagtcccaagtctgaagagccagtgaatttgtatgaagcacatacccttctctggtactaaaggacttgctcacttcagaatccatcaaggtataagcccaagttatgcccttacctgtggtgtagtttccagaaagttggcaaaccacctctgtgatctatagatcactggtgcagccctaaatacctcatggcatcagtttgatgacagccttatacatctgatgaggcgaactgctttgtatgctttctataatatgtacagggattagaaccattgttcagcttattaaatggttttaataaaaaaggaaaaataagtctgcatactaaattttacctaatttaaattgtaatgggtggcctgagatttcagaccacatgtgctagtgataatacagagtatgaaaataatttctccctggaactcccatctagtcacagatgccaaaagaatttatttctacaagtgctttggaattcccataaaaaagcagtggagtagtaatgaagtcatgacacagaagtaatgaaactaaagtatttgcctaaccagactctcagtgcccacatacgagccgtctaaatcactaatctcattgcagtgtgttgttgtgggtgtcatagtcagaagtacaacctttgccaagagcttttggagcttcactatacatggcctgcctgtgtgtgctgcatgtgcgtgaagttgtcactctacaaaatcttcaggcttgcttctcctcctcaaccccagatggagcttgtggcactgattacagagttatctagaaaccatgtctaagaaataagaagtggttttagtttacacttttgaatatcaaaccttataccatgactgaactattcaagcaaaaaatacatgaaagagctggtttcatttgtttttaaatgacatggaaccagataggttaaataactaaagatgctcttgtgctatagtggagaatcgtcacatctgcaccagacttggattacctggtggagttagaaaataattttatgtatagtcagaattttcacccaaacactagttaacacaattaccaatttgagactgaaatggcatctattaatagcaggttctatgttgtggagcactgaactcatgacccagatgatggagaaaagttagcagggccctgctaagcccgaaccggcttccttgttcttcttcctttccccgttggtgcttatcagtctctacagattggatcacatgtttgctacagtgattctcatttactctgtcaacacgtacagttggaatgaaattccacaaaggtggggccattgctgttgttgttaattgatgtcacctaaacagaaaatgttctgtgcgattgttaatattgttaaatgagttgataatggggaaaaaagaacagtgtactttaagaatcattgtgtctgagaaggtctgtattgctcttgagaaagaatgtcaccaccatggctcaagcagcatagttgaggtttgttttgtttgtttctaacaatttctagacaatgttctatattggttacttttctcattatgacaaaatacctacaaactcaatgtaacagggcttgaaagactgagtggataaagtactgcttgagcaaacatgagtaggggcattcatctccagcacccatgtaacatgctaactgcgggtaacttcagtgcaggggggaatagatacagacaggtagatcagtggcctgctggccaggaagtctttccaatggtgagctccaggtcttgtgagagaccctatctcagaaagtaaggctgagagccaaagacatgggcacctaatgccaacctctagtctctgtatgcacatgcatagatgcatttatgtacatgcacactcacacacacacacacacacacacacacacacacacacacacgtcaacttaaggaaagtgggtctattttgacttctactttgaaaggatagtatccatcatggtatggaagtcatagtggcaagaccatggatcacattatacacatagtcaggaataagagtttgatgctggtgtgcagctcactctcttgtattcagtctagggactcagctcaggagatggtgccacccacatgtaggctcagtcttcctcaacagttaagttgctcaagaaacaccctcaaagacacaccaaaaagagggtctttggagagatggctcagtggttaagagcaccaactgctcttctaaaggtcatgagttcaaatcccagcaaaccacatggtggctcacaaccatctataatgagacctgatgctctcttctggggtgtctgaagacaggtacagtgtacttatatataatagataaattaatttaaaaaaacaaataaattgtgcaagaacttgacaataaaaaatggcatgcctccccccaacccccaagctgggcagtggtggcacatgcctttaaaaaaaaaaaaaaaaaaaagagggtctttgtggtgattctaaaatccaatccggtggacggacgttctagatcaaatattacaacttatcaacttgatcctcggatacatcattttaaatcacaacatcccatcccaaacccctaagaccccatcttcatttcatgatatagaatacatgtattccatctctaaaagtccctgtagtccttaacagtcccaacacttttaaccatgaatccctataaaccaaactatatatttccaatataaaattgcacagactaagcatcctaattccaaattgggaaagtaataaagggaaaatatcacaccatgcatctagaatgtatgatgaaattatctgggccccaacagctttggacagcccttccttaaccagctcatccatgcattgcacatgtgacctctcttaggtgccttcccactgtgggcattcatgggtccagcttctataacatcctgctgtctccaaagtaacttagattacaactttctagctttatacaatggcttttcagagtcatctttaaaaagattccaaccctgccgtgtattcactagactcaacaacttccttgctgcaagcctccataagctctttctgctaagttctgccactccagacacagtttggctccctctatcacagctacaatgacctctggatcttggcagctgctcctgggaaaacacttccctaggccgttctccaggaaggaagcctttcactgatgtctcagttcagtccgccattctacaaatgaatttttacttttgaaagttggggccttgatggatgtatgttactcaaatttactttcaaaataaattgcatctacagcagacctactcttaagataacctattagctcattaaggcagaactggaatcatcaatttatgagggcagattaccccatgatccaaacactttcatgccatctctcaatagctttctatgggtattaagtttcacatgagttttggtagagggattcaaatacatagaacttatcattcatgactaaataatattttccacccctaggtttctgatcattaaggctccatggatatgataacaattatcttctcaggaaagcaacctgattattcttgaattcttcttcaatgttgtcctaaatgttcttaacccccaccaaatggattactatgcattaaaaccagagtcctctccctcctcttcatgttactatggagtcatgactttctcattctttctcagacagaatgtcctcagtgagtggcagcagtctccaaggaaggcttttcttgggtgaagcatgtttctgggagtcatctggaggagctagcatgggcaggatgtgtctttgtcaacctgggctcttgtgaggatacttcatcagggtcatagtctagactgacataaagaccgcacaagtaaacatctccaagttcgcaggccagactcctcactccaggagaatatggtgagcaggccagaatgcgaagcagtaacacactgacctccataggctgaggcctctctcctgacagatcctgaccattatcagatatgtaatttctgggttctctttctgatacccagtacttgacatcaccttgctcacatggtaatgtttgatcgccatctgactttgttggactctctccagtccctgaacttccttagtggaggcttcataacttcccagcagaacctgtgagttcccttctttttttattagatattttctttatttacatttctaatgttatcccctttcctggtttcccctccgaaaaccccctatcccgtctcccttaccctgcttactaacccacccactcctgcttccctgtcctggaattaccctacactggggcatcgagccttttcaggaccaagggcctctcctctcattgacatccaaccattgacattcaacaaggccatcctctgctacatatgcagctggagccataggtccctccatgtatactctttggttgatggtttagtccctgggagctctggggttactggttggttcatattgtttctcctatggggctgcaagctccttcagctccttcagctccttcagttccttcagctccttcaggtctttctctagctcttccattagggaccttgtgctcagcccaatggttggctgagagcttccacctctgtatttgtcaggctctggcagagcgtctcaggagacagctatatcaggctcctgacagcaagaacttgttggcatccacaatagtgtctgggtttggtgactgtatatgggatggatccccaggtgtggcagtctctggatggtctttccttcagtctctgctccacactttgtctctgtatcttctcccatgggtattttgttccccatcttaaaagtaacgaagtatccacactttggtcttccttcttcttgagcttcatttggtctgtgaattatatcttgggtattccgagcttctgggctaatatccatttatcagtaagtgtataccatgtgtgttcttttgtgattgggttacctcactcaggataatattttctagttcc

SEQ ID NO: 140 - DNA, 1380 bp, Mus musculus
ctcagacagcagaaaacctcatctttttgaagagtgctacaatttttccagtcacctcttgtaactgcgtgccaaagaaggactccatgaaagatgacagaagaagtcattgtcatagccaagtgggactacactgcccagcaggaccaggagctcgacatcaggaagaacgagcggttgtggctgctagatgactccaagacgtggtggcgggtgaggaatgctgccaacaggacaggctacgtgccttccaactatgtggagcgtaagaacagcctgaagaagggctccctggtgaagaacctcaaggacacactaggcctcggaaagacgcgcaggaagccaagcgctcgggatgcttccccaacgccaagcactgatgcggagtacccagccaatggcagcggtgctgaccgcatctatgacctcaacatcccagcctttgtcaagttcgcctacgtagcagaacgagaggatgagctgtccctggtgaagggctcccgtgtcacagttatggagaaatgcagtgatggctggtggcgtggcagcttcaacgggcagatcggctggttcccctccaactacgttttggaggaagcggacgaagctgcggctgaggcccccagcttcctgagcctacgtcggggcactgcactgagcaatgggcagggtgcacgggtgctgcacgtggtgcagacgctgtaccccttcagctcggtcactgaggaggagcttagtttcgagaagggggagaccatggaggtgattgagaagccggagaatgaccctgaatggtggaaatgcaaaaatgcccgaggccaagtgggcctggtccccaaaaactacgtggttgttctcagtgatgggcctgctctgcaccccgctcacaccccccagatcagctacaccgggccttcagccagcgggcgctttgctggtcgggagtggtactatggcaacgtgacacggcaccaggccgagtgtgcgctcaatgagcggggcgtcgagggcgacttcctcattagggacagcgagtcctcgcccagtgacttctccgtgtctctcaaagcgtcagggagaaacaagcacttcaaggtgcagctggtggacagcgtctactgcattgggcagcggcggttccacagcatggacgagcttgtggagcactacaagaaggcccccatcttcaccagcgagcacggggagaagctctaccttgtccgagccctacagtgaaagcagccattggccccctcatgccctgcccactgtgggcctcgctgccacctctgcctcccagagcccagcacttctggccacctccacccatgtggcttggatcacctctgtggcccagtctgtccttcttttcagccctgt

SEQ ID NO: 141 - protein, 381 aa, Mus musculus
KMTEEVIVIAKWDYTAQQDQELDIRKNERLWLLDDSKTWWRVRNAANRTGYVPSNYVERKNSLKKGSLVKNLKDTLGLGKTRRKPSARDASPTPSTDAEYPANGSGADRIYDLNIPAFVKFAYVAEREDELSLVKGSRVTVMEKCSDGWWRGSFNGQIGWFPSNYVLEEADEAAAEAPSFLSLRRGTALSNGQGARVLHVVQTLYPFSSVTEEELSFEKGETMEVIEKPENDPEWWKCKNARGQVGLVPKNYVVVLSDGPALHPAHTPQISYTGPSASGRFAGREWYYGNVTRHQAECALNERGVEGDFLIRDSESSPSDFSVSLKASGRNKHFKVQLVDSVYCIGQRRFHSMDELVEHYKKAPIFTSEHGEKLYLVRALQ

SEQ ID NO: 142 - DNA, 168276 bp, Homo sapiens
  misc_feature (1)...(168276): n = A,T,C or G
gagttatctctttcctttctgttttgcatgcatccttaatcactgtggctcattttcttttggttattaaaatgtattttaggtctcttaacctacaggttcaatgtccacctttgtttagttttcttagcaacattggtggaagaagccagatcttttgtccttcagaataccacagtctggattttgctgattgcattcccagtatagttggacgtgttctctgtcccctgtgtttcctgtaattttgtggttggatccaaaatatcttcttaatgcctcacttccttgttcaagaaaccaccagcctccctaaactcctcttgcctcttaggtggtgtattagtttgttttcacactgctatacaggactacctgagactgggtaatttataaagaaaagaggtttaattgacttacagttccacttggctggagaggctgcaggaaacttacaatcatggcagaaggcaaagcagaagcaaggcacatcttgcatggcagcaggagagagagggaaactgccgcacacttttaaatcatcagatctcgtgagaactcactatcatgagaacagcatggggagaaccacccccatgatccaatcacctcccaccaggtccctcccccaacacacgggaattacaattagagatgagatttgggtggggacacagaaccaaaccatatcagctggggtgtgtgacgcataaatggaggtgggcaaaataaatgccccacctcctctaacccacaatggtcatctgggccagggcctccagaaagcactcacaggaggattgacgtgtcctcattctcttgtatacagcaggcttatttcctcctcaaattctctcttccagtggttccagaggccagaagctctccctttccttctcatcttctcagtggcatcctggttctgcccatgccctccataaaggatttaaagtctgtccatgaataatgctccagaatcatgacccctcaaagatgcccctgcccacaaccccggagcctgtgaatgttcccttccatggcaatgggactttgtagaggctacaaactttgagatggagagacagccctggattgtccagatgccatcacaagtcctaaagggagggtgactttccgggctgcagtgagagagactcagaaatggaagcaggatcagaaaagacgcatcgctgctagctttgaaggtggaggaaaaggccgtcgcagaaggagtgtgtgtgacctccagaggctggaaaaggcaaggaaatgaatggtcccctagagcatcccaaaggtaacacagccccactgccaccttgattttagcccagagagacctgggttgaatttctgactcacagaactgaaggatcataactgtgatgtttaaggccccaactttgtggtggcttgctacgacagtcataggaaacaataccccatccagtgtggctctgagtgctggccttcaggaggggtcacttctccagagtccctgcaggtaaaggtgtcagtcctctctaacacctccctatgccctgaggcccctggcccaatgcagacatgggaagtgtctgataaaactagagtaaaatgggtgaaatcagtaactgttaagaattctcaacatgaaagtgatttaataggatattaaaataagtgcaatttattgatcatggttgcacttctcagatactttgtaaatcaatattagatatttgtaggagacatcatgagaaagaaatcacagccatttgtttgctttgtgaccttagacaggttttttaaagcttttcaacctcagtttccttatctataaaatggggaccttcatgcctccctcactggggttgtcaggattagatagtgtgcttggccagtggtaagaatgcaacagatgatagctattaacaactattgtgttaataataaaaacttacaatgatatgtagctaaacccatttgcattttaaaaatgttatttgtaaatagtatatttttatcccacgcctttccttcaagaatcatcattaactgccaactttgtatgaggtgtcagtgagatactctggggaagtcaaagaaataattttggtggttcatgcctataatataatcctagcactttgggaggccgaggcgggcagatcacttgaggtcaggagtttgagaccaccctggccaacatggtgaaaccccatctctaccaaaaatacaaaaattagccgggcatggtggcatgtgcctgtagtcccagctactcaggaggctgaggcaggagaatcacttgaacccaggaggtggagtttgcagtgagccgagatcatgccattgcactccaacctgggcaacagagtgaaactccatctccaagaaaaaaataataataataataattttgtcctgaatcagtttatgatcttaaaatatcatatggacataaattactagaaaacaaggcatttttggctatacgccccggcagagtttcggagaatgagaggaactccaaggaaagagagcttatagcatcatggatgggagggaaggcaatgcagaccacagacaggaagctacacgggattattcctcaatgcagcctactctccgctggatttgcattgaattcacaggagaaagccatccagtgcactgcagagtgaaaaagagattatgttacagtgtctctaaaacatatcttcctattaacctatttgttctttagtgaagactgtgattttaaaaaaagcaacatcccacttaccagtactctagttgagaattgctttatattttagaagtcttccctttcattttttttttaattttatttttgagatgaagtctcactttgtcgcccaggatggaatgcagtggcaggacctcggctcactgcaacctccgccacctcctggattcaagtgattctcctgcctcagcctcccgagtggctgggatgacaggcacgtgccaccatgcctggctaagttttgtatttttagtaaagatggggtttcaccatgttggccaggctggtcttgaacccctgacctcaagtgatccacccacctcggcctcccaaagtgttgagattacaggcatgagccaccgctcctgctagaagtcttcccttttaaaacatgcaagtaagcactgaatgactaggctgtaagtaactggagccctcactcaatggcaatctcctgctcagcactttactttcagaaaaaggtagcaaatgcaggaaaacaagcaaattttattaactttttaaaaagtaatttgagcatggctctgacttagtacagattcttccactcaatcttctacacacttaacactataaaatgaggatgcatgttcagaatgatgactcagagacattatgaggcaccccacatcaaaaagggactcatttcatttactgtactgtgctttccaaggtgagatatctgcctacaatatacgtacatatatttttaatttcaatttatgttccagctgaagggaatttctggttgatctttaaccaacacgaaaatttaatttagcaaaacaactccttcctgaggcattctgattaattgagggttattgtagctaacataaatgtctcatccatgatgttcacctaaggtggatttcaaaatggcaatttgcgtaaaattttagcttttctaaaggtacagagctctcttaaaattgttcctatctgaaactaactctgccctgctgctaacaatcaaaaacaatgtaaaattgtgatcatttttatttttcggctcaagcacctgttaaattttaaagttatgatgtgtaacgttgatcaccacaggaagtgtttgacaaaacacatactgaaaaacaggtcggtgtttaagtgcacttccgttccttttttttttgataccctaacttacattcaactttatagtgttacttcatctgtttttcctttatttacacaattagataaagcatagttacttcctgaagtccagatcacaattcttagagagaggcaggagaatcgtattgatcatccatagaggacagcccacttttttggggggtgtttatgaactttaactctttgtagtggtggtttgtaaaaagttaatcctgccagtcactgagagatgggtttcatgtgtttctaagctgccccttcttgggtctgaagaggtagtgaaaaggtactttgtagtttgggtatgaaatcaccgtgccgtcttaagactcgtctcttccccatgttttcatgtaggtgaaatgaaatgcaaaaatctatacgtccaccggtatctgttttgagattctcatagcgagttcctaatggcctctttttaagtctcttcactaatgctctctgtcctctttgacacactcgtaagtgtggaatttccatccatcgtgaaagatttgcaaagtgtctgttctgtactgggtaggccggagaatggtcggggctgtacaggaaaaccaggcttggctcctgccctcagggcgttcatatcaacgctgagatgaatgatacaattaaagagcaataggctcattactccagcagggtatttatagtagtaatagcaacttttctagcacagaggcacgtgagggcaggaactgtggcttgctcatttgtgtacctcctgcagtgccctctccatgtagtaagttggcaataactattcattacatttaacaaatgtacaaaaacaaaaccgttcatccctcacaagccagtcctccccacttttctgtttctgatctcggcaccgttgtctttgcagtttcccacatccaaagcctcaggttatatttgtgccccattctctttctctttggtcccccacatccaagcagctgccaattcattttgagcctccccttccatttctcctaaaacactttcccatctactcattccaccccagttggggttatgaactctcttggaaatgcgaacttttgtctgctcttcctgtctccagctgtccttccgtgcatgcaccaaatgagtgttcctgggctgagcccagatgatgtccacacttaactgctttccttcttggcctcgcgatccgctctgtgcagcctctgctccatttaggcaagtgggccattctctgtccctacagggtcctcccacgtccccctgtctgcctcagagttctgaactcctgccgctgggaattttctccctgtctatctccacctttcaaaatcctaccatttgcattattcaggggtttgggttccaaaaagaggaagtgcctctgggtaccttaagcagaataggagaatttactagaagaatatcaagtagctcacaggggaactggagagcagaaggggtgagaatggagctggctaattcctgtgggagggatgtgctgggactatttcagccatggcaaattgaatctcaccctctcttgtccttttcaccctctccagtttcacagtcttgagtgggagggttccattggccaatcccaggctgttcactctcacagggcttctgggaatggagggaccaaggtgcctactctgcctccctccagggttcagacaggcttctctaaaaccaggaaggggctagagaggggggcagccaaattaaaggcagcttcccaccatgtaatctctcaaggtcattgccaatgccaccacctttcataaagcctaaagcttctcctgattctctagacatattttctttggtactgttcatatttagttttatattatagttatttgtatgctggtttcatccttccttttgggtctttcctctccatttctcctaaactattttcccatcctttcactccactccagtttgcgttataacctctctgaataatgcaatcttatatctgctctttgcacatccaggtgttctttggtgtctgcaccaaatgaatgaatcctgaagtggatcttataatgccttacaaatagaactacaccagatatgcttaattgaattgagggttacaagagaaggtcatgagaaaggagacatgagtgtttaccatgtgctgaacacacagttgagacatgtttatattatctcctttaattctcacaacgctttgcaagagcactattaatatctgaggctcagagaggtgaaatgaccccaaggcacaggctccaaggtaggctttgagcctctgacgtatgacttggacaacaccctcaaccttgctttgtgttttccgtgagtctaaggaggggttagagaaggccttgaatggagctctgaaagagaaggacggggacagggaattcctagctgccttcacaccacagaaggctgaaactagtgtgactcaatgtggcactgtgggcagagctgagtgactgaagcaaacagcttatactggacagaggtaaaaaggagattgtatggcagggctaagttggagaggcctttggaagagagatcataagatgtaatgctgatgtgattttaggcaaaagtttactgcacctccttccactccatgttttttatgctttcaatactttgtgattgaagacagtaaaacagatgtggacacattaatggagtagaatgcagaaaaacctatatatttttagataaaacataagcttcaaagaaatgtctcccccatgttaagccttgcagtgggttggatgttggccccaaaagatatgttcacctggaagccgagaacgcgaccttatttggaaaaaaggtctttgcagatgttgtaagataaggatgtcgagatgacatcatgctggattagagtgagccctaaattcaatgatacttgtctttacaaaaagagagaagggaaaggacacagggaaccaggttgtgtgaagacagagaggcagaggtgggagtgacactgccacaagccaaggaatgtctgcagccaccagaagctggaagaggcagggaaggattgttctctacagactttggagagaggctggtgtcttgatatcagacttctgaactccagaactttgagaaaataacctctgttttgtcacctagtttggggtcatttgttaaggcagccccaggaaacgaacacaggcctctaagggctaaataccccagcctctctgggggaaaatgctcagtcttcagtcatcagataacttttgaggagactgtggtgggcaatggggagccatgagaagttcttgagcacaaccagggacaaatggaaacaatttacaggaaggttaggatgacattgatgtccagtgtgagtctgagggatttaagaaggaagtaatgggagaccagttggaaggcagtagttgtggggaattgaacaagagttttggagtcaggtacatgctctgaccccagttctttgatccactgttcaagtgatttcatctgtaaaatggggataatactattgtgtgtggattagagatgatatatgtcaagaattcaatcaaggtacattataactattgctagaatgatgtataagttaggatgccagtgatggaaatggaaagaaaggtgcagtggaaaagatgtttaagaatcaccaggactcagaaccatgggggtagtctgcaaggggtcttggtgtcattcagcgctctcccagcttttcttggggagaactcggagagagggaaggaaaagccaagataacaatgagatttctcccaggagctgaggtgcctggtagactcttggccaggcctgaaaccatgggaggaggagctggtctggggagcagatgagtttcattttgaacatggtgacctagaagagatgctgcgccatgtttagggggtgcagattagctggggagctctgcagattagcaggggagctctctaaggctacaggtctgggggttaatcaatgaaggtttagacagggagtgtacaaaaaacaatcaactctctctttaaaaaaaaaaggtgcgtatcagaataaaaacaaagggccaccatctgccttggggatatcacttttacagggtgggaagacaacaacctctctagaggaggcagatgggcaggtcagaaaggtaagagaatcagaactggctgtgtttgatgaatgaaaagatgatggtgtttcaggaaatagcagaaatgccacatatttcagaaaactccacaggataaagattgataaagggccactggatttagatagagaatgacatcggtgacttctaaagaatcagagaaagaagaggcatgcaagaaccacgattcagtgaaagtttacaaagcaaacaagctacaaactgggtcaatattgctatacttattttgagtaaattaatctaaaattgggcagactgatgactagaattcttcttttcttattgtaaagctagatattagtaacacaaaacttgcacaaaaggatgaactgaagtagcttctttcacaaggtcaaaacaaggaaaaatgaggctgttctgattccctgagcttgtacctgattcctgctcagtgtactgtgcttccttccacttactgagctattgagggctacctactgccagggtacttcacataggaggtaagtaaatattatctccccatatgacagattttagaaaggctgaggaccacctgtgcaacgttacacagttcaggaagtcaacagtcaaacactcacctgtctgacttcaaagctacgctgactctagttacctatccttgggtacttcccttctggaaggaagcaggagatgagtgaatcaaataatacagccttgtaaccttgggtaaattattattgccttaatagtaagcagagaccaggagcctaagaaagaatctcattaacatggatgcaggctatcctgccaggaaatcagaatcatttgaatattaggatttcctttgggaaaccatatggggaggagaaaagacatccggatgcatgtgtctgtgaaagggaaacttgtgtctttccccttgctcttgggttttcatcttccaagtttgtttataggctagccacaactcgaggctgggtgagctgaacggtcccatcattagcgacactccttctaggggcacattcgggcagctcctcttcgggttctgcccccacgggtgtgcaaccaggattccacaggctggggctggcctggatgcctgggaggcaacagaggtcgagtttcttcttcttttaggaagtgcctcggacagggatgatggactaaaaatgtgtctggttgggaaagtaaatagatgcaaagcaaataaataaaaatgcccacaagcaattacagggaggaagtgacatttttatttaagtcacttttctgatggacaacaggcctgcttagctgagtgccgtgggaatgcttccgggaggggggcggctgcccagcaactagagcttcgtgataagaacaacgaacaaacaaaaaagaggacgcaaagcccacccggcagtcatcccaggctggaagttgccgtctgtgttttcactctcctccccacccacctaccctgccccccaccgcccgcacgcaatttcgggcgtggggaccctttcctgcccccggcgcccggcccgtgctgcgcctccagagcggagcgtcccgcagccccgcgctatcccggcgcccgtaccgggacccgggcgcggagcctggcgacgacggggggcgccccaggtgggtctcgggtccccgccccgcgcgcccgggcctgggccggcccctgggcggcgtcacggcgcggccggggaggagcgcgggaggaggaggaagagcgcggaggaggcgggcgctgcgcgccgggggagggtcgccgccgccgccgccgccgccgccgccgctgccgcggggatcgtcaggccggagccgcgcggccgagcgggcggcgggcggaggggagggcttggcggccgggaggctcgcggcgcccgggccggcagggtccgcccgggccggcagcgtccgcccggcggcgggaggagggagcggcgcagacaaagagcggcgcctgggcgggcgcagcgcggccaccgccccgggacccgcgccgctgccctccggctccgcgggcggcccacggcgaggtaagcgcggctaggcgggcgtggggcgggggccacaaacttggggccgttgggcggagttgggagcgcggcggggctcgcgggccggggtgcgcccgggaaggggccaggagagcgggtcccctccgcgcccctccggtgctctcggccctgccgcggcctgggcgcccccgaccgcggactgccgggcacctcccggctctgcaccttcctgcccgccttcccatccctaacccccaccatcgggggccggcccaggggcggggacgccagccaagggcgcgggcgaggatcagggcagggggcccggctgcggggcccggggactggagacccccgggtgcgcaggctgcgcctggcctgcaggcgggcggccggcacggagctcggggctagcgtgggaccgtgcggtggccagggtcgccagggcgcgtgtgccggggaagaatagccgcggatcgcagggccccggcgcagggacgggggaggccgcgatcggccgggagaacttaaccgtgtttattacaactatttatgttcgcgcacaaagctgctgtcacattgcataaaggaggtcctcgcttcggcgaagggagcttttgtgcccggcttcaggctctgcgccctgccccagatttacaggactctaacagccacctgaatgaaccaaagtttctcacaatcgctcggctctctcggtttttttcagggcgatttaatcaccgagtgcttttggaaaaatttgatatgtgagttttaaggcatggagggtaactgccttatgagcacagttagcttggcattgtgtggaggggtttaatttgcaaaacgctttaatttgtagacaatggggatctctgtgaaggtctgcggtggatgctaggggtcattggctggtggaccccaggcacctgacttaaactagtattgtaacagcttcagggacaaagccgagcgtgcgtggagtcggccttggccacttcacacaattcaggttggcagattcctctttatttggctttgtttattttgccaacaggtttaaggctgcttctgccaagtttgcatctgcataatgggatgagcaggccccagtgtgggcaggagggggcctaaaatatcgcacgggccagctccgtccctcgacccagaaagaaacaaccctgagaggccggtgggcgtggcttgctgggacctacaggtaggggagtcccttcctggcccaggcgcagtccccgcttctcggaagggattttgtgtaggaatgaaagtgattcagggtgtttttcatgcctctgttttagatgtagttatcaagtctcaaaagtgactgaaaatgaaattaacctgggccgctttaacttaccaaaacggaactgtgcgtgtgaacactccctcaattcactttgcaagcttcatagataagcaggtgaattagtaacaggattcaagccttgcgagttttacgtaaagagaatggcagtcatcggacacgtggagaagaaattgacttcacctggagattgggctagacatggaggttttttgacgtttggaacaggggtttcctgagaagcaagtgttaacctgcttgtgaagaagtgaacacgagggaaaatcctacctcagtatattctgccctggaggttggttagatgtagttttgattggagaaggtggcggaatcttagtggtcttctggcggctacttgaggctgaaatggagaactttaggcataggaagctgtggaggtgcctggcccacttcctgtcccggaggcctcgcctggattctgagcttctttcctgcttcataaacattcaggggggttggtcatgaaacactggatgaaattgggtcacaaattgccatcaggaagagttggctgctgcataaccccctctgtccacttgtggagaaactgaccctgttaaccgtcgggcttgctgaaggtgccttgcaggtggctgtgctcagttttcatgctttgtgttttgcttaggacacgctgcatacttaaatcttcttcatccttgctctgtttgaccctgccatattcccaggctttgtcatttacattttcggttatttagcttttccaacaaacagcagatcttatgtacacagtactatatttgagaaatgcactaccatccatattaaatacaccggaaatcttccttgcatgtgcacagactggataaccttttaaaataccctaagactcccggaatggcgcagaatgcactggagtcctttacttgatcagttgcactagcttagtttgccctggatagaccaggctgcgaggctctatgggacacccatttttctaactgctcaaactggcttgccgtgtgcactgggggagacagggcttgcggaaatcattctctgacattaaaaatgaggcttaaagactgaagagctcagaattgcttgctggaactacaggggaggatgatgagtgatgtttggaaaaacaagtaagctaacttttttcacaaatgaactggaaactccctacagctcacttcagatgcttaggaaattagttttcccatccagagggtttgcgagtggcacttccaaatggtttctgtttcctaaaatgagtgatggaaatacttcacggcacgttttcaaagggcctaagctaaaatgtgatttcgtgtatcttgttccatgcctgagttaaggcaactcagaagaaggtcgtgacggccttttaacgggctatcaaaagtgtgcagctaaagcaaaaacagttttgcatttctttaggccatttagtagcacaattaaaaaattagactcttttcttttcctgcattttcctttgaacatttcccaaagtatgtttatttctaaaggtaaatgaacgttagcaagtattacctctgcccagtgacacacatccacatgtgtactggcacatacattcctacctcaagaatcttagtccttgaaactgtggaaatgaaagttattttgattgaggtagcagtgtcacagtgatgtcatacggtgtcactgtccctgaccagcctctgtgttccctctcaactccttggctcagtctcctccgtgtcctgagttcttactcatcccaagggtcgtctcttacttcttttcttccccacatcttatcaactccaaactagaggggatggcatcatctttaaacttccacagcactttctttgtgtccctgatttgtcatctgtgacattctttcctgcagttgttttttttctttttttaaggcagggtttcaccctgtcacccaggctggagtacagtagcatgatcacagctcactgcatcctcgagcttctgggttcaggcaatcttcccacctcaggcaatcttcccacctcagcctccgagtagctgggactacgggtgtgcaccaccatgctcagtgaatttttttatttttatttttatttttattttgtagagacagggtcttgctgctttgccaaggctggtctcaaactcctgggctcaagtgagcctcctgccttgacctccaaaagtactgggattacaggccagagccaccataccctgccctatggtttttttgccttcatcttttctttactagattctgaaccgcttgggggcagactggtcttgccacttatacacaatgagtgtgcaacaaatacttattgaatatgtgaataatgagtgcccagcctgttaatattggggctctagcctcccactgagattcaagtggtaagagacctccagcattcttgtaaatctcagaacttctgtctactgtggaaggctttgacctcaggatgtccagacaatgggagaatttggtctgttggcctctctatttggcaaattttctgtcatgtgagtcatttgtagtcctgaagctacatttaaaaacaacaacagcaacaacaacaacaaaaaaacaaagccaaccccatactcaactgtattacctggtgggctggctgaatggtttacttttgtaggttagtctgttcctatcaacctgaattcaaaacgctgggcagaccgtttgtgatcctggcctggtaagttagttatttgtgtcaccccttctttctactgttgtattggtaatgtttttaagagaagaagcttcaagtgcactcagaattttaagtattgcagttgcttcttttgagacaattttggaagctggggtgcttacgttgccaaattgttagtgaagaccgaaaatgccatgatgagagaatgacatgtactaatgcatgcacgctcattcattgtttgcaaagtcctcttcacatacaccatcatatttaatagtcgaataacatggtgcacttggttctggccctcatttctaggtaggagactggggatgacagagcttgaatttaggttaagtccttctgcaggccacacatgaggaacaccaacgtgttgctgggtagagttgtttttttgtgaggcagtttacagaacacagtgtccttgggtatctgcctttgccgtgtcgcagctgtgtgtagatattggtggagcagattctggatgtgagttgactgaggttgagcggtgtgaggggaggccggcaggagcaatgtcagtctctcttgtccccacatcctgattatgggccagggttaccctggaaagcctcctcaagttcagaaagcttattcctgtttagtgcgtgtattagtcagctccagctgccttaagagaataacacacagaggccgggcgcagtggctcacggctgtaatcccagctactcgggaggctgagtcacgcgaattgcttgaacccaggaggcggaggttgcagtgagccaagatcacaccactgcactcctgggtgacagcgtgagaccctgtctcaaaagcaaacaaacacacacacacacacacacacacacacacacaaaacaacaacaacagaatgggtggctaaagctgcagacatttattttctcacagttctggaggctggaagtccatgaccccggggccggcagggctggtttctggtgagtgtctcttcctggctcgtcttcttgtgtcctcactcacgtagccttccttctgtgagtgcactgagagagaggtctggtgtttcttcctcttataagaacatctgtcctgttggatgagggccccacccttatggtgaccttttttaaccttatttatgaccttttttaaccttaattgcctcctgaagcgtcctgtctccaaatatagtcacttaggggttagggctttaccatatgaatttagggtggacaattcagccactcccagtgtgtctgtctaggttccacaacagggctgatgcttttaggaagacctggtgctcccatcatccagatctgggatctctgtttatttggggacacctaccagggatggttagagtagtcacaagtaaggagggaacgtcagctctttatatattggttgtagcaccccataacagggaacaagccttggtgctggccttccaaaggctggaaaggttttaagtagagtgattgaagagagagaaaaatcttgacttgatttcatttatggaaacttctcttcaacttaggtaggtagacacttatttgggggttggtttgtctttaattgagaccatgataaaatatcagtgatatgcaaaggaaagttttttctgaaccctggatgaagagagcaaagcaagaggtggggccaatggcagccagggtggagaggccgtctcctctgagcctgccatctctgtgatcgtgcagtctttgccacatgagcaaacatcccttagcagaatgtgcatgacggtggtgaggtgcaccctgagcgtggctggaatgtttctgacctaggccattttgccttgttcagacataaggcaggggcaatgcctgcatgactgacctccctctagctccagatctgtatgttcattgatgctttgttcgctcattcattcacattcatatgaattatccaagttcttagtggtcatttccaccatcccaaaccatttgcagcttctcctgcaacctgcccgccttctcagttatattccccatcacccactcactcggttatccttgaattctccctcagctcccaactagttatcaacccctattgattctacctccaaaagatctaacatctcagccctgctgtcctttttctgtttcccctggacatcaaaaccactttttaaccattcctgccaatccatcccagggtgactgcaccctgacagtcaggtctggccatgacctgcacacggtggctctccatcgtacttgggtcagtgactcaagtccccagcatggcagtcatgggcttgcacgactgggctgcctctctgtttctcccagcatctaaatatccccttccccatatacacacatgctgagctacaagtcatctgtggccacccactgatggtttgctaattgtgataacaaaactaagtttataatcagtttgtttttaaagactctctccactgggactggttcagggttctcctgtgcagtaatggcagggctaccccactacagctttgcatggaactgagcatgggcccagctctctgtcatgggaggagaagagactaactgcagaaaatggtgcgtatgtgtgttttaatatggactgtctccctgcaaatgccatttgaactgatggattgtcaagagcagtgctgaccccttgaaatacaatgtgaaccacaaatgcaagccccagatgtaatcataatgttctggtagccacattaaaaatgtaaaaccaaacaagtattattaattttcatcctatattttgcccaatatatatataaactctatgtgtaatcaacataaaatgtaattaataagataactcatattcttttatttgcgtgagggctttgaaattcagcatatagtatatacgtttactgcacctcttggctgcctctcgctgcattttgattggccttggccacacgcgactagtggcagccttgttgcggagtgtgagtctatacacttttcatgatttaagcctcatttgctgtctgttttccaaagttgagatagctaaagagacaaagtggaaacaatgtagaataattataatggtcattattattatgctttactgggaaaggtgtaacctttttaaatatgaggagtaatgtcatccttcagacactcagcacatgatgttttagagcactaaaatcagattcagttaaaactaatatctatcatcaaaataccttgttcattttacaaatatcttaaaatgtggtttgaattctagaagttaccagtgtaaaataacatttttgtatatcagtattcaacacatttccttttaaaaaatgtgttcagcaccataggaaaggtaaaaaacaacattgtatacagtgatggggtacaggtgttattttgttacataaattgcctaagggtgaattcaggacctttattgtatccatcactcaaataacatacattgtacccattgagtaatctctcatcatccaccccttcctaccccatcacccttcaagtctctggttccgtctggataatggcctccagttccatctgtgttgctgcaaaagatatgatttcattgtttttttatggctgaatagtctattttctttatccagtcatctgtagtattcatatttctgataacatgttaagtacaagctaaaatcatgtatttttaaagtgaacattagcttctctcccacacggacacagacacacacacacacattgtaatcactgttctaagcactttccatgtaataactcattgagtcctcaccaacagaacgtgtggtactttctgtttgtatcttcatcgctaaggaaagggaggcactgaggctgccatgtcttaggttccacagctagactctgaccaagctagccaccatcccttcattaagatgtatctgaaaatacataaaacagaactgtaaacttttattatggtgtaagatttgagaaacattgatggaaaatcattgatagggagtgtagcttgcatacaggttcattctgggaacgccttatcagccaagtggttggggaaggccctggactttggaagggcctaatgaataactggtaccttggaggaggggaagccttggatggtcatcactgaggaccattggcctggctgctcctctcccccagcccccttgctatgttccgtaggctggtggtcctccacctgcccaagtctccaattctgcaggaaacaccagcattccctggggagaaccgctgctggagggaactgcagtggcactggatgagggggagtattttctgttgtagtcacagtgtattagctcaagtggtcatgcaggtgccattgtaaatgcctgtgtgatgtgcctcttcatcagtagctgtgtggtgggtccccacccttgtctcctccacactgggggctgagaaaacaggagtgtgtgtcttctcactcttccaagtggcccccggacttttgtgctgttggaatagcttgcacaaggccatttttgctgcttctgtttttccttaatgagttgctgttgttgaagtgaaggtaggcaggtaggttcttgctgaaaaccttgtagcaggacataccaaatccttttcctttgtgcttttatgacatctgggaaggtcttgaagaattccaaggtggctttgaaatctgcttctgaggttgtgagagaggccaggtcaagtccaaatgtagattcttgggagactgctgctacaggtcctgatgggaactctgacactggctgctcttccaagtgagttgtctgtgccagcttctcgaacctacccttttgtgttaggagggccactggggccatcagagtgttgagcagccctccctggagcagatgggactgagataggacggtgagtctggcgtctctgttgggagaagctcctgcatgttccaagtttcagaggggctgcaatttgggcagtttctttcaactcacaggtttagatttgcagtcacactacctctcatgtggccacttctacacgtagcaggttccaggatatgtggtggcaaagaattgtttacttcaacatgcttaatttcccagcaatggtgggggcagccaggaagtgagaagtgaaaagtaagttagaaagtggtgagatcacagggagatgcctagaaagacgcccatgcccatcttagaggacaaagtccatcaatgtctccttcgattttccttaacggttatgtctcccatttaatatcttaagaattttggttgcgtgtttaaggatgtctgcaagtcaacaaatattttaattatgtcacttatgagcctggctacaggagaggagagcagttgctgtctctttcatgctttgcctctcatcagctgtcttcattttaaggacaatcactttaaaagcttgtattcctgtttgtgtgtgtctgtgggaggttggggggagctgctgcattggtaagaaagcagctcccccaacaactttttttttttttttttaaactgctctgcatgatggaagccagcttggagacattgacataaaaagcacaagctacttgaatatttttaagagaccaagaaataacaagggattcagggagttattttgagacagtttttgggaaatttaatataggtgaagagtgaattttcatcaaacgattaaaaaaaagtgaaacaaccttggttgcagaatctagcaagatggttatagaaacagattttttttttccagccatttccattctttctttccattcttctggttctcccctcacttttttgtgtgtgactcccctcaccccgtctctcccgccctgaacaccatttatcttaatagtgtgtgtgtttcccatctgtctttgttactgccctcatatgacttttcttttatgtgcttctgttattgtcttcttaggagcttcctagcttggatttagaaggttctcttcccttaaattaagccatctgtcttgcttcagttcccttttcgtagtttccttactaggtctattttacatggttcggtagacaagacccagcggtaactgtgaagaaatggtggcattatcatcttttttaaaaaaggaggagggtgtcagacatcgtgctgttgtgattttcattttgaagctttgctgggtagaactaaagttcagttgattgatcacctatagattaggtgtctagtgttgaatttgttgcttcttaacttgattgtgccgagcacctcatccctcagccatcccagtgggtgcagccgattccgtcttccataagaagtaggttctcctttcatgagtgcctccggttggtgagggttccatgtgtaaggaagaaaatatgttttcaacacattgcacgttcatgcgtgtggcttctcattcattttagatcgtattagttattagacctagattgggaagtagaaacaatttacttgtgcaggtacacgaatacctttttaaatgttagtattttgagagacttcattgagacccgaacccatgcctataaattcgtggttctcagctggggcagttttgcctaatcaaagacatctgttttcttagctcagaagccttacgttggtgattgtctacagaagaaaatttgtctttgttgttactaaggttcataggattctaggttcagcctgataatttttgagctggtcacatatgttagcttttgaatgtttaatttccttctttgtatagttctaaaataaactcctcaggggagagagactaaaaatatcacaaattagaccttacgaagggaaaaggaaaggggaaattctaatctggctgttagtcgctgacttccagtgtctgcaaagctgcctgttacctggcctagcatatgacgttgctgtctgaatgttctttttttctttaaaacaggcccttacttgatcaagtaggatcagcctagagatgaagagagctgtcagttagaagttcccttggtcttctcactgtctgctttgtttaaattatttcctgttccattattcttccttttgactttgttgtttcttacccctctcttcctgtgctgtttctaggataaacacgaaatcatcactttgcataattttgagctttccttggtggagatagttaaaagtacaatcaatctttccctttcttcagtcatcctatctcatatggactgagaaagacctgtgagaaattaatagtaattctttgcacagactggaaagttctgaagttgcaactttggaacgatgtgtgtttctcttattacttgcacaccttgtatcatttgattctaactttgtcaggtagagggaggccagtgttgttaattatcccttttttagatgaggaaagtgtgggtccctcaccagggcacactgactggcccactggggtcctgtggtgagtggccatgggggaatgtcaggcccaagcagtgtggtatgtgggatggcccagctccagagcagcaggtcctggacttcattctggctttgtattgatgttactgaagtcccctcgtccctcaaaacatttgccttcacgcagtgactgcttggctttccattacaatgggagctggattcaaacagtatcattctgaactttttattttttgagacggagtttcgctcttgtcacccaggctggagtgcaatggcacgatcttggctcatcacaacctcccccctcctgggttcaagtgattctcctgcgtcagcctcccgagtagctgggattacaggcatacaccaccatgcccggctgattttgtatttttagtagagatggggtttcttcatgttggtcaggttggtcttgaactcctgacctcgggtgatctgcctgcctcggcctcccagagtgctgggattacaagtgtgagccaccgcgcctggccccattctgaactttattaatggctcatgtaaatctgaacttcaacaatcttgattcttacgaggaatagagatgagtctccttttcctttgctactaatttggctaaaattgcatagcgaagttttaaactctcctgacctctgttttgtcttctgtgaaactaggggttgcctgtaatgtactttcacaaccttttatagccccaactttcgctgtgttaaaattgagatgggacaggtccttgattattagggatttttttttcttcaaagtggcatgggatgaactgatctatgtgtaaattgatgttgctgttgcttttctctgagtgtagttaggagggctggaagtatatgggtgcagagatgtagaaaggctacgttgttcatcctgccaccgacaggtcagactgttctcctggctatgttttcactcagttgtgtacctgcagttcatacctacataggaccagccatgggccaggcactgtgctgggtgccgtgggaaaaccacagcaaaccagacaaacaccagcctttggggagcctgtaaaccagtgtggagatcttacaagctcacagtccactgtaatcttaattaacaagtatggaaaataactttcgccatctctgggtgggggaagcacatatgggaagtccccctctaacctctaacccaacccccaaggccaggcagaattcatttgaagcattctggaggataatattttcttcaagatcctcagaagctcttcagtgcacaggcaactcccagatactggaattgtcacctgagctgagacattccacatgccagttgtaagccaggtctccaccacagctggggtgaatgaagcacctctattctctcatgccagggtgggtgttattattccagggcctggatgaagctcagttagtttgcttaggatgaacacatgatttgtgggtcaattttcaggtaatgtgaactctacttacatgttgtttattgcttgagagctttatctcttaaaaatgagttaaactacttggcgctttgagtggaatgcaggtctcaggtagcacactaatacttccttatttttttttaattgataatggcataaagccattatgccatcacatttgatatagagatgtaagtaattgaatcacattacttctcttggattagtaatgaatattgcacatcaatcctgtgcacacattttacaggtttgttttatcctattgatggtttcatttgaactgtgtttggaaatttagtttatttcttactccattgtagatgtttgtttttgttgtttttgtttttttttttttttgagacagagtctcgctctgtcacccatgctggagtgcagtcgcttgatctcggctcactgcaacctctgtccccgggttcaagcagttcttctgcctcagcctctcgagtagctggtactacaggtgcgtaccaccatgcccggctaattttcgtatttttagtagagacggggtttcaccatattggccaggctggtcttgaactcctgaccttgtgatccacccgcctcagcctcccaaagtgctgggatgacaggtttgagccactgagcccgtcccgtttttgtattttttaaatgcagtgtttgaaattcttgacttctacacagtagtcaagactgatacttctacccagtacccaaattactgtactgctctgacagtaagttgttacaaaactattttccaaaggttggaactgatttcagggtttacatttaagctttgtttaacatctgaaactgaattaatgctagcattcaaaactagtaaaatcattattagtgattcgtcctctatttgacactgaaccagcagacatttcccttagcttttggtgacatggattaaagtaaaatggttttggtgatttactatagttaattagtgatagactataattaatgcttagtgttttgaatgaacttaatttgcaaataatgataatttaagatctgagtttgataaaattttaaaggttgatcgaatacctagattcctggttcttgggccttcagaaggagagaatttcacgtgttaagtccttatttggtcttattcaagggagcaagattttttgtttgtttataaacacatgcagtatatcgttttacgtattcaagtacacatagtacgttctctggggaaagcagaaaattgtattgcatttcagccatgtaataccctcacgttcgtgtattaagctgatcaataggggtatttatttccttttgttgagcacagtgttttaacgtttccaaagtgtaatttgttattgttgaaagtcaaccatgttaccctatgcatacaggcttttatataatattacacataaaaacatatggtatatatttttaagtaagcgcttaattttagaatagattttaaatttacagaaaaagtttcaaagataatacagagaattctgatataaactgtgtctactttcccctgtgattcacatcttacgttactatagtacattggttacatctaatgaaccagtattggtacattattgttaagtccatagtttatttgccctgacatcctttttctgtcccaggatcccatccagggcacgtttcctttagtctccgtagcgcctctgatctgggacagtttcttagactcgccgtgtttttaatggcttgacagctttgaggagcaaaactgcttttcaggtgttttgtagactgtccctcagttgagagttgtcagatgttttttcatgattagtgtagagttaccggtttggggaggaaggccaccgaggtaatgtgccattttgtatcaagggtccatgtgatcagcgtggcttatgatggttgatgttgatcttgatcacctggcccaggtagtgtttgtcaggggactccactgtcaagtgactccactgtcaagtgactcttttcccttctttccatactgctgcagtctttggaaggaggtcatttaaggaagagggagttcagctgtacctcctgtaggggttgtatttacattagttatttagaattctatctgacagatttatctattctcccaaaagggaccaagattttcagtggggatagaaggcactgtggcacagacagccccttggcactgttgcggaggaggtgataggataggatggtgccccagcatggggtttccagaatgtggtcctgggctgtggagaaatgcaaattccggggaactgcctgacttcccgcgtgggataggttggtctggaattcttcctgttgcacgagttccccaggtgattctgatgcatattcaaagttgagagcctctgctgtggattagcacttgaaccccaggtgtgccggccaggagtcaggccctcacctccatccttgccattcacacctcttccctgctggtggcacctagctctaaggctccccgtgtaaccacttctcccacagttttgaccacctcttggatctctccatctgaggctccctttgtatcaaccaagggtctttgctttctggataacttcatccttcttttggtgggcccagagttccagtgaagggagaaaccagttacagctgagaaccctattgtggaaaggccagtcagggccagagtagggaggtccctagatgccaggcttctctgaaaatggttttgtcacatgtgagagagagagagaggcagagacaccgagaccccacgtggactgtgttcaggtttgagcaaataaaaaatcaccgaaaaatcttcatagtttctacatgtgtcatgccttgcgctttgggacacccctagctcttgggcacattccctggttgaagtgggagggcagtggcctgaagaagtttctttgggattgggatctgggtggccctcatcctgcttccgcctgaggaagccctggtctgtgactgggctcaggaagtggtcccgacccagtgtctgaggaaggcattctcctctcatagatgggggccagagtctgctgtgaggccatgctggtgtgcctgcccgcccaccctactgggcctcttctgggcagcagggttgtgccctacccgggtgctgggaggtttgggtgtgtatgggagcggtggtatggacggggcaggcgttggctcagaagctggcgtggggagggtcttgaagtggtcattttaactcctggctgactgacttccagagaatctttttttgggagggagaagagtggctcacctttctcttgggtacagaaaaagtcagaattaaggccattagcctgtttctctttctggtcactgccttctccctcctagtgatgggacgattccaggcttgggtggaaggccaggtggggggacactacttcctgctccacccttcccaaaccattatacacagatgagagagactctgttgtattcattcacatagatataatttataataatgcattttgtttattaaaaaatgactgggccaggcagagtggctcatagtggctcatgcctgtaatcccagcactttgggaggctcaggtgggaggattgcttgagcccaggagttcaagaccagcctgggcaacatggcgaaaccctgtctctacaagaaatacaaaaaaatgagctgggtatggtggcaagtgcctgtagtcccagctacttaggagactgaggcaggaggatcacttgagcctgggaggtccaggctgcagtgagccgtgatcaggcccctgtactccagcctatatgacagtgagaccaaaaaagactgaatacagacatgtgcgctgacccttttgaacattattttcttttcaatctctgcctctgtgttacagtttatgttttctcttttgtcctgcggatttttgatacattttaaaaatatcttgtcctttttctaagtttttgcgttgactacagttgcaagtgtgggttttggtggctttctgtagatgaatcacttgacctgaaaacaaggactttcgctttgctagaaaattaaggacagagtttgtggaatgcactgctcttgggttttccttagaagaagcttgtgagaagcacagtttctgtgcgtaagagtgggcttaaaccaggtgatctccgaagatttccttcaactctcaagttgaaagaggccttgccgaggaaacaggcagctaatgggcagagcatcaaaccagggggggtctaggtccaggcccgggcgcttcctgctgtcagactgcctcctcacatcagcaggcattcctgggattcacagcaacaaaagagccctctgctttgaaaggggttcagtctgtctcttctgtagtctggactctggaatctagagattcgctgaagctcatgtcccagggtcttgacgtagtgtgaagttctgagtgatttcctaaagacggtgtcctgaaccatgggcctgtggtggtgagtgcatggaggatatctgtgaactttggggtgggaaaaaacatccttatttccaccagcttttcactgaaattcagtatttccttcctgcatgaatgtaggtagcacagcccatagcatttacagtcatcagagaaatggtcactattttcctgttacataatagtgatgcacgtgtgttgaaagagtgactgcttttatcattgctctcaaattatggttgttattagcactgctgctaccctctcgtttggtgtgttaataaggaaatacgtagattactatgtctcaagtttgtttttaagtaatatattaataactgtgttccacatagttgcataaaatgaaaatcacttaaaagcaacctgaggccaggcgcagtggctcacgcctgtaatcctagcactttgggaggccgacgtaggcggattgcctgagctcaggagttcgaaaccagcctgggcaacacagtgaaaccccgtctctactaaagaatacaaaagaattagccaggcgtggtggtatgtgcctgtagtcccagctactcaggaggctgagtcaggagaattgcttgaacccagaaggcagaggttgcagtgagccgagatcatgccaccgcactccagcctgggcgacagaacgagactcttgtctccaaaaaaaacaaaacaaaagcaccctgaggaggagtacctagccctcaccattctgccaaggggagagcgggacctcgccagggaccaggtgtcactgcgtcctctgatgaccgagctgctgggaccgaggctgctggccagagacagtctacacaggcattgcagaaaagtagctcaattttgctgcctaacagaactctttccagtcatgcagtaacgacaaaacatgccccaagtgggtaaaatgaaaacctgttctcaaaagagaatatagaaagaattttatttaaattggataaaagcctagttgttgtttttataaattttatttaattaagttgtcacagtgggaaatattcaatttgttagttgaaaaaaatgtaaaattgtgttctgggatctgtgattatttactgttacagcagtggggttggggttgggttgtgcattgggaacttaggggtttataataacttccagtatcaggacagtgtaaatgacttaaaatctcttgtgtgaaaaagtttgactttctgattctcagccgtgttgtggcaaaatggtccctggagtttttgaccctgtgtttaaagaaatatgctataaaataaaaaataatttggaagaagaattggctcagacattactttcattgtgccttcttgcatgtggaactataaataccagctgctagaagttcccttacgatgatggactgtgtgaaggtacattcttaaagtattcatgtgtcaataataatagctgatatttattgagcacttaacgtggctgagcatttcatatgtgttgcctaatttagtcctctctacaaccccacgaggctgccctcagccccgtttaacagatgaggtagctgagatggagaagctaagcaatttgtccgagtgctagtcctggcagcttcgctttgcagagctttcacgtgggtgcatgctgtttgcacgcctgtgcaatgatccttggtgtgggccacagccttgaccctgcagcacctgctggccttcagcacctgtggcaccacagccttgacccttcagcacctttgcatccgcaccctgcaggttaaggagagcctgtgggcagacatcccacattcttaattattttagccccacagctcgagtggaaatgcttccttctgcagggctgtctgagctccacatgtttatcgccggccaccctcctaggactgcatccctgcaggagcctgcagcctgctctgcttcgaggctcagccacaaagctgcctcaaaacctgatggcctgcctcatctgactgagacaggtgagcaggaggcagaatgatactggtcacttggctctggtcttcccaggtggggtttcagcagtaccaggtaaaaagatctcaaagtgcaaaccaaacacacagctgctttatggagacctagattcctgagatgtatttttctggcattgctttttcttggtgtgaatttacttttaaagatagagataatatactgactcttaagcatagtttttgaaaagcgagatgcttcctgtaatctcaccatcctgaaagagaaacttttcatatttgcagctcatccttgtaagtatttataacttttgtataattttctattcttctcactctgaatattttttccactttactagtttttcaaatcctttttttccatgttgtgtgatatcccatggagttgaaagcgccacacttgcataagtagtgtgctcatttggacatctaaatttttgctcctgtagacaaggtgcctgtgtacgtctctgggtatatttctcttcttcagtggaaccattttttttttttagtgtaaattccttggagaggcattgcagagttacatggtatggacatctttatggctcttgatgcatcttgccataacgcccttacaaagggttatgccagttttcagtagtgtggaagtatcaatttcacccaaataatactgcttttgaaagtcagtgtaaatggtccctccataaaggcattttggattgatctattctagaggaccgtgtctcagagtgatgataaaacagtgtcactgctgttttgaaaacaaattgacgagaatttgtacatactgtgactaccatgtccttttaaaacaggctgactttaaaatggcccttgaatttcagggactctgccagtagtgctcacggatttagcattccatcatggtcatcctgaggccggccccacggccagttcttggcttttcctttcgagctggtggtcccttctttgaagggactccctaatggcagatggaacattctcagccatggtatgacttttccctttaagggtgactttagtttttgttagactgttctgtggggacttgtttggggcatgatgtcagtgacagggctggattatcgtatttttggtcgctggctaaaacagagacagaggtagtgggtagtgggttttttttttaattactaatatgttccttaaagacattttcagaaacagttgcaaatattttagattttcacacccgtaacaggcagatagcctcccacagatacagcttagaatagggggtgtgtgtgtgtgtgtgtgtgtgtgtgtgtctgtgtgtgtgtgtgtaagtctgtggaggtatgtgtgttagctgtctttcattatataaaaaattaagagtctaggtaagccacacccaaactccagacccacagagacaataaatatgtgggtgtaagctgctgaatttgcagtgacttgttacatggcagcaggtgacgcttaacactgcacaggtatgaccagttcctggtactctggcccagactttgcttcctgccaagcaggactccctgacattgctaccatggatagtagaaatcgctttatactgttcccttcaagagtgttaaaggaaacaaaagaatgaggggaggcgcaggtggggctgagtggggaagtggggcctaggaagcacattctggtagcaggagagcccgggaatgtggggacttcccacctgggaaagtctgtgttctgcatggctctgggagggcctggaaggtggggagaacctgatgtatttctttctccttctctcacctcttttaggttttctttttcttcttctatttaggaatggggccttgctctgttgcccaggctggagtgcagtgccgccatcatggctcactgtggcctcgacctcctgagctcaagcaatcctcccacctcagtcacctgagtagctgagactacaggcatacaccagccccagtgaagtttttaatttttgttgtagagatggagtctcactgtgttgcctaggctggtctgaaacccctggccttaagggatcctcccacctcagcctcccaaaatgtagggattacagacttgagccactgtgcctggcctaggttttctttttctccactgctttgtatctgttgacttgtcacctttcagggtagtctgtgagggagaatcctggcgggggcggggtctgcaggtgaacatcgaaccagccctggctctgtccccagacctttcctttactcggctatccctccatcttgtgggcatgcaggattttcgttccctccaaactatttccatctgtagtgagtagtgttagtttgacttacaaattaatatttaagccatcaaattagtttagtaactggctggaggcttctggctccgtcttcctgctgcctgtgcagtgttggtgaaactcaggagtgaagagaagatgtgaagagacacgcttgggaggaactcttctcacctgaggacacctgcccaggtgtgtcacacctactcttatggtcagctactcgtatggtcagccaggttcaggcccacacacaccagtgctgggttcctggtgcctgcttatctctctggagccagggaggctccgacctggaagcctggacccccgtctgtgtttatctcatagataccattccatattcccaggtatatgcttgtaatgttattcatgtcacacatacatgtcatgtcattgaaccaaatgcaatttgctgttaatgtaatactgctcgtgacgtggcctacttggatgtctgatatgagcttagaagcctaacaggaagttcacctgcaaaattggaccctccctattcccttgtttccacaataacctagttagtattttgtgaaaggtgttctttataagtgttacattctggtgcactgatgatacagtaattgatttaggaatatctgttactctttgtggttacagtagaggttggcaaagtggcccatggaccaaatccagttcacctgtttgggtgtgaatacagttttattagaacccagctgggctcattcatttccacagcatctgtggctgccccatgttgcaacagcagaattgaggaattgtgactatgtggcccacaaagcctgaaatatcaggccttttccagaagaagaaccgcagcccctagtgtgcagcaaggaacagaaatcaggagagctgcattggagtccctgctttgtccctttattggcgcgaggtttgaggtttccgtgcccgcacctgggaaaggaggaggaggatacccattgtctcaggggattgctagcatgaaattgtgggacatactgggtggttcccagcacttaatatgcacttaataaatactaattccttccctctctattactcacatccccggctctcatccttaagtagttgctgtctttctacatgtgaaaaatttgagacaaaaaaatggacatcagtacttgtgttttcagaaatgaagacatctcaagcagcactgtccagcagaaatagaacataagctgccagtgtgtgctagatgtgtaacttcacctctcccagtaaccacatgaaaaaggctacaaattttaagtcttctgtagtccaacataaccaaaatatttcaacatatactcaaataattgctaatgccattcatttgctttctttgcctgtctgtagagtccagtgtgtgtttgccctcacagcaagacatagctggactcaccaccccttgagtgctcagtggccgcgtgtggccggtggctgtgttatcaaacaggtctctgattctctgacaccacctaggtgtcccctaatttggttcagttctgacactagcttttcagggttcgtgccggcctcacaagttttgagggctaagtcccacaagaccatccccatttccgtcaccagttgcatgtcctaagccacctgtacttctgatcaactggctgtaaattggggttcccatgacctcacttcaggttccataatttgccaggacaactcacagaactcagaaaggcactttgcttattgttagtggttcctataaagctaggttgtccaacccgcggtccaggatggctttgaatacggcccaacacaaatacttaaactttcttaaaacatgatgagttttttttgaaattttctttttctcatcagctgcagttaatgttagtgtattttatgtatggcccaagatgattcttacagtgtgtgtggcccagggaagccaaaagattggacacccctgttttaaaggatgcaacttaggaacagcccaaaggaagtgacacatgggacgaggggtgggagtccccatgccccctgggggagacacctcctagtgcaccatcccaatgagttcatgacgtggaggctccccacatcccatttttcaagagtttttgcagcccagtctcctggccccccacccctcccagaggttggggtgtagggggtgcagaaagttcccactctctaatcacacgttttgtctttctggcaatgaccagctcccctccaggctatctaggggcaccccccaaccccactggtcacctcattagcataagctcaggtgtggtgcactggggctctctatgaatcactaagggcactcttgttgctcagtaaataccaagggctttaggagctctatgccagaaaccagggaccaagaccagagatcttttttattatccacctgggcagccctgtcagcctgctgccccgccccacccctcccctccccatccccagctggctgcgccctatttaaagccctcctctcagtaaaacagctgatgcgtgcctattttacattcttttctaccctgggtctgacgaatcatgactctcactgtgctggtaactcccccgttcttgcttctcaggaagcaaatgtaggaaaaatatagtaacatttctaaggaagcttagagatacaaaatgtttaaatgtagcacaaaaattgtgactctacttataataacgtacagaagaataactccacagtagaagttaggcatccatggctgcaggttttctaagaaatgggacgtgtgggtgacctactgcactgcccactgccctctggagggaaccatggggtaattagagtcattggccaagaagggccaggggtccacgcagcttccgccctgaggagttgcactgtgcagtacagccaggcggccacaggagccactgtggcagggaatgcatgtgtcagtgtgtcaggcgtggtcagtaaaaggagttgtagaaggtaaaccggagaaaaactcagattttaatccctcggagtaatctttggcctctcctccttccgtgtgtgatgtttctttgtttttaattttttgaccttctgctttttgattcgggattttggagccagaatgccttggccccgccatgaggtctgacttgtgctggctactttacccttggtgcctccatttccttcactggaaaatgggtgattgtgcagagtacagtgagtcaaaccattgagagtggtgcctggcacacagcattatttaagtatttttgcacttaatttcatgtaacataaagcactaataagtaaaaaaaaaaaaaaaaaagaaaaaggtatattgcaacaagaaaaaggatggtgctgtggacatggggtgtggttgctaaaggaatttctaagaatcagacttcaaaaaaatgttaatattctggacagaattcttttctacagaattctttgaactttaagagcatgattgaaatttctgttacagtgtgactccagttagaggtaaacttagtggctctatctaatgctgagatctttttaaaggatgatgtttgcatctggctttgatcttttgagaggtagatttatgtgtcctgattaaaaagtacagtgcttttcttacaactaagaaggcctgaaacttactgtaaggttgtgtgtgtgtatgcgaatgtgtgtttacataactgatcatatttaaaatcattttcttagaagtagaaggctatagaatatctgtcatttttagagtgtgtagatatgctctagaaacagaccactgatctgtaaaatgatcaggtcagtgattcggatttgattcttgtgtgaatcacagagtgctatattgcctaggatatggatatcgatatttagtaatctgaattatttttcattattttaaacttaaagatctttaacaggtcaagaaaaataatacttctgaaaatgtatttctacccctttaaagtatttcagatccaggaagtcattttgggttaaacagtttggcatttcagtttgcttatcatttcaatcttcagtgtttggcaattctgatgttaatatcatgatttctttttgtttgtttgtttgtttttgtttttgttttgagacagagtctcgctctgtcgcccaggctggagtgcagtggtgcgatctcagctcactgcaagctctgcctcccgggttcacgccattctcctgcctcagcctcccgagtagctgggactacaggtgcccgccaccatgcccagctacttttttgtatttttagtagagacggggtttcactctgttagccaggatgctctcgatctcctgacctcgtgatccgcctgccttggcctcccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgggaggctgaggcaggtggatcacctgaggtcaggagttcaagaccagcctgaccaacatagtgaatccccgtttctattaaaaatataaaaattagctgggtgtggtgagggcgcctgtaatcccagctacttgggaggctgagtcaggagaatcacttgacccgagaggtgaatgttgcagtaagccgagattgggccactgtactccagcctgggcgacaagagtggaactccctctcaaaaacagaaagacctaatttagacaaatatttcaagaagtttcccattgtttctaatcatgtcacttaggtagaaagtaatgttcttttcttatcaatagaaggcagcttttttaaagctgatgtttctcaaatagaggctactgagatttgctttgagttcataaagctttctagaaaaagcatgtacctgggttgaccgctactggcagctttttctaaccattgttttcttctgtctgaagtaaaaaccctctggtgtgaaagctgccattcctttgtgaggcctgcccatcactcagatctatatttttctccgcagctgttcccagaagcttcctcagactgacttcctccctcccagggctgttccagggcctcattttccactccctcccagacacccttcaaaattggatattgtcgtcaaagtgtccaggaactcttcagctctgagtctttgagaactcagcttgtaagctgcgtcctgcctgtggaactgccgatcctggctcagccgagggcagtgtctgaaggatggcggagggggtagcgtttgcagaggctgagaatgctgtgttagcagtttccaccggtgtcttcccaacagcctctcggagcctcctgggaactcttgatctctttggccctgagtttgagaaccatagatttatttagactgttgatttttaactttctcaaggctcagctcattatttgtttattcccaaaggagagccttctgccccatggaataaacagcactaagcatccttcccatttgcctgtgtttggtcaggataagaacctagaaaaaggaaaatgttcctttctttgttcccggggaatgtgggcatagtcctgggtttcactttagcccacctgatgtcctgccttttagatagctgatctagcctcacagatgtgcttctccagaagtggccggatctctggtcctcctccctccgcagcactggggtcagccgcatgttactgatgctgggttaaacattgagccagtacttgcctgtcactgttggctcagcatgcagtcattattgcagaggacatgggaataagtcaatgacaaaaacactgtgcttctgacttcagggaggctcagaggcattagtgacctcctactagagtttttccccgaaactcttctttctggaattgacttcttctcccctcccattttcacagtgagtgcagcttcctttcatctgggaaccagagtcctccctgtccttgccctgcatctaggtctcctggtccttccttcacagtgtgttcctggcgacctcccacatcatcccacgtgtccacattttttttttttttttgagatggtctccctttgttgcccaggctggagtgcagtggtgtgatcatggctcactgatgccttgaactcctggattcaagcaatcctcctgcctctgcctccttagtagctgggactacaggtgtgtagcaccccactcagcaaattttttttttttaatttttctgtagagacaggccctcactgtgttatccaggctggtctgtaactcctggcctcaatccatccacctgcctcagcctcccaaagtgttggaattacaggcatgagccacctaccatctggccgtcactcacctttttgccagtgagtgccaaggatatttttctttaagaaaccaacatcagcaattgcagttgtttctcgaatcctctaacactggcttagtcccccttgtccctctcctttccagccacccgcttgaggcagacctgtcttctcgccgtctggtacacgtgccggcctccatcagtccatgcacctttgctcatgctggtttttcatccctggaatgcctccttgtttcccacatgctcagctcagggccatcaccactgcacctggaacctgctgggcaggtaacttcagtgtcatagaaagaccccatggtgtctggcatctgtgcttcatacttcatgtctttccttccccttccccagtcctctgtcagcacccaataccatagtatccctttgacactatggttcatttcttatatgctagagcatcctggtttatggatattttttctttggaagacttgaagcagcagtcacccactcaacaactatttgagcacctactctgagccaggtgctatttcaggccctggtgatcctgcggtggaaaaggagcacccaagtgcttgctcccctgagcttgtgtctggcaggctgcctggagaatcggtagtggtgtggactgttgtcttttgttcttatgcagtgttttgggtagtccagcagtcttttctttaactgtttttatttgccttaaacaagacaaaaccctctgtttataagaaagatgtcagaggtaccaaaatgaagtgtgcatctggaagtcctcaggtggaagatgtggatttttccagctatctttttttttttttttgagacggagtctcgccctgttgcccaggctggagtgcagtggcacaatcttggctcactgcaacctctgtctcccaggttcaagcaattctcatgcctcagcttccagagtagctgagactacaggcacgtgccaccacacccagctaatttttgtatttttagtagagacaggttttcaccatgttggccaggctggtctcgaactcctgacctcaagttatccccccgcctcagtcctctaaagtgctgggattacaggtgtgagccactgtgcccagcctccagctatcttagtaacagatgttttaggtacctgagtcctcctcacagtagctgagcccttacagcaagccttaacttggctgtgtgatgatggtctgactggtctgacagatgctcagtattttctgtgttggcaaaaataaaattgatgtattggtcagaatctggtggccctccctgtgaatggaccccttgggccctggtgtgttgagcccctggaacaatgtatttgggtcccagagtcagatttgatcgtctcaatttgggcaggtgtccactgcaggtctggtcatgtggctggggaaggcacacacacaacgaactctagacctggctgttggggcctgtccactctgtggtgcggtagggagaggaggtgtcaagttgtctggggcctggatgacgaaatctgtgttccacaagtacactcaatttttaactcacgtttattttgtaacttttgtgaagcattcattggacactgagtactgggtatcatctataaagccacttttctttttgagttatgtgttgaaagaaatgtggcttaatgagccgtgtagatgtacagctgaaaaaacgctttctaaaatcattaccagtccaggcaccggtggcttatgcctgtaatcccagtgcaggaggatcagttgaggccaggagcctgaggccagcctgggctgtatagcaaggccctgtctctacaatgataataataatataataataataataattaccagatggattcatgtagaaattgagtcacaccatggtgtctgaataccttgtcatctgatgttagctaaactttagtttttaaaaaatagtaataagtggtatttgttgaggggtggtttttacgtgttagtcatgttgtaagtaatttgcactgtgtgtggcatgtgggtgcctaatcaatgagaatttgcctgtttctttgtggatttttaatttttcatgatgggaaatttcaaaatttaagaatcctgaatcctggtgtgcctgtcactggacatcagtagttaactcacctcattcccttccctgatctctgggctccctattagattattcagattccaggtagatagataattatttttaaccgaaatttagtttttaaaatttaacttcagattgattttgtttgaacttaatcatttttcctctgacttgcttatttttttcagttgtcattgtagcacattgatgtgttctttcttatctccttttgggttttaaacattatttatgaatttatgccttaacttaaattgtctacagcttctgctgtagacaaaggagctgtttgtttcatgcaacctttcaagtgaagaataatcagctaattacaactgtttgaaaattagcttcctttttgtttgtttgtttttccttcctaccctgggagcctggctggcatcactgggagcaccacacctcccggtgtggtgagcttgggagctaccttgattcacttggattcttttaatgtgtatttgtgtttttgtgcactaatcaggctcattattttctcatctgtaaatgagaaacttggaatagctggtcatcaaaaagttcctttttgattttgtggttaccaaaaccaaaacaaagcaccaccaccaacaaaaaaaacagtgcgagggataattgttgaccgtcagttgcttagggagttaatgacttccacctgggaaataatttgaaaaaatgtcccccttgtattttggtttggcccaatttggtgtggcctggagcatgtcccttactgcaggccacctctgggggtgtgggtgcggagcaggccatgcctggctggggacctcccctaggaatctcagtgctctgccctgccattcgctcccacttcctgtacgttgctacagtgtcctgggtggggacaccccaacttccgtcccagcgacagaaaccgtacatcctgggttttctgtaacactcagtttcttaccttttgccctttatttctataagtcctccaaatatcttaacatttcaacatcttctggaagcagccaaagcacgtttgggggagggagttcagaacccctgtcaccatgcatataccaggtgggcccatttgactgggacagggtggccgccctccagggtgtacagtcacccagctgtggttgggggctgcttcctgtgccatgccatctgctagcctacccacccgtggagggctcctgcatgctgccagccttgggttgtcccctggcctggcaggggacctctatgacattttgagcatgatcagaaaaaggaacttgtggattttcttttagggttagctggtgagcagatgatgccagctagcaagccaccttcctcctccagccagcctccctcgttttagctcagccatcccagcagggctggacttagtccaggctccgggctcccagctcctggctgcagggatctttagcagtcggaccacacgtgactattcgagggtaccatagccctctggtttctttctggtagtcagtactgctgacctcacttttcagataatctctgctctcctctggccttggggttcttcctgaccccttggagcctctctcagtaaatggaaacctcctaggggtttcatataggcagaatctagtatggggagtggcttcacgagagtgtgaagggctggacagccaaaggcatcttccccagagatcagagactaagaaagctgccgctgtccctaggtctgaagggcaaaatgaggccttgagagttcccagagcctgagagcaggtgctctcctcactgctgctgccgccgagcaggaattctgagcccacggccctgcggctgtcactgggcactccaccgatggcagctggaaccttctactctcgtcactgctgctttaggaacctgctgtccccatagccacgagccggggtgttgcgggggggcaacgctttgcccttcctcctgccttttaatgttgcacctggttgtgtctttgacagaacttaaccagaatccagctggcaagggtagctttcaggtacagaggagggctggggcagtcctcacaccaggaggccacatcttgcacacagactcctgagagtgtgggtggaatgaaatgacccagtgctcaccacctggcacggcgtgggtggagagtggtaggtgctgtgcattttctgtatggatcaatggaaatgggatattgataatcatgcggattatacccacacaccaaaatggaaaaacaaaacaaatgaaaagtttaacatgacctgctttggccagtggaaatgactataaatgacttcagttgcagctgttctccgggtaacagtctgtggacaccaatgcgcacaattcctatcaaggtcctgtgtgtagagccactgtggacactgtggttctctggtgcatatgttgtgggtggagaagcagaccacttgaagccctggtaggaactgtttgctcctgtcaagcaggaaacaaacacgtgcatcttgaaaatgccgagctccctttgcagttctgtgctcgtattgaagagaggatcggtactggggtgacagctcacaggattccagcagcagcaccttggtttcgcctagccgttcagcctttgcctgtcttcttgtcatggaaagttcttttgtttgagacctggactttgtgagtctctcctagctcccttatttgcacctgccttttctcctcaccttcttcagctgtgcttggaggagctgccaaagtggcagtaaaagaaaccccattgagctctgtgaagtgagagaaatttgtcctaaggacaagatgtgttgtgaaggagatgttggcaggcctctgggactgggtcccgggcttagagggggactggggacctagaaagccccctgcctctcagctctatccctctgcacattacagactggccgtccctatcccagcacatgtggtagtgacctttgccaacatcctggaggcatgtgtctccagcagaggctggagccttcaggatctgttctgtgttctagccttgaggaaagagctgctttggcccagtttggtcagctgcccactctgaccacatctgctgaccatcctctgtggcgtgggaagtggtggtgtgtaagaacacacctgcccttaacactgtgtgcatggggaccagggaagggcggtgatggcagagggaagaagcccttggttctgggcagcctctccatggggatttgccggcagagttaactctcacagagtaatgcaggatgctggtggctgcgtgaaccaaaggtgcccctattaactggagtttctgcacattcctccttaggctgggaaatcatgcccttgttactgcactggttatgtgtatcaattgagataatggttatttttttcttctttcatttcttattatttttgtagagacaggatctcactctcttgcccaggctggagtgcagtggtgtgatcatagctcgctgcagcctcaaacttctgggttccagtgatcctcctgcctcagcttcccaagtagctaggactataggcacacaccactataccaggctaattgagataatggttattttttttttcaagagctttaagaatatgctttaagaatatcttttttaaacttggaaattcaatatttaaatgttaaaacaaataattgagaataattttcattaataatccatcataaggctgggcacagtggctcacacctgtagtcccagcactttgggaggctgaggcaggtggatcacttgaggtcatgagtttttggccagcctggccaacatggtgaaaccctgtctctactaaaaatacaaaaattaactgggcatggtggcacatgcctgtagtcctagctactctggaggctgaggcatgagaatcgctagaaactgggagacagaggttgcagtgagccgagattgtgccactgcactccagcctgggcaacagggcgagactccgtctcaaaaaaaaaaaaaaaaaagaatccgtcataaaatgtgtttattaaaatcactcctgaagaaaacagaaaacacctagacttgaggcttttaatcttttttaattaactaaaggggatactttaagttgattgccatgtgactgttatatatagagcttcagtctgtctgaatatggctgcatctctgccacctaccaagtggtgggtggctgcgtccagctgaacttggcttcctggagctgggtgcagcctcctggctgcagacctgaaaaggactgcccattctttgtgctttacacttggccttgtgggcagatggaaaggagagcttgctctccgcccacgggagacgtatgcaggtggaggagaggaggaaagagctttgatttttttttttcccactaatcagcttttgaattgagcctcttggtcagaccatgatttaaaacgcacactcacatacatatacatagtaattccctagcagaaatgtagctttgtagagtcctcacgttctgtatgatggattaattcccttagttataggaaggagaaactgatatggggaaaacagcctgaatgccatagcctacgagaccgccttcaccctctccctcaggatagcgtgtacatatccacatacttcacagctcagcgaattctcaagacctcctgtgtgtgcttccttgggttatttaattcaattctactcttttcataaactactctaatttccgtttttccagttttgcctttaccttattcaatggcattattttaactgagcatattttggacgtactagaaatgaagcatatttcctttgttttaaaatttctggttgcaagattaatcaagaataataaatatttattgtagaatatttggaaggtttttaaagtgaaatttctattaataaaaccattgcttctcagcatctagattaagttgggacctgatagtcataaatatttagatgtctgtcacatttatttccataatatgggagagagatatatacacacacacacacacacacacacacacacacacacattcatctaaaggacacacacacatactctctccctttctggctctctcattttcgtttggtatctgggttaaaattctaatgttcatcctcaaatcctgcttctcgctcatgtcctgtgtcacatccatatagatgttgaataaagtgataaccacatttttgtcatctatacctgggcactattgagagtgggaggggtgctgtctgtaattatgctgaaacatcagtcaccagtcagagcccctggtcactgatgtggtctgaatgtgtccctcatatgttgagatcctaccccccaaggtgatggtatttggaggtggggcctttgggaggtgattaggtcgtaagaggggagcgcttgcaaatgggattaatttccttacggaagacaccccagagggccccctcaccccttcagcatgtgaggacacagcaagaagccgccgtgtaggaaccaggaaggaggcccttaccagacactgaatttcctggtactttgatcttggacttccagcttccacaactgtgggaaataacttcctttgtttataagccaccattctgtggtattttgttacagccagccaaatggactaccacagtcacccagccttgactaagtgaccctctcttttctcattgcccgaatctagattttgtctctcacctggtcatggtcttcctgtcttcttgctttcagatttttctccctcccacccacctattccggggttggctttcaaagatacagatctaattgttttacttctcttcttataaactattagcttcccatttcctagaggtgcctttgtgttgtcaaagcacctttaaaatctgatctttgctccaccttctaccattcagcccttgtgaattttatgaacatgattactctaggtattcccaagggagccgtgcactttttacacctctgtgcctttgcaggtcctgttgctgacacaggggcagccttctcccatctccgcttccacctccaccactcatcccttcccacactgcaagacttgactaaatgcaatctcccttttgaagccttcaggattcccccagccagaactagtgaccctccttggccttctagtccatgtacgtctgtttcgtaatatttctgcactcattcctggaaggcagtacagcctagcagttaagatctggtttgctggcatgaatcatgacctgccattgccatagtgtgactttgggctggcagaggtctttgtgcatcagttttattatctgaaaaatggagaaaatagcagtcttgtaaggtagttgttaggtttataataaagagcaatgcatgaaaagtacagagcctgtggcttggcaagtgataatcctgcaatttatgttgtctgtgacagagctgtcgcctctccgcagtacgaaaatttgtagacatgtctgtttctccagttggaatgagtctgtgataaggactctggccacgtagtgatgctcattaggcatttgctgaatgaactggtatacgtgcatatgtattcttccctctttatttcttgccgtaaatgcttttaactgaaataggtacatacagctgtcagtttcttgactatgaagttgagaatgtccaagtgagtccaaattacctgaaaacctgcggcccatcaggtccctcaagctgagggaggagctcctagacaaagacctggtttcccaggtttgaggtccattccttccttactctgttcttactatgactgcgggaagttgcttttgggcttccgcgagagtgggagcctatcaccgatcatctctttcccctctctttataggagtaaggggacaaccctcctggtctggctgtaggcaggcggggtggccgggcccagggactcagggtggcccttccttctggtgtagatggatggattatcaggcacatcctgctgatggcttccaccagcccatggggattagtgatctgccttctctctctgccaccaaaaatctccctaaaactagttccactctctccacagcaggtgtcagagttgggttgatggccatttgaggacttgagaagaaacagtctatataatgaacgctcttttcttaagtattaaagttactttaaattctacacaaaatctcacttgaggaatgctggctatgtgaagtgtcttatgttttcatcctctcactcttgaactccatgcataggtagtatgtggttttagtactttttattttgttagagcagttttgttttcatggctaatttagctctcctcatgcaacgtcaaatgatagaacctgatcgtttctgagagtgggggatccggcccgttgaaatcatttggcaaaatgggctgcagctgcctgtagaggcgaagtggatgtcggggagaagaggaggttgcaaaggctgttaggcttgtgctcagctctggcagccacagcacctgcctctcagagctggcttccagtgactagtactcacttactgtccccaacgctcccaactggagaggcgtagggggcagttactccagacacttgtgctcaccggcttggcgaagagggtggcagcctcacctttatttccggtgtcataacaagccccatttgcagctgagttggtcgactatcatttgcaacaggtaagccttaaggccagagcctttttgggtacctgggatataaccgtggaacaagatagatggggaagctgccttagaataagagttgcagaaggccagagccctgggaggtggtttaactttctctgcagcactgctttgctttctgccgcagcagctgaggaagccaatttaaccttgaattttctttaagatgatatgtaatcttttgaagatggaaagtaatggcagtggaatgttctgcgtgctgtttgtagcctcgctagagcttgggtgggcccccatcgccctcctcctttggggagcctctaagagtcactagaggagacttccctgagcttccttcctcggagtgaggcattaaattgtgcccgtgttctggggtagcaccgtgaaggcccgcgtggaacatggtttttatttagagtaaaaacagctcgatgcagcgttgcctgtctgagccagacttagctcttcatcttcacctgcttgtgggaagcttcgtacaccaccaaggcacaggttaatgtgcagtatttgccaccgtgggtgcagttactaggaaggcagccgttcgcggagaataatggtgtgttttttccaccttgttcctctgagcatcatgaaataccttagcacgaagaaaccctgtaaatattctgggtaatagccctacataaatgtattcagattatgtttttttttcgctaataggtgaaaaatgatgacctccactctttccaagaggggtggcctgttcctgagcgacttcagtgtgcttccccacagagagggttttgcagctggaaacaagggcatttcttcccagaaagtgggagttgtttcgcttctccctttatagtactgccttgtagcaatctgaaatgtggatatatttggaatttgcacgagaaaatgaaacaccctttctctgcagaagacagagtgccattgcctttgcaggtcactgagtaagcagcaggacctgcttcagctggacggcaggtcccttctgtggcacctggctggcctcaacaccatgcgtggcattggcagtgatgaaattcattttcattcaggaaagcgtcactgggagcttttcttttttgagagaggctctccctctgtcacccaggctggcgtgcagtggcgtcatctctgttcactgcagcctctacctcttgggctcaagtaatccgcccgcctcagcctcccaaaatgctgggactacaggcatgagacaccacgcccggctgttatttctaataggaagttgccatcccttttctcaccccagtggcatttctggggagcagttttcccacctgctgatcggactccttgtggtggtcatatgggcttggggtgaatcgggaggggagagtttaatttgcttacatgtcaagctgtttaaaacagcctttcaggctagtaagtattgatgctggttatattgaggtgaaggggcatgttaaattcaagatacatttgtgtttccactatgtggagcctcgcttgtggagggtacaatgtagagatgtattcaggtctttacaatgtaggtgagcataaatgcatttttatcatttctataataatcacatttaaattgagcatgtctgtggttaggcaggcagttacaaatgcttgccataaaagattctcatttagtctagtgaaaactataacaccatcaaacttgcccctggaggagcagtgtgtctgttgaggtccatccgttcctcagcagccactgttccaggcccgtgtttcccacacttcccatttcaacattcttagaatatgcacaaagagtgtgtcctcagatactgacagaataggatacacgagtaaagttaggaacacgtgcatgcacttaggcagcctcccagtttgaaatgctttctgaagcaggtagttgttttttatgtgtttttttgtgtgttttttcgtttttgttttgtttttgtttttgtttgttttgagacggagtctcgctctgtcgcccaggctggagtgcagtggcgcgatctcagctcactgcaagctccacctcctgggttcacgccattctcctgcctcagcctcctgagcacatgggactacaggcgccggccaccacacctggctaattttttgtatttttagtagagacaggatttcactgtgttagccaggatggtctccatctcctgacctcatgatccgcccatctcggcctcccaaagtgttgggattacaggcgtgagcggcagttggttctttacggtgtcactgggagccgaggtggccatgctgtgtgtgtccaagtgtaaaaagaaccagaggacggttcccccgtcctggccaaggaggctagtgggaagcttcctgagatgtctgtggacacaggaaaaaattgttgtgttgtcctacagggagacatgtgagtgtaattcctgctattcagaaagatagagtccaaagtgacacgaccaaaagaccgccaatacaaaatctaatgccgcctgcccagtcctccttgtaacctggtcccactgacaggtttcccgctgtgaacagtaaagggaaaggcccaatctccaatagcaccaatagagtggaagccacaggattggctctgagccacctcaacatccgctcaggtgtttgcaggtatgcccagccagggagtctggggcagccctgccgaggttaagtttgcctttgtgctttataagccgaagcttgggagaacctgatcacacccaaaatgtcattctgagggtcagcaggaggttgggcgcaggactcctagtaagtgctgagtctatttatttagctgttctcatttgatgtgctgaagaaaataaatacgatatctagtagcagtgcaatacttttggtctagatgatggtccagggaggcccaaattatttaacttgggcgactggttccctggacttaataccttttgcctgttttttgtgttttcgtaaacgtgtgtgtgtccactctttgcccatctgtcaattttctcatttaccttctgccttatttgccttattctcacgtcccttccactgcacatctctctatcagttaattaatccattcatccagccagccttttattgatcatctgttgtgtctagggcagcatgattagcgttgtggactgaacaataaattacaaacaatcccagcaccagggatgaaaaaattatgtgtacaaatgactctgataacaaatgattattttgaatctatgtaataaccgtagtgatcattagctgagcatgtgctatgtgccaggcctggctctgagcacggacttgttccattagccctgggaacggccagtgggcaggctggggacaggatgggagttcgggaaggctgggagtgttgtcttgggcctgtctggaaaggtctctgcctttggagacctggctgccagccttggaggtggccctggccgctgctgggatcttgtgtctgctcctctctaagcatgagatgctgagtcggttcctttagctcagactcatccacacctttaggaaaaggaggtaatgccggcctcgcgcggttatgagagtgaaattaaactccacatagctggctcagggtgaggcctgataagcactgtgtccctgtggtggctgtggcctggcctgactctcctgggtccccgggcagggcttcctgtctccatcgctgtctcttatttctctgcctccttcaggtccagcttctactctctcctcccttctgcctcccccacgcattgcttcctcctgggtttgttcccctctgcctctcttgggccagtgccttctaccagccctgctcccaccctagccttaggccttaggctgactcccttacctctgctgctcaggcaccctcctttctaaagcatggtgataacagcaccgtccagactcgaagcaggggacctgcgaaacttcagctggcgtggtgccgcacaggtgctccctggccttggtggctctcaatggggtgagcatgtgccctgctttcctctcttctgccctttgctgcgactcctctgctgtcttgctctgcccgctgcaggcgtggtggcactgggcagctgctgttactcccactgccctcacctttgaccctcagccctgagcactcagctggatttctcttttctgggttggttgtcctcacactgaaggaagctcagctcagcgccgtggaaggggcaggacccagtctcagctctgacatggtcatatctgtaggcttgggctgagtcttccacctgcaagtgcaatggactgaaattttatgtcccccagaaattcaggtggtgaagttctaacccccagtgtgactatatttggagatgagccctctgaggaaatagggttgagagtagggcccccataatgggattcctgcccttctgaaaagagacagcagagagctctctctgccacctgaggacatagcgagaaggcagccatcggcaagccagaaagtggcccccatcagactctgctggcacttggatcctggacttgcagcctccagagctgcgagaaatgaatacctgctgttgaagcccccagcctgtggtcttttgttagggctgcctgagctgactcaggcagtgaagctacctcagtctctccctgcggtggagactccaccccatggggtgtcagggtgcactggtgaccactgcaccttccccataggagcatctccactagccaggttccttcttgctggaaacaaggcccatcttttcttgatgacagtgagggaatgggtagatgggaaaattacggccataacttgttttgctttaattttgggctacatccatgttataagatgatctcattctgttagaaacacatgcgtataccgccccccaccgcccccgacttgtagatccctggcccattggcagaagtgagtagacctgggcttcctgccctcctgggctccacgtgccaccagccaaggacaaatcagagttgggatgtgtctccttccaaggttggatctgcttggatccattttggatgcaaaagtgagggtgctagctttgaaaaagcttctcaatttgactttcctttcacttccgtaaagtgtaggggattagaagtgagagttggggaggaaggaggccaattctagataagttttttcatcagctatgtgaattggagacaaaagttagaaaacctaggtactagtgctgtcttttgcttaaaggatttttgtgcccttgaaacttctacacccataaaatgcattttcatggagttaaagccattgcttaaaagtaggttaaaaggagagggaaattcttttctccatttctatcaacgccatttagatgatgatgtttcagtcttttttccatgcttaggtttcctttttcctctggtttgtatatttatagtcatactctatccaaatgaacttttctcattaatagggattctgaaactactgttatctccatctcctcttgaacaagtaatacaagcaatatatatttttgatatttaacatatctatagttgtactatattaatacaattattatactgtatattacttatatgtaggttaaataagacacttctgttggccagtgcagaacttcctcatctctaagtgccttctcctagagttttctatttttttgttttctttcaatatgctttatccatagaatgcataattttttttgtttgttctccttcattcgttttcttcattcttatatagcttaaatcagttacaaacaagccactgtaatccaatactctgtactttaaacaaaagctatctgtgttaattctgttgtgttttgacagagggtgactagtcagggcagcggatctcttatctgctcgtttgggtttctaaaaatgtattctggttgcattcaactttttagaattctaaactgatatagacaattgttatttaaaacatggtatgactgtgaacgatttaatgcacgcttctctgccaatctccccctcctcccgatgcccgcagcctcacttgtgctcagagggttccagcgcccaagtgagccccacccaccttcctcagctgagggcctgggaccctcggctcccatagcgggtgtgagaggccaggtttgcagttagatgtggcacttcacaccatttttttctttttctttttttggagacagagtcttaccctattgaccaggctggagtgtagtggcgcgatcttggcttactgcaaactctgcctcccaggttcaagcaattctcctgcctcagcctcctgagtagctgggattacaagtgtgcaccaccatgcccagctaatttttgtatttttagtagagatggggtttcgccatgttggccaggctggtctcccaactcctggcctcaagtgatccacccgcctcggcctcccaaggtgctgggcttacaggcatgagccaccttgcctggcctcacaaccttttttcaatgagaaaaacattagccttcttttgttacacataagagagttctttctagttgaagagatgtttccctgagtctttctgatgaaaatgatcctcttgctacataaaatccttataggagcaataaaacctgccttcggaaccagctgtaaagcacttattgtccatcatcatctgctggtgaggaccttgctccccggcttgtgattctcaaaccccaacttaggcttgctcccggttaacgggagggctttttctgacacagactgctgccccacacacccccagtttctgcctcagtggtctggggtgggccccagtaatttgcatttttaaaaagtccccaggtgatgctggtgctggccagggcacacctcaccatcagataacgaacaggttggatatgagtggtcgccaactaaatgttcacgaatggatgttgtgttttgccatcactgcctggagggggcagggtaatcagagtccaacactagcgtgttcatgtattgagtgcaagggagcagaattggcttgtcttcaaaacatcttaatttttattgcttctactttgtggaatgttacttcctatttgtagaacgagaagaattaaaagttgatttgtgagctaaaaatacgggcagccgtttcttcttcatcaaagcccacaaatagacctgaacatttagacataaaagtaaaccgttagaaatagtgtgcatgtcattaggatctgttgattggattaaaatgacagactcgtttcttggcttcctgcagctctcgtcattgcccaccatctatttttagcagatcttgccctgctgactcagagtgggaacagttgctgagccctgggcttctcaatgccataggctggcaagtagcctgacttctaggatgggtagcactctatgcctgggcagcaggagagtctgtgcctgtgaggagacccctctgcaggcagcctgggagcccggccacccccgcctgccccatttcttgttacctcacccactgagaggagccacctctggagccctggtttcctaggccctttgagaagtgtgccaggtgttgctgcctggagtgtcatcacttgatgtgacatcttactgcatcccccgcacctgtcctcatcttaggtgaaggcatcaggccaggcccttagtgcctccttcctctgttctgggcacccctaggggagaagtgtacatgggtggagcttgtcttcaggagactgtacctgtttctttaaggctgctgtccaggtgggtctctcgctgccagctgatgcacataggcaagacttgggtggagggaacggcctttgagctgtgcccgaagaaggaagggtgtggcaggtcagcccgaggcaagggaggagagtcctcatctgcagggcttggtgaggagccagccagagtccaacccctcccctttatatcacagatgcacactgctaggggagtgctcctcgtgttagaacctgcaagagttggaaggcactgcttagaggttgtccgctcccactcaggaaactttggggctctggaaatgcccatgagcaacacagctgagagggtaggtactgtatgtgggagccacttggaagcccctgcggccctgggctcagccactctgcaccctcattttctcatttgttaaatgaagaggtgacagcggaagatctctaatccttccttccaggatttaaattctagtaattcttaagagaatgttgattcatctagagaaacctgaggcagtgatgtaaattacagccacactgataagaaactggtcattttttacctctcccacgtaacctctgtgccttcacgtttttctcttcactccagaagaagagtgaccaggtgtggtggaaggctcggtggctttcacgatgggaggatatacggtgtaaagtgcctaacaacaatgtagggagtgcaccctcgccccgtcgccgtgcttaccggccagagtgctgctgcagattactcttcgctcactgtctttgggatgtccttatttgttccgtgtattacagtgtagtttattgtatgtttttagagcactcttgtgttcatttaaacttctctagagcaaagagcatttcgaactgactccgtaatagatctgatcatagtgacctcttgaagtgcttgatacagggtttcgtttttctacttgacaattcaggcaaatcagtggtatacattcttcgtagagcttgtgagttttgtctataatttgatccatgtaaaaatgacgcagctgctcgtggtggttgtgttttgataggccactcaatattttcatatctgttgtatatttaacacccgaataacttaccaagattttatcgagtgaactgatttttctttttgggaggagcagaggtcaagctaccaaaaatgttttttcgatgttttgagtgtgtgttttttaagcataatcagaaacaaaaagaagagccttaatgggttagcggttgattctgaaaagcaagctgttgattgtgttgtgggctctgcacagagccgtgggaacgcttccccagtcctgccttggtgaccggagagatggatgagattttggagacccctcctgctcagcctcaccactgacccgctccatgccctaggcagggaggtgctttgcgcaccttcatatgtagaagatggtttgctgcttgggggtttctgatggccctttcagctatcacattttatgatgatcttgacattctttgtaagatgtgatttcttagttatcaagatcatcatattcagtgtagtcctaaggtagaatcagaataaattgcccagcttcagcagttatcaattaatggccaatcctttatctaagcccctatagactctaacagattatttctgaagtgaattccagacatcaattcctgtcctgtaaatattacggaatttcaataacaataactacttaacaagtatgcagtcagtgttcaaattttcccacctgtctcaaaatgttatttacaactggttgttaaagtcagaatccacgtaaggtccacacatgcagctgaatgatctattgatttgtccaaactcgtttgtttttttttttccaccttccccatgccagttgatttgttggcaaaacccggtcttttttcatttgggcttcccacagtctgcaatgtgctgactaggaccctgaacttcctagaaactgcacatcagaaccagagccagtctggtgcgattttctggcaaggctgccccttaggtggtgtgtgtgcatctatcaggccgaggcccatgtgagcaacctggatggccgtggcctccacctgtaatgcacaggggttgcaaagtgatgattttctgattcagtcactccttctgcacttgctagccaggtgaggagagtacttgtcagctattaccccgacgtgcagtttagatgggagtctttccctttctcaccaaccgagtcagcttttccctaatggtgggattctttcctgtcctgtgtcatgaagccaacccatgaaactgaaggtgagcatcaagcagtgcaggctttatataatggccgtggaattgagaagtggcagtgtggctcgcaaattggcttctcagtccatgagaggtgggaagccacagatgtaggacatctttaatgaagggattgggcattaaaagccaggagaggaatattcatgtattttctgggaatgggtggagaacttctggaaaccagagtgctgcctgtttttttgtccccttatggtttcttgtcattgtcatggtgattgtcaactgtcatggtcctagtgggagtgtcatttagtatggaaattagatgataatgaagttaaaggttcttcagaggtcaggtgagctgccatcttggatcccactggtttcagctggtctggtcaggcagggaacttctgacctcgggcatcctgtttctgagacaagtagagttaaggcagggtagaaattcacctaggtcatgtaggcattgcactggctaacaagtttatttggcagttttcagagtaaatagttctggttccccagtatccaccaaagtgagcaatgaatttgtttatttctttgttttgagtagcaattgtggaactctgatttaagatactttgtgtgtatttttacccactgcagttgacaccctcattgctgctcaggctgccccagccttggccagcgaaagctgccttaggtggccttcgtgttctcttgccacgtgcctgtagtccttaataatcacaccggaaagcagggagctgtgggggtttcaggctcctttagacagtgcctaccccagctggggtctgcgtgccttcaaagaactgtggggaccactactgtttatgggttgcttctggtttggtcattgtgtctgagccttttcagtggataaaagctttttttctttggtgtggtttgtttttaaacataatctattataaattcacattgatacttataactcaaaattaggattctaaaatattgtatctttcgattttttttttttttttttttggagacggaatcttgctctgtcgcccaggctggagtgcagtggcgccattttggctcactgcaacctccacctgccaggttctagtgattctcctgcttcagcctcccaagtagctgggattacaggcgcctgccaccacgctggctaatttttgtgtttttagaagaattttctaaaatttcaccatgttggccagactggtctcaaactcctgaccgcaagtgatccgcccgcctcagcctcccaaagtgctaggattacaggcatgcgccaccatgcctggctgaatcctttgattttatatttcctttatgctgaaaatctttgtccctaggatcgtttacgtaatgacttatttgcttgcttgtgtgttttatttatatacaatatatataaatgtttaaaataaccccaccaatataattgcaaaccatataagtactgaaaacaacagaaaatgtttttgtccttagggtttatctcacaggggaaatacagtccaattattgtatttcaaagtctttcaggataattcctctctgtacttaagccaccaactcaatttatagtttagtttgtttcattctgcttttaatttttggactttaaaaaagttaatagtttattattttatttatttatttatttatttatttatttttgagacggagtcttgctctgtcacccaggctggagtgcagtggtgcagtcttggctcactgcaacctccatctcctgggttcaagcgattctcctgcctcagcctcccgaatagtttattatctaaactgttcgcatggttccgcagccaaagatggttatgtccagagaatgattattttgtatgactactctctctatcttcttttttccctactcttttccatcaccattttttaaagatgtttttttctttcccctttttatttcttgctttttaaaaaaagttttattttttagagcagttttagtttcacagcaaaactgagcagaaggtacagagttttctcatatatccagttcccccacatgaactagcaacatccccgacagggtgctgcatttgtttctgtgggtgaaactgcactgacaaaaaccaatcacccaaagtccagggtttatatttgggttcactctttgcgttgtgcattccatgggtttggacaaatgtataataataattattgctttttaatgtgagcaaacacatatgtgtatacagtgatatatttttaattttttttttcctcaaataagcaatagcatactctatacacttttcccaagcaagaggtcaaaggtggttttctaattatatggtatattgtaacttaatcatgatattgagttaaactgaatgggcctgtttatttagttattttgaaacgggtaattataaaaactgctgcataaatatttgagtcatattccaaaagagttagaaaatacatggatattcctgtcttatttttgctttaacaaacttggtctatttagtttacatgtatgctccgtcagtggttctcagccagggtgatttcattccccaagggatattcagcaggcagtgtctgcaggcgttgttgattgtcaccaatttaggcagggtgtggattgttgttaaacatcctacaacgcaggggacagctccacgacaaagaattaccgaaacgtctgtatgcccctggtgagaaacactgctcatgttcaaccaggtatttgagtcattattcctccctctagacctctccctcctccctaacttccttccttcgccgcttcctctcatcttccacgcaccctccccccagtctttttcagtaaaactaggtatttacatctaggactttaggaaaacatgaatcatttaaaatgaaacacatcaacgatatattctttattaccagtcttgtaaaaagagcaaaacagtttagcatttgaaagctctattgtagtttgctctggtataaatcatatgtgcagtcaaactttttttggaaagctaattctgctttatgatacaggtcccaagaagacagaattttattaggtgcatgcacatggaataccaacttcagggttgaaagtgactgaggttgatagtctctgtattggccgccctctgggcactgtggcttcagggttgaaagacaatcatttgcaggcgtgtgtaagtatatatggctggtgggcagagtggtggctttgctgctcttgcaaggctgttttgtcattgatggcacacaggagagtgctggaggttagtgtcagtttatcttatctctgtacttcctgttgcctcactttaggatcttaagaaatattcaatttccactaaaaagaggagtgaacaattcaatgttttgctgttttaagggtcatgtatgtaaatatggatgaatgggggcattggagcagggagcacatggggtattattggcaccggttgcagagagggcctggggacatgagtgtgtggcacagaacgcaggtgttcagatcggcagcgtctggactgagcctgggagctggaaggctggagatggtgcttttcttccttttgcatttggcaaggaagagtatcccgtagtttagtgttattccagaagctctcggcatcatgtttattccctttcttttttttcccttgtactttctcatacctctatcagataaattaaatgaattggaaaaataactaagcatttctctttgacgcaggtaaatgcagtatacatttgattccatggaaaggaaatatatataattagaacacttatagacattagtggtgacagttcacaggttagtctgccctctcaggagttgtcttgataaaataaattttattaagcatgttacttgtaagtgtcagcacttatctgtggttggttcagtacccctagctggggtgagtgtttgctgtgatgatggttacaagcatagtcttgcagaaatggatttagtcatcacagtcccttttttattttaactttatgtctctaagacataaaaatttattatcctttttaggcctttgactcacagtttgtaccaccatcttttctttcagcatctcccccacccacaagaaaaaagttgacattgatttctaatcctttctgtctggccaaattcaggatcttagaaaggacacccctatttcagctcctatactagtgttttaaggggaacctttaaaatgggattctgaagccttggctgatttttcttttctgcacaggaaataaccaatttgtgctatttctgggtggtgtgtgttgaactcacagttctaggaccggaagagactgccagccatgcggttccatattgtgcaatgcaagggcagaaatggtatccaggtctttctaagggggaaaaaaccagtatggccaagcagcaggctgccaggctgtgcgggctagcagaagggaggttcttaaattctctgcacccatgtgagggaggctgctctcttgacagcgtcttagggtcaggatggctggaatggagcgtggagcctggtctggttggagtccctgtgtggccttttggagatgagtatggtaacagtgaggcaggaagtggctggatttgcagcgactgtgtggagcctccctgtttaggcttagtgagctgatgcaaagtctttcgtaaccatgatcagttaaaacaaaacacctgatgttgtggcctcctgtcagcttttgtcctcctgtagaaacaagatgcttctagaaaaccagtttgtaaatttggcacagaaaaaaaaccctttcagcaatttggtgtggactctgcttgttaatttatggcttcgcaactttttttaagctaccggcactaacagcagatctttaagtgtttaatcgtcccaagtcaggtttgactgtgggctgactagctatagtgatctaatttggttcatttcctaggagaagaaaattataaccacatttttattaatttatggttttgatccatctattttagactcaatattaaatcatcccctacttccagaagatgtgtttttgaacataagtatctttaggatttaatattctatgaaaggagtaggagctaatgttcgcttgttgtaatgtttgttttcttctgatatgatgattttgttgaaaaaatgtatttgaaagagtaacgtgtaggtaagaaataagttagccaaaaccatacttcaagggaagcctccctcctatcctgggagcccggatagcctcactgtggcctcttgtttgtacatccagaatattcttgaaactgggttagctgagtcatttttttttcttctttcagtgttctccttttttctttttataaaatgaagagatctgtccacaagtctagcttttaacaatgagaaaaagcactgaattgtacactttaaacagtgaaccagtttggggtctggtttagagagaagaaataagggttaaaattgttttcatcttccatatctgattcatataatcagatatgaatagtgaagttccccaaagatacatgtaagcttggagtaaagacaaaatgtatgcattactttgatgggggaagcctgtggtgaacccactgaggttgctggtgattaagtttatgtggacggtgaatctcaacagaatgaaaataaactgtgggtgtctattttgaagcagatgaaccaggcagcaaagcagtagctgtggttcttcatagataaatacatttagggaaattaatacaaaatgttcttaccttatttttctgagttgttcaccgagcttcctcagatgttaacatcttaaccacagcacagttttgaaaatcaggaagttataccaggttgttgtcatcacactttctgatctccagtggtctgaaaggtgagaggtgatatcttagtatcattttagtgaagttcagatgtcccttttcatcagtttgaaggccttatattttcttacctggttttccttggcccacggttttcttggtgtgttggtcttttcttgtgtcaagtttatttaagaagctctcgctgtgtcctgtctgtccttcgtgtcctaagttgcaaatgttttctcctagctttttatttgtctttggaatctatctgtggtatattttatcatgtaagaaaattttttatgtttatgtagttgaattcatccctcttttatggtttctggaatttgagtcctaggtttaaaaaaaaaaaagttcttccttcagggttataaagggtgttttccatatgtccttctatacttttactttttcattgtaaatcttggatacctttggaatttatcctgttgtgggcgtgagatgtggctccagctttctttcagatggccaaccagagtaccccatggccatttattgagaaggctgtctcttccctggggacttgacttgagatagtgcctttatcatacactgaattcccagaggcctctgggtctgtttcccatgttcctgcttcctagtgtttcgttagtctgtctatctgccacaccaaacacgagctgatgagttatttgaaaacttcctattttaaagcagaaaaacaaaacggaataccactatatgaaagcctataaaaagctaattaccatgtttacataaatggtacaatagcagcccagaggtcactgggttgttttggcatggagggatgcttccctctacctcaagcctaaaagtggttaagatagatccatttcaagaagccattggtccttacctggccttcccctccgccatcttgccactatgttcttggctatggagacaggatcagggaatttgattgaaaatcattaatgacataacttttttttttaacagtgagagaaacactcaaacactacattttgcaaagtttgtaagaatccctcccaagagtttcctttggtcagcgtagcttctggtaataaggaaatctgtcatttggaaacaccatctttgttcatgtggtatcattagatgtgtctttgcaccagcatttgacagagaccatgacagttttcctcctgagcccttactttgtgagaagagagggtcagtgcagccatgtagcctggctgcaccgtatagtctggctctccctggtctccggcacgggggccacatgcccagggtgaacaccaaggaagggatcctgagtccccaggctccggttccaactgcacaccttgttctctgtcctccctgtgcacgccacctaattctctgctgtgaacggggtaatgaggtgttgtcttgttgtaaagattgattgagatagtgcataaagagggcctagtctggtctgtggtacccaggatagggttggtaaatgattgccattagcattcatctgtttcctttcctctttagagcatgaaattctgaggtgcacagttcctgagctttaaacttgagtgctggaggccaaggaaaatagaatacaattcaggattacgtaagagtggcatatgtgtgtgtgattagcccatagaaggcggaaacccagctgacatggggttagtctcaaagttctactaaggcctaagaacaagaaacattcatcctgtttttggtctgtttgagataaatggaccgagagagtgggtttggtgcttggtttctgatgggaccagttgcaggagcacagttgatcaactgtcatgaacgtctgtgttttgttttgtttgttaaaaagaagaatcttgaaagtagaggcttcagaacaaatgtcgtgaagaaggaattgaagctcaacatgggaaaaagtgagtgggagagcaccttgctgcttttcaatccaagctcgaggttccatgggattacatgcctgtccaggtggttggcagaagcccctttagtattctttgaggggtcttgaaggagaggagaagtgtcagaagattggagacaggcaaatgttctaattttctaaacgcagaaaaaagcagaagcagggaagagatacttaaacaggttactgaatggaggtgaaagctgggcgtgctgagcccgtcagcatttgttctctttgatgcagtgtggcttgatgtctgcagggtgtctggtgaggttggaccctcttaggtgagtgtcccataaatctgtggtgttaatatgcctccttaccctgggacctcccctccaaccctgctcactggctagaggcctgccgggctgtcatctccttggggacaggactgtgatcatttgcccccttgttggacgtcattgtagggatcccccagccccagcccttacgtctgttgaccagctcactcggcttgcctccccccttccccatgtcatcgtgtgcaccagcacgtggttgagggatgtgcttttttcttttttttttttctcctcacagtctatttacacaaaaccagtgcacaacgttaacagataagaagaaagactgagggacaaagcatgacagagacctttgtcacgtgctggctgtagcagtcgagtgaggagaggggcccatggcacaaggaaagctggagttagggggagggatggtctgacctgcatccgcattgtcttgctgcctcctgcttggcttcttacctaccctgtgagagcagcctcgggattgttctttggcaggctcatctcaagggctgggtgtttggggacagagtggccctcggctcagtccctttaataatgagagtcattttcgtgtccactcgggggaacaaagtgacattttctgtgagtgtgcaccaaaagcacatgggactttacagggcgctttttagagtatctggctctagagttagtcgtcttgctgagagaaagtgatggagctggcattgcattccaaagccagtgtgcattcaccagctcaggctgcaggcccatctccctgcatggagaactgttttgtagattggtagcgattggacagccatgccctgtcacctgctggttcagtgctcctccaggaaggcctcaactgcctactgcctttgaccatgatttgtacagcagcttggatgaagagctggaaacctgcttatcagatttgcagacgatgcatggttagagcaatggggaccatctgggagtgagccaggatttaggactcttgagaagctgaacaatggacggaaactgatgtgatgaagtggaacgggaagatgtgcacacaccctctacctgtactcagaaatcacttgctcaaatgtggtgtgggaggctgggcccactgtgcagggatggtgctgtctgcagaggcatccttaacatgcctttagcatttgcatttccattttccatggacatctgtcttagtctgtttgcattactgtaaaggaatacttgaggctgggtcatttataaagaaaagggtttatttggttcacggttctgcaggaggtacaggaagcatggtgccagcatctacttctggtgaggacctcaagctgctttccactcatggcagaaggtgaagggggccgatgggtagagatcccatggcgagaacacggaagcaagagagagaggagggatgtgccaggctctttttaaccatcacttcttacaggaactaaatagagtgagaacccactcatcaccacgaggaaggcaccatgcatgagggatccgccctcgcgatgcagacacctcccttaaagccccacctccaacactggggatcagatttcaacatgagaaggagtcagatattcaaacggtagcaacatccttgtttgcccccatgtgtcacatacatgggccatggatgatgactgatcatctggaattccccttttttgtcgcttgccacccagttgtctgtttcatctgctgctttctcgggggtgaggtggtgtcagtgatgtctgttgtgtgtatagcaccaagcacagtgctagcaggggttcagtaaatacttgttggatgaattaacttgaagtctttctagaagagagcaatattgggatggtgaggtttagcaaaccttgttgtcatttttcaaattgatggttttccttagagaagagattatagttcccctagctttgaaggtcagtcttgggaaagcaaggttaggcttattttctactgtatcacaaattagtttttatctaagatagttgttaatataaacatttattctgcttgtctccatcaaatttttaaattctaaggcagatattttagatagcacacatgtgttttagaagttacctagaaaagtttagctgctgttttttataggcacgttttcttgcagcagatatcataaataggcactgctatgtagtctcctatttgactttgaactctaattaggctgagctccttaagaagggccacttctgtgctgtgccttatgtatgtacagcatttgcacacagcagttgtgcaatacattttcattgaatacgtgtgactgatttcattctaccaacaaggtgactgctattgtctccaaggaaacctagtttctgaggttaattagcagccttcaatttctacagctaggaaagtgcggaactggcattagcatccagtttcaaagcaagtcctcatgcccctgcatcatgtgcagagacattgccagcttcacacccaggttagtcgtctttcacacttgtggtccagttatgagggtttagagaataaggctttctggaattggctcttcttcagtttctcttattttctctagagtagtgattctgaatggggctgggcctcataaccacctagaagcttttataaactgcagatgttctaattaagtaggtctcaggtagggtccgtttggaatgaatagtcagcccagagtctttctgtttctggaatatgtggttaaaacagtcctggttctggctgttgcatgaaagctgaggataccatgtgccttgtgagttgtgaatctgagtcatggattgcaagacagaggagtaaattaacacgttgagtgcatctctgccatccctctccctctcagttaggttttggctttgcttgcccattttttacggggcaaattatatacatagaggcagtggcgactctcaggatttactaatttcaagggtgtactctgtaaggggttggttgagtaaaattttgagtctagagaaagcttgagatgttttctgggcctgtttcctcactgcacaaaatttcattgtgaagctgaagttgatcatttcaaaatgtgtgtaaatgaacggaccagcgcttttctttgatgtttgcactggatgaggattatctgagaagacctggtggacgagaaaatgggtttgactttttgccagatggtcactgaatgtcttttctgtctttgtgcccagttaaaaggctaggcatgtaggttttcatgctcttgtctggttttggctttggaagtgcttacacagctaatctggcatttatgatgatttccactttgagctcagcaggaggctctttggggatattcagacagaaatggcttaattggatttcagcccagacacagtatttgaatggctttatggatggcattaattgggcagctgccataggaagtcatatatatgctcctgagctttagaatttagaattactctttgattctgtccctcttcattgactgcttgcaaatttatttattgaatgaaatactcaagaaaactaaacttatagccttgaaattaagaaatatgatatgtaagaaccattgtttggttttggcataggtatgttattatctgtatttaaggctccacgttgatattcatggcctggcctagaggcacagtggtgttagggattcagtgtgtcttagattgcaaactgggggacaaggattcaatcagggcctaacatggcactaactgctgcagggtactggatagtcacagctgatcttatagatggaactaaggaagtggaagtttattgaaccataaatgggggagaagagtcattttatccagagcctgccatgggcctccccatatgggtatcaggacatgaaaaagttgcagtcccttcccagaggctcttcctatctggacagttttgtaaatgacagttgatattataaaatagtgctttttatgggcacggaggccggtctcctagaagagagcacgtttgagttccttcctgaatggtgagttggatttgattgcacgatggcattgggaagctgaggtgcaaagatgttcccagtacggggaggaaatagcagacgcgagggcaaagagttatgaaagggtccagcgtttgaggagaatgtggatgaacataccttgaccattttaggaatatttaaaaactaattgtactttaagaactaagtattcttaaagctaaacatactttaaaaacacagtgatagtaaaatttctatttaattggaataataataaatttgttttctataagttaaatttttataactattagccttttaaaatttcatttatttttaaaattaaacattttaaattaaatttcccgaacttactcataaccaaaattttgtacccatccaccaaaatccccccattttccctaccttccagcccctgttaactaccgttctactctctatttccatgaatttgacttctttagattccacatataaatgagatcattcagtatatgtctttctgtacctggcttacttcagttagcatgatgtcctcccagttcatctgcgttattgcaaatggcaggatttccctttttaggattgaataatattcttgtgtgtgtatatatatagggtaagaattccttaacccgaatacctggaaccagaaatgtttcagggtttggatttttccagattttggaatatttgcataaacataacgagaggttttggggatggagccaagtccaaacatgtaattcatttatgtttcacgtacaccttatatacatagcctgcaggtaattttattttttttcttgggggtgctgggtaaactgtgttgtgtgcctgcgttttgactgtggcccttcccatgaagttaggtgtcgaattttttacttgcagcatcatgttagtgctcaaaaattatcagattttggagcaatttgtattttgtatttttagattagggatgctcagccttgtatatgtatgtgtgtgtgtgcttgtgtatgtgtacatatcacacatatcacattttctttctttttttttttttttttgagacagagtctcactctgtcgcccagtctgcagtgcagtggcacgatctctgctcactgcaagctccgcctcccgggttcacgccattctcctgcctcagcctcccgagtagctgggactacaggcacccaccaccacgtccggctaactttttgtatttttagtagagacggggtttcaccgtgttacccaggatggtctcgatctcttgacctcgtgatccaccccgcgttggcctcccaaagtgctgggattacaggcgtgagccaccactcccggccacatatattctcttcattcatcagtggacacttagattgtttccatatctttattagccacttttaaatggaaaattttaaatttcctttttattccacatttgatggaattttatggaattcatttatgggacactgtaatatctatgtgaatatctgctacttaatgagggaaaaaaaatcacgttgattcagtgcttatcagaggaagaggataacatgcagtgcggtattttcagtttcttagaagcaaatcccattccatagggggcttcgcagttaccagtaatttacaaaattaaaaaaaacccaaccaaccatcctacagaatctttctgaacctttttctccagagtttctttgttctctacacttgcaggtacttctcagatgcccgtggtcatggggtgatcttagtctttcttagcccatccctttgtctaattgctgtaagacatcctatcccacaccctcatgctgaagagtcctattgtgacttttcaaatgacccgtgatgtaatgtggaatgaaggtagagtctgagtaacacttggaatccctggagtactaaagtttgtatcagcccttgtagcctgctccctggaggacccagctgcctaatcctgagttcattagaacctgggccctgaccggaacagctcactctgggtgttactgtcctgtgacgcacctgcgtgggaagggccgccctcgcagacatcatgttctctctaagattcataggtggttctaaaatcacacccaggtgctctcctcgaagggcaggggaaataaaggttttgaggtttctgatttgattaattctgggctatgggaaagccctccgatttatatatgacaatacaagttgttctttgtagaaataaaaagtgcaaattttccttcctagggaaaaaattatttagtagcatacagctgatatctatgtaatttgagaagtgtaaaaatggcattatgtttctcaatagggtcacttggggacataaaatgcctccttcctagggtggtgtgagggtgaccatcagtgacaccagcctcttggagttggagtcacgctgggcagcccttgagcccctgcggaggctgatctgacccacaaggtagttgtttttttcaacctctctccttttttttttctcttttcttttttccttccttccttccttccttctttccttccttccttccttccctccctccctcccttctctccctccctccctcccttctctctctccctccctcccttctatctctccctccctccctcccttctatctctccctccctccctccctcccttctctctatctctccctccctcccttctctctatctctctctctttctgtctctctctgtctctgatgaagtctccctctgttgccaggctggagtgcagtgtgcgatctcagctcactttagcctccgcctcctgggttcaagccattctcctgccttagcctcttgagtagccgggactacaggtgtgtaccgctatgcccagctagtttttgtatttttggtagagacagggtttcaccatgttggccaggatggtcttgatctgacctcatgatccacccaccttggcctcccaaagtgctgggattacaggcgtgagccactgtgcctggcctctttctttgtttcttaagaaaagaacattacatcattcaatgcttaagatgattttgtaactttcagccttaaattttcatataccttattccagttggaaaagtagaatgaggcttttcctttcttctggaaagtcttcaaaagggccatggaccctgtagaaaatcccatttgaaaatgacagcctggaaagagctaaggacaagggctggactccctgatacattagcacctctaacttgtttcatttactaaatcacggattaatcgggtggttctcagtgccaagcacatagtcagtgctggatccctgctcttgagaaaggatctttcatcgaaggagcccccaggagtaaccaccagtttactacaaatgccagggctggggagcacgtgaaaaacaccagagggatggagtgccacgtgactgcagggtggatcacccagcgtcttcaatgcattgtcattaaaataaaatcgacttaaagtggcctaagagaaaaattgtaatttgtggacatgacttggatcctgattcaagtaaatcagctacagaaagtcacttatgagacaggaaaatcgggacactaatgagatatgagctttatattaaggaattggtaatgatgtggggtgtgatactgaagttgtgctgatctgttggtgataagcactgaagtgtttgtgggcaaactaatttttgcttgtgatttgctttagccatcttgtgagggctggggtgtgactgcatgtacaattgttgagattggatgagaaagtatttttacatatagtgaaacatcacaattcaaatgcaaaatggcatggctatgttacaatgtgatgcaggagcttggcccaggaagccagctgtagtgcttaaactgggttttgaagaatgaataggtgttgaaaatggaagaatcagttctttctggtgtgcaagaggagatacttggtaggcaaagtgtgggtcacctggtggttttgacctcgagttctttcaattcactcatccttgcatttgctcacacaaggtttttcaagttcctgttgcgtgtgtcatatgtcgtgacacatatgtatggttgagtctcacaaaagtcccaggctgccatgggaaagtaccacagactgaggggcttacacagcaatttatgccctcacagttctgaaggctggaagtccaagatcaagggctcagcagggttggtttcttctggggcctttctccagcgcttgcagacagatgccttcttgctgtgtcttcataaggtcttttcaacgtgcacaccctcctggtatctcttcctctcttaaaaggccagcagtcctattggattagggtccctgattcattttaaccacctctttaaagaccttttcactgtcacattatgaagtactgggtgttgagacttcaacatatgaatttttttggaggtagggcaaggacacaatttagcccatagcagatgggatgcacttcatggtgtaatcagtactatataagcacttatgacttattcacagaataatgagtactgtctaagatgctaagggaacttggagggaagagcgtttaactgtccatggagccatccaggaggtcttcctggaggaggggcttttgaagagcttcttgaatgagagatcttacctcacccactgagcactgctagaagaagagggagtggtggaaggcagttcccaacactgagggggagagggcaggcagggaagggagcgagcgggactctgttagtagtggagggctgtgatgtcagaatgggcctgaaaggagagtgggtgctgaggtctcattcagtggcagggccagggctgagagggagggagaaagagcacacacatccccactcttcattcctgggcctcagcttagcagaggatgcagtgatagaaacagggaaaggagtgtggaattttatctaaagctgtgcttaattaccaaagtaaaacatattataaaagttcagatgttatagaaattaacccttctcacccccgattctactccctaaaagtgttaataatagttgtgtctcaccttctggcccgcttcttaagatgctatttgaaaaaaacaaaagtgtgtgtgtgtgagagagagagcgagcgagcaagcacacaagcaagctggcagtagagggagggagagagagaaaaacaggatttgctttcctgactcctcactcttccctccctctttccttccttcagaaaaaggggggtttgcacagtttttattcagtatgcattttagtgtttacagtttatttttgtcagcatgctttttactggtgttgtcactacctagacaatggctgaatcctgtgcatgcttaataaaatgctggtgaacctgttaaaaaggcaatatgtaattaaattgtctagttatggcactgagatgtatagcaaggtttttatgttgattacaaagacaagtagcagtttggactagaggaaaaaccttagagaaacacctgggcagaccttttagagaatggagtactgctggatttaagaggctagcattaaatatatcaagaaaaccctttacaaaccttgtcacaaatttacaaaatttgtcactaatcgaattcctatatgttagaatttttaggcagcagactgtaaatcttaaatttatattaatatttgcccggctatgggccaggtgcagtggctcacacctgtaatctcagcactttgggaggcccaggtgggcggatcatgaggtcaagagattgagaccatcctggccaacatggtgaaaccccgtctctactaaaaatacaaaaaagtagctgggtgtggtggggtgtgcctgtagtcccagctactcgggaggctgaggtaagagaatcacttgaacctaggaggcagaggttgcagtgagccgagattgcaccactgcactccagcctggtgacagagtgcaaaaaaaaaaaaaaatgcattatggctttcttctattattttagtaagctttgatacatttttggcaccacatcatcaatttttgataatgtccattcccatatgtcccaaagatataggattggagttgagtggggtggtggatgagggaacagagaggcatttggtggccaagttaggcctacagccctgtcatcctgacccatggccttgttgcttccttttctggctgtaatttgcttctcattatatatggatgatgtagggtaaacacacctgccagcaataacttaagcagacccttagaatgaccttgtgtggcagacgtacctgaatgtgtgttcccagctagggaatccagaagttgccagcctggagattcagtccttgtctttaaggagcatctgagtccctgcagcttgtctcgtggaacaggtgtgattgaggccctgagttttgggttgcatgaaggatgccaggtggaggtcctttgtcagggagtgtgttcagtgaaaatgctacatgaattgcatgatgcttgcaggcgggtgcgggtctcctgtccagcccgctgccactggactctctcccttctctgtaagcccctaataaaaccctggctggctctggatctcttcagcctcttgaacctggtgcctcccctagtacagttaataggggtttggcccatcgattgacctactgcttgctatttccttcttttctcagttctggagtatttgaaggcagaaatcattattccagaacctagaactgacagaccttaaactctaatcagtcacttttctcctgcaaacacctgccttggccactctttggctttctagagaattagaaattagttctgttttttccctcgtgttttcattaatcagcttctaattaacctactaaccagcattaatatatggaattgatataatttcagcctagtgcagaaaaacttgatacttttacttttcaggacagctttatcttgagtgaaaaatctaattgcagtgaggctttttgaagctgcttcagctgtttctaaaccctgcctgggaaccactgtgcactggatgattaagagacagctgaggtcatctccttggacacctttgagtttcggattgataaacacatctaagctgctcagtatcagtccacatgggttgaactttggccaaaccactcaaagaaacttgtgtagctttgttcagtatctgaaaccagccttttcccacttgaataaggttctcttccaagtggttcactaggaatgaaatatagctagctctgccagaattccctcagacagcgctgaccccgtgctgtgttgggctggcactgccgcctccgtactctgaacgggagatccgcttgcaggcctctgctgggcctccttggtcagggagggaggagggaagggtaagacaaggcatttgagagctccgaggcctatgctaatccatgcttttttgtttttctttttaaataaaaggaaaaggacaattgccttagctctggctacagactagggatctggagtggttctctccatgtgtaacacagattagatttggttatgatacacacccgagtccaacatctgctcattactgacccagccaggtgacactattcaacaaggctttttttttttttttccctcctgtgctaacatctaagagaagcagtaccgttgaaaacaaacttggtgtgtgtacattcatgggcttgcttcttgatgtagcctgacatggttcctagctgatttgagaggttggagccggccacccagggtggcagataccccagacagatggcatcagcagatgcgatttgcagaatgcgactgtcaaggttctagccctttcgtggtgatctttgtcaggagaaggagcactctggctttaaaatcagacaagtgtgcattcaaattctggttgtgagacatctggtcatttggttcctgggctgaatgataagatgtatctcccagggttgctgtgacgattcttgcagctgatgctaaggtgaagccacggcgagtgtctcactggaatcagaacatgttcttctcccagcctgtcaccgtttctatcatttggacagtgggagaggagggattccctgagcctcctgaaggctgactttagtctcttggtgacttcagttttctggacaaataggccacctcaaaaacaggttgagtgacagcacccagtggtattatgtccacaaagctcacagccttgggctgtcatcagaacaaggctcataactcccttcttaaccctgaactgctcctctggagttgccttagtcagggacctcatcactggacttccctctcagatgctgatagttggaggaaaccagcccaggtgcagcagaagacactgcgccagcaccacacaggcattggggatgcagaatcggccacgactgcttgcaggggggcatctcactgcctggccctgcgcctgggacaagtagtgtggcctggcagtgctcagcacactcgcccaacactgcagctaagtgctgctgaaaacactggaaaaccctgggttgtggctttagtggaaaaaaagcaaattttaaggttacagagaattcagataatcccttggattttgcagtggtaaaattttgtagtattaaggatccacattaaaatgaagagatacgtacggtatcagtgttaattgccttccagccctccctcctttatttctaaagggagatgcacgtagtgctagtgaagtacttttagagaaaagcacacactccttctgtatattcctgtcctgaagctggctgtagaaaatccttgaatcctttggtgagggccttctacagtccaagtgaccgtataggtgtttatctttcaggctgatactgttttttgcacaaaagtgtatactttcctgatggatttcgatcactgattataattaagacctgctttgaaatgctcttccttaacacaggttttgaataagctaagagccccatgttaaacttgggcagtcttcatttaaacccagagagagagatgttgaccaccatgttttattctacttagggtgtacacttaacacattgacagtttgtcagtggaatgcttttctcaaggaaaacatcgcatgcaaccttcacgttttacacttgaatcccagatggccactggcacctttcaatggattttcagtagcctcacttttgttggagctgctgcattagttcaagtcctgctccgttctgtctggcttttcctttactgattgtgcttggagaggccgtgttctgacttgcccactgtgcctagtatcaaaggactcaagttctaaatccagctcattgttcttttgcggggtctggtagagaagctgctcaggcttttggtttgctgttggcataaggagtctctcctctgttcgcatgcagaagagattagagatgtgcaaagcccactcatccggagtccaaggcctaagtgattcctcactctccagtcggttgggaaaaacctttagtgtcgctgagaaagtgaactcctctgtacatttgggcattagaatccatcctggcagtgtatcagaaggattaaatcatattactcatgagacacagggcacacaggggggaggcctgtatttggacagcccaaacaaccgcataaaacaattccttgcatttgcctgtggaaggcagactctgggcaaattcacttcccagttaaaatcttaacaacacaacttaacgtttataatagcccctgaaaatgacacatacagaggtggtgtttggggcatggtacccagcacattgccctttgctgatgttcagtggtgtcagcatgagaaacaagaactcttggtcaagaactgagttcagattccaatacttccatctcgagaggacctgtcattttattataaacacttaacagagagaagggcaatctgcctagtatacgtttgaacttcttgcccaaagatgtattcccactgtgtttggccatcaccttttccttgccttaaattatatctgtattaaaatgatgcggcctttaaaacagtgctagagaatacataaaaaggaattaatttttaaatcaaaatttatgaacttgccttataacatttttatgatagccctatttgaattatcttcttatctttgactaaaatagaattcgatttttctatggggtatttaacattttggatcataatcatgctagggatgaattaatagatcttctgtgagtgaactgtcaagacagatccccattgggtttgaaatgtaattaaaaatgtcagtgaactcacttgaagtccacagagtgctccagggtcccctcgaaaacgttagtcaaggactgaaaatacttaccaagtgcagtgaacataacgcagctgccagctctccacaaccaggagggcgctggtcacctttgtcaggtgcctctcatcttaacttccttctagttttggagtgttcgtctcagaagtcttgaaactaggggtgctttttagcccaaggctatgggtccggttggtggcttctcaacaaatggctggtgcaacagacctccaagagaggaacgagtctctaaacaatatccatgccctttgtaacccttctccgtcattagactctcagactggccacctttccaatgggcagactcccttttatttctgggaggcttttaaaggtggggctcattgggaggaggaagtctggaagggactgggagctcaggtcccttgattatgggctggctgttcccccacaccccatcacctccttccacctgctgttcaccgggtgtgtggttggccctccccaacccgagtgtcggagcttgcccagggaatgaaaggtgggaagagggagtacatgtgtgttgatggaggtctttaggcacagagcagctttaatctgggatatatttaaaacattggtttcaaaatacataaaattagccaggggtggtggcatgcctgtggtcccagctaatggggagacttaggcaggaggatcacttgagctcaggaggtgcaagttgccgtgaagtaagatcgtacaaccacactccagcctgggtgacagaggagaccctgtctcaaaaaaataaataaataacaaaaaaacccattagttttaggcaaataaataaccagttatttttaaaagtggttacttaaaatcaaagaagcaagcagacctaatatatgcttctttctttttagatttcatgtgttctttgtatacaagcgacgtcccagattataattctctgctgagatttgagttggatttgaggatttggagaatccctgcagctttgtaacttcagaggtgtaattagctgaaaacatcatcgttttgaagagttctgcgttttgccagtcacctctcaactgtgtgccaaaggtaagtctgcagttttctgcttaaaacagaagttgcagctttttgcttcaaatgcttaatttggacagtaagtttagtaaaatatcagtcagtgtagccttgatttgttgaatcacattaaatttaagctttcaatgagggagaaaattagattatctctgttcctgctttagtgtgtgatggttctgagtatgtagccaggaagcaggatggtagacacctacaacctgtaagatggtacaggtacctccacactcagatattactgactcttgaatccataacgaatcctggtccctgtattctgtatgggacagggagtataaggataaataaccacttttctggtgctttcagtctaggaaaagttggattccagctttgatgctgagaagataaatctgtgtcaaaggatagctgggcatggtggcgtgcacatgtagtctcagctattcgggaggctgaggcaggagaattacttgaacctgggaggcggaggttgcagtgagccaaggtcacaccactgcactccagcctgggcaacacggcaagacttggtctcaaaaaaaaaaaaaaacctacatcaaatgagatgcagacagatgaaggattctcaggaaggttttacctgttcatatgaaaaacctacttgtgtatgttacaataaaatcataactgtgatgcaacatgtggattctgggacccagtggtgctatcaccacaggcaccagacaaaaacatgtcactgtgcaacaaaaatatttcttagccctaacatcttaagacatttaacttaaaatatgaattgctgtttgtagtccagttaatccggtgttctctttctggctgggcagtaagaagtgctttatgagaagacacattttcacctccagagctttgtctcagaatgaactgcaagaataacactagctttccttaaaaacttttaatttgctcaaaaaaatttacaagaaaaaaaacaaccccatcaacaagtgggcaaaggatatgaacagacactgctcaaaagaagacatttatgcagccaaaaggcacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttgcactgttggtgggactgtaaactagttcaaccattgtggaagacagtgtggcgattcctcagggatctagaactagaaataccatttgacccagccatcccattactgggtatatacccaaaggaatataaatcatgctgctataaagacacatgcacacgtatgtttattgcagcactactcataatagcaaagacttggaaccaacccaaatgtccaacaatgatggactgattaagaaaatgtggcacatatacaccatgaaatactatgcagccataaaaagtgatgagttcatgtcctttgtagggacatggatgaagctggaaaccatcattctcagcaaactatcgcaaggacaaaaaaccaaacactgcatgttctaactcataggtgggaattgaacaatgagaacacttggacacaggaaggggaacaccacacactggggcctgttttggggtggggggaggggggagggatagcattaggagatatacctaatgtaaatgacgagttaacgggtgcagcacaccaacatggcacatgtatacatatataacaaacctgcacgttttgcacatgtaccctagaacttaaaagtataataaaaatatatatatataaaaagattttattccttatactgtaagatttttcctgtacatcttactatcagcttataagaaatatatatttacaacatggtatatttaacagaacaaaatagaaaagattgttaaatcaagtatgaaagcaaaccaaattttaatcaaagcataacctaaattagttttggtgtccaacttttaggtgatatgtcttctggttgtatgaagagcaaatgagaatattacagtggacatttgtataaaaaaactttaatttgcttctattatttgcagattgttttaaagtaatcttgaaactatcatgttggactatggaatcttttggtgtggtggtttctggaaattttctcctttaatattaaaagttagaatttcctcttacttggtctgctactactacaaacacatcttgtgaatatgttctttctcttcgaccaccttaaaagaaaaatctcttggaaccttttcaatttcagttatgcccctttgatgtgtggtatttagaacagcataagattaatatgcaataaggataggattaagtgtcttagtgttctcgtcgtgttacgctttatgttatcttttggagaaaatgccatattgtcccgttgatttagggtgttgtgtgttgtgatttccagagctagctcctggtcggcagtcgggggttggcactcacactgcatacctgacttcaccccagccattgttggctcttctagctttgggtcccctcatgcattcatagggcattcccaggtctctcttccagaccttgtgcaagacagacaccatcggggtgttcctgttccaaacctaggaggtttatcttacataagaaaacttctcaaacccatggtaactccgttttctttaaaaaaaaaaaaaaaaagtcattggggtagaactttttaaaacagtcatttgcaaatgcagtcatgtatcaatccacttgtcagatttcaagggaatggagtataagctagaaatgacagatcttctgattggatcatcagaactcattaataatttattagcatcagagtctgtcactacttctttagaaaggtcttgatcgtcagtgacattagcagacctgaagctgttgttggtgctggttgagaaggtggtgaggcaggggagtgtggcatgctcacccagcagctcagtctgcaggagctcccaacacacgggtgccacgtagacaagacggtacatggagaccatgagagctggctggcttacaaaaatatctacccatgtaattttaaaggattacttttatttcataagtttataagttccacacaaaaccttgattcacctattaaaatttacttttgtggtttagaaaaatgttcatttggaaaatcgtgagatgtagccattcatataataaacatctattgtgaacaccccacctgtattttgggctatttttcttgcagtgactgttttagcagttaaaaaaaaatagataaaatatagtcccagccaccttttcccatgccctttcaggatgggaccctgacagtttgggactgtgctaactgctgtagtggaggttcttacagccagtccctaatacttgaggcagggatcaactgaccctttaggggacagtatggaaaagccaggagatgttacgttgggaataagttttaaagaatgaggagacgtgtacagaggtataatgtgtttccttggaacagggcaggctgattggaccagctgggccatggttcctggagactgcaggtcattcagacaatactggcttggggaccaggcatttgccatttggtcggtggtccttgaagtgccaacagggaaagcaacagctcggtcagccatacacttcggcatgtcagaaagaagtgaaataaatgctggcctggtagaacagtaagcgggatgtcagccttggatgcatttcccagttattggacactcaaggtttgcgtgcctggggctgggctgagagcagcttgaggaggatggcggtgtctgagggcttgagtaacgtctcagcccatttccacgtggtgcatttccctaccctgttttctggtctccccattgaagttaaggaacaaagtcttgggaccctgcggctctgaccctgccttctttgggggagcggagaccataggaagagccagaaggccaccagagttgtcattttggcaaacgcataatctgcacttaattcttcccgtgtgtacttgaaaagtgactgtaattgattgttggaggctggccattactagggacggaagatgcaaagggccttgtctgctatgctgcagattcgtttgacttttgaaaagcttttggaggctttttcatgacagacatgtcctaatggacagaaggatggtgtagtgggataggaaggacagtggcttagatgacacaactcaagtttgagtaaacaggacgggatttcacaaaccgagtcagttggtgatgtgcatgtccagcgtgtaaatgtcagcagtgagcctacacacatcttttccattttgtgatagaagcagcagcagctgtgtttaactgagcagtgagcatgagaagatgaaacattgagcctgtcactcttacatccataaaaacgctatccagtaatatttatttaactactaaagtttactacttcatattatcctcaatttatttcagaacaatttttcctagggtgtgtacacttggaaaagtcatctggaatttactactcacttttatcatatcctggttgtttggtattttggagattgctggtagctgactttgcccccaacaggttatttagaaagattttttacacgcaaagcccagtgctcagtcattaagattttagggctaaagcttctgttgagggtgtagctctggaggtctcatgatacctggaagtaacttgtggagtttccgcccaaataaatgggcccatctcagcctccttctgccgcactctggacccctgggtgatctgggggaacagtctctgcagtttggactgattgtttcttctgtacagtgtaccgaatataaagagatggccacagcctttaatgctgcggataaatctgtggtaattggttaaataattgcccagtaagtattgacagctgctgggaaaacattgccacattgattccacagtgccccggtggtgcagtcagtggaagcagctgtaatctatggggtcatcgttggcaggtgcccggcacagggcttgtcactgcttgtatattatctctagtcgcaaatgccagatgttattgcccccatttaatagatggggacaccaaagcctcaggagaggttaaggagacctgtccacagctgtgcatgctnnnnnnnnnnnnnnnnnnnncaggaggagcgcgagctgctagtcgcaaatgcacatgttattgcccccatctattaacagcagcccgggaagcagaaggtctgttgcttaccagcccacgttccttctgcttcccgggctgctgtctctgacacatgatggtggtgacatggtaacgacccattctccaagtgcttaccttaaactgaaatgtgaggctctgggagattaaatgacttggccggggctcctaggtggcagagcaggctgggagctcccatttcctgacccaaaaaagcctttctttcttactgtaccaggaatttcgtgagatttatttttttctcccctagaaaaatctcctgcaactaagtgcagtttggagagttctttggaaacgtaagggtgtgtgaaggaagactttgggaggtttgagaagggggcaccagctgggaacctgaatcccccgagggcctctgctgctcctgaagcaccaggatcagcttaacagctcctgtggcttccagctccacccatggaggcccaggatggtgctcagagtcgccttgtgttggggatccccagcttaacatcagacctgccaaaagagaagttctctgtacaggccaggggactttgtatttaacagccacttcctgtgtgctgaggccatctctaaggtccctgacgcttcccacagcgcccctgttcagggcgaaacatcataaaattgtgatttaacgttcttgcatagtcaataacataattattttctcttagttgtggtggtgatcaaggttatgccaagcattttttcttttctgtcatagctgatacaccctagcagtgtggcttcctagaaagctgaagaaacaaaaacaaaaaagccaattctgtacccctcgaccttcttttccttagatagaaactgaatacataacattccattcatttttcagtgattctctgaattgtaccttagaatttacaaaggaattttcgtgaattctctttaatgccaggtgatatggatagtcctcccctgaattgtatagcagaaaatgagcccagagaggttactttccttgcctagtacggcccagcgttggatggtgacctgtgtctcacacctgaatgttggattccagatactctgtccttgtccttaagaggccctgggccggccgtgtggcggatgtgtatgtaagagaacagcattaaataaacaggccacacagagcttgaaatgagcgcattgctgcagttgaggttctcaaactaggaaaagcagagagaaatttttcttgacttcctccagaaaaacaaaaagtcctctcatgctgtgtgtgtgtgtgtgtgtgtgtgtgtgtgtgtgtgtgtgtcacaatggagggggtgttgtagggcttttagtaaactggaccttgaacaggtaattacaaacaagccccagtaggagaatactttctgggattaccactgggatgtacagaactgaagggaacacgtggaactgcagaagtgtcattcaagttgggcgtgtctggtggagggtgtgggaggggagtgtgtcccagtgcccttgtgctccccattcccgtgctgcaggtgcctcactggacacaccaaaagcattttgagtttgagatttctgcctatcagaatcaattttccggttgacttttattataactaacgttgaaatggtttctttagaaatgttcctggctccaggatgtcaaaatggttataaaacatgatgaataaatcagatcataagaggtcacagtttatggggaatgaattctgggaccatgttaacaaagagtatattaacaagatgccagttttggatggaaacgaataacccttagtgcttgttggggcagaaggtacccaggccttcctgtaaggtccgtggccatggaggcaggccttgtatctccctggaaagtaaaatatgccttctcagcttctcagagtcacacctgaccaacagtcacactgacaagttaattggtgagatttgagcttgattgctgcctgcaagcagtaaggatgatcctaattatgaatctgctctggctgtttcgtgatcaaacgccttgttccgtgaccttcccgtgtgaaggtctacccaggtcacagtgtgaacaacccatggtccggagcagtccctggccggcgtgaactccaagtcaggagtctgcagtggtgacgtccctcttgagtgtcctcaggtaggctctcccttacagggatgtggccagggacagggagaggctctagagttgacgtttttagtagtttttctaaattgtttatcttttttgccaacattccattttgggttttgcttgtgattgttaccttatttcacatgtgtgagtgccccctccctttattgaccacatagcagaatgccccgtctgtaaatgtcacgtttccatagagtactgctttccacttgggcccctgacggtgctcacagggaatgagtgggaaatgcagcagatctgacagtgagagcccagtcactcctcagtcagacttgttttatttagtgccttccggaatatgccacttatgatcttacccagaggttatgttgaagattttgttgtgttcacaaagaccaacgtcagaagtacttgggaaaggcagggatcccaggagccagagacaggactgtcttccctgcctggagtctgggtctggtacaggcctttcttgtgggagaagctaaatgtaaccgtatcttccaacctgagagctcatttagtaacgtttttgtaatacattggtcattttcccagtcgttaagtaccacgtctcggcggcgtgtgcttagaacagaggtctctggaggaatcactggggcgtgctcatgtgtgggtgttgtgctttcatggctgggttttaacttccggccttggttcctttggcagtgacatggagggagagggtagatgaagttgggtgtgtgaacttggaattctaaggacagtcctgcacaggcaggacagtaacacagacctggttgccatgccccacagaattcagtgggaaaacatgctcagcatttgtgggacaccagtgtcaccctctccaccactgcagtaagatcaggagcccatctcccacctgagtctcaattccaggaaagagcatcagggattcccccaagctgcaggcaagtgatgctgcccacatttgttggctgagtggggccaggtatggagggagatgagtgggcactcgaggtgcttggggacggagtggaggtagacatggcctggctcctgcctcctcctctccctccaggctttggagctctgtgagtccatgcctaccagctgtaatgtaatggggatcatctgggatgcttgggggtgacttaggatgctcagggtccactccccactaatctcgagtgggcagacaggacctgggcatctgtgctgttaacgctgatcttccctaaaggggccttctactctaagggctttcatttgcgagttttcatgtattcacacctgagataattcatcataaattcaaaaatcccattccgttactagtgtttagttctgatctttgatccttacagcgagctgaccctcagtggagacttgtcttatgctcagaaatttaacaaaatataatggagaagtaggaagcagcactgggcactgcagcgctttggaacatagcagatatgggaacgctaataatttcttcccacacctggtgttttccactttggagattctggcttgggggatggtgggttcctgaaaaagggtcagcagagaaatcacatagcaatgtccatgttatcacatagcagagaatgataatttctcttgttttattagagattttttacggagcccttatttttgcccagcagggctattatctgggtcaccagcaaggcacagagggatgggaaatgtttgtaactttacagaaggcagtaaatatacactctgctctgtcagttacagtataacccaaaaacctttgtaaggagttttgttacataaccagaccctctagtcctcaggactggagttccttatgcagtcatagtgtcctggtgatccgtcaggtttggagttcctggctccattagatcttgatggagattctgattaaccaaagtgattgcattacatcctttataactctagagcagattgctaggatggtccacatcccttagaaggctgatactgtgtattagtctgttttcctactgcaataaagaactatgcgagactgggttatttatacaggaaagagatttaatttactcacagttcagcataactgggaggcctcaggaaacttaatcatggcagaagatgaaggggaagcaaggcaccttcttcacagggtggcaagaagaagttctgagcaaagcgggaagagcggcttataaaaccatcagatctcctgagaactcagtatcaccaagacagcatgggggaaaccgcccccatgactcaattacctccactggtctgtccattaacacatggggattatagggattacaattcaattcaagataagatttgggtggggacacaaagcctaaccccaccacccttcgaggaccaattctctctgctcaggtagtttgcttgtagtgtggatgatatgttagttgggaggcctgtgattgtgactatctcaggaatggaaaacttaaagagacttatatatagattacctgattggttatgttttttaatgcaaaaatgtaactaataaagcaagaatttcttattcccaaattagagccaaattcccaatggattgcatggtaaagggctctggatttgggttctaggccccctggatttgggtcattactgagttatcctcacagtatccttctctctcaattccaagttctggccaagtaagtatcctttcctctgagcagcttccctagctcctctgccttatcctggcacattttagagacattttatatatgtgtatatatatatatgtatgtgtgtgtatatatatgttgaaaataaaaggatggaaaaagatataccatgcaaatactaatcaaaagaaagcagaaattgttatattaatatcagataaagaacttttaaaagtagagagttaccagggacataaaagagtgttcatcaagaagacatagcattcttttttattttttattttttatttttttttgagatggagtcttgctctgttgcccaggctggagtgcagtggcacgatctcggctcactgcaagctctgcctcccacgttcacaccattctcctgcctcagcctcctgagtagctgggactacaggtgcctaccaccacgcccggctaatttttggtatttttagtagagacggggtttcaccatgttagccaggatggtctcgatctcctgacctcgtgatctacccgccttggcctcccaaagtgctgggtttacaggcgtgagccaccgcgcctggctgacatagcattcttaagtatgcatgcaccaaacaacagagctgtgaaataagaagtaaaaactgctagaactacaaggagaaacagacatacccatgattatacttgaagatctccatactcttctcaacagttgatagaacaaccacacagaaagtacacagaaagtcagcagggctataggaacactcaccaccatcaattaatattatctaattgacatttataacactccacccaaaagtagcaggatacacattctttttaggcacccacagagcatttgccatgttagggcatgtcctgggccaaaaaacaaacagtaacaaatttcaaagcattgaaatcatacagagtgtcttctatcttttaatagaatttcttctttttgctttaaaatgagtctcaaatggtcacacatattgtatgattccatttatataacattctcaaaatgacaaaattacagagatagagagcaggttagtgtttacaaggggttggtgatggttgtcagaaagggaggtgggtgtgactgtacaagggataatgtcagagagatttctgtgatgatgaaatagtcttgattggcgtggtggttataggagtttacacacatgatgaaatgacagaaccatatatactcattatactaatgtcagtttcctggtttcgatattttactgcagttatgtagaatgtagccattaggaggaacaaggtgaagagcacaagggaccactctgcacaccctttggaatttcctgtgaacctatacttatctcaaaattaaaagtttaaacttttttaaaaagaaaaaaatgttgaaagatcaactcatttcctctttttatagtagtttgtagtttgggatctaagaagtgtgcaagcttacatagcagtagatgaataagtcataaaaggaagatggaaataggagaggggccagggagaattgggcaccgttcaagattgctgaaaatgtttttgctatcaacgaatttccctgttccctgctttggaacaatatggcctaaccatatttttgttgttgttgttttgatatacaattataattcacaataatttacctgtaattagtgttggtcaaatttaaaaaatggcactgaccacaagaatactacaattaaagccccatgacagcacactcacccaccgcagatcagtgtggagtgcagaatttaagcatgtgataggtaatgactttgtctcgactctgaagtctaagaaacaaggctgaaaacagtagaaggctctgcaaatcatggcagctactgcaaatgaaatacctattttcatgaatctagacacacaagcactaaccctggggtcaagagacccaggaagaggtctcagcttgtctttgatcacctatgacatcttgagcaggtcaccacttcccccttggggctgctgtaggagtgaaataggatgttgctgtgttgacctcttagtaaattaggcatgctctctacagggaaggaccatcactcactcatcttttcagctgtacccagtggccactgtctgaaatgtcttcttttaatagaaaccatagctcttagtatgagctcacacactccatctctctgaggcttccacctttcccaaaataggcattatttttattagagcccaaatgagctgattctttatttcagacccccagctctgagtgatatagttggatggagtagagtgccaggcctaggggcatagccatgctgactggcattttggggaggttcagcaagtgctagctagtgaagtactcttactgtccctttctgcttggcctgtatgctttctttttaaaatttccatttgtgatatttgataggtacaaaatacgtaggtgtcatttatgtacttttggggcataataataagacaaatgcctgtgaacctacctcccaacttaaaaactagaatattctcaatactgttctctacctcctcttttgccattgccttttcccccagaagttattttagaacacttttagatttacagaaggcttatgaagatagcctaaaaagttctcatatatttagcatctagttacccttatgatgaactaaaattggtccattattaagtaaggtctgtactttatttggatttaaaacttttttaacctaatgttcattttctgtcccaggattccatccaagatgccacactagttagttgtcatgtctctttgagctcttcttggctgtgacagtttctcagactttccttgttttgttgaccttgacagttttgaggagtcgggtattttttacaaagtcccccaattgagagttgtctgatgattttctcgtgagggttttgggaggaagaccacagaggcaacatatcctactcatctcatcacatcaagagtccattctgtcagaattcttcactccatactgactccctctccccctttccctatgtactctttggaaggaagtctctgggtgcaccccatagttaagggaggggagttcactgcttcatctccttgaagatggagtgtctacgtaagttatttagagttattcttccaacaagatttgtctctttcacttatttactagtcattcattctctttttgtttttttgagttgatacattttgttttcttcactggatctgtttacttattcattctaattgttcctattaataggtaaagagtggtattttgatacctgtatatagtgtgtaatgatcaaatcagggtaattagcatattcattccctcaaacatttattttctgtgttgggaacattcaaaatcctctcttctagttattttaaagtcaccctacagtgctatcaaacactagaacttattcctcctatctagctgtaattttgaatccagttaaccaaccttttcctattcctccctctccccacccttccccacctctagtaacctctattctattctctacttttatgcatcagcttttgtagctcccacgtgagtgagaactctggtatttatctttctttgcctgacttatttcatgtaatataataacattatccaggcttatccatgttgccatgagtgacgagtgacagaattttattttttttctggctgaatagtattccactgtgtatatgtaccacattttctttatccattaatctgttaatggacacttaggttgattacatatcttggctattgtgaatagtgctgcagttaacatgggagtgcagctgtcacatcaatatactcatttccttttctgtgggtaaatgcccagcagtgggattgctagatcatttgcaccaatggtaaattagtgttcctctttgtttgcatccttgccaggaatttggtgtgtgtgtgtgtgtgtgtgtgtgtgtgtgtgtgtgtgtgtgtgtttggtctgataataccattctcattgagatgataccttattgtggctttgatttgcatttctctgatgattagtgatattgagcattttttttgctatacttattggccatttgtatatcttcttttgagaaatgtttattcagatcctttgatcatttttaaaaccagattatttggtcatttttaaaaccagattatttgggtttttctttttgttttgctgttgagtttttgaattccttgaatattttggataataaatagtcccttattggatgaatagtttgcaaatactttcccctattccagagtgtctcttcatttgattatttcctttgctgtgcaaaagctttttagtttgatatagtcccatttgtctatgtttgcttttgttgcctctgctgttgaagtcttaactataaaatgaaaagatatctcatattcatggattagaagaattataatattgttaaaatgactatagtacctaaagtgatctgtacattcagtgcaatccctatcaaaatacaatgatatttttcacagaaatggaaaagacagtcctaagatttgtaggaaaccgcaaaagaaccctgaatagccaaagcaatattgagcaaaaagaacaaagctggaggcacatggtgcttgactggaaaatacgctacaaagctaccaaataagcatgatatcttttttttttttttttgtctttttgataatatcattctatgctgtaaaatctttgcccagaccaatgtcctaatgtatttcccctatattttcttctagtaggtttatagtttgggggcttacatttaagtctttaatcaattttgagtaaatttttgtatgtagtgaaagatagggacctagttttattcttctgcatatggatatccggttttcctaccaccatttattgaagaggctctccttttccctaatctatgttcttgacacctttgttgaaaattatttggctgtgaatacatggatttatttctgggttctctattctgttccctttgtcgatgtgtctgtttttatgccaatacgatgctgttttgattactatagcttgtagtatattttgaagtcatgtggtgtgatgcctcaaactttgttctttttgctcagtatttctttggctatttgaggtcttttgtggttgcatacaaattttaggatttctttttctatttctgtgaaaaagtcactgatatattgatagggatcacattgaaaatgtagattgctttggatgtaatggtcattaacatgggatatcttttcatttgtttatgtcctcttcaatttcttttatcggtattttgtagtttttaatgtagacatctttcactttcttggttaaatttgttcttaggtatttggctttttttcttttatttttagctattataaacgagattggtttctttatttcattttcagctagtttgttattggtatatagaagaaacactactgatttttgtatgttgattttagtatcctgcaatttcaccggatctgtttaccaattctacagtattttgctggaattttccgttttcttttccagtatgactgctttttctttttcttgcataattgctttggctaggattataaacaatacattgaataagagtcgtgaaggaataggcattcttatatttttccagttgttagaggaaaagttttcagcttttgcctattcagtatgatgttagctgtgcatctgtcgttaaggctcgtattacctaatttgttcagagttgttatgaaggaatactgaattttatcaaaatggttttctacatttatcgagatgatcatatggtttttgttcttcattttgttgatgtgatgtatcacatttattgatttgcatttgttgaccacatccttgcatttctggaatgtgtcccacttgatcatggtgtattgtctttttgatatgctgttggatttactttgccagtattttttttttttttgaggatttttgcatctatgttcatcaggcacattggcctgtagtttttgttgttgttgtgtccttgtctgtttcaggtgtcaggataatactggcctcttagagtgagttaggaagaattctcttctcttttttttttttattttgtttcgtttcgtttttgtttcgttttgttttgttttttggaatagtttgaaaagaattggtgttagtttgtctttataagtttggaaaaattcagcactaaggccatccagtcctggtcttttctttgttgggagactttttttttttttttttaaatggattcagtcttgttgctcattattagtttgttcaggtctcccctcccctcccctcttttttcttttctttttcttcttttcttttttttgagacaaagtctcactgttgttgcccaggctggagtgtagtggcgtgatctctgctcactgcaacttccatctcccggattcaaacgattttcctgcctcaatctcccgagtagctgggattccaggcatgcagcaccatgcctggctaattcttttgtacttttactagagatgagctttcaccttgttggccaggctgatctcgaactccgggcctcaggtgatccacccacttcccaaagtgctgggattacaggtgtgagccactgcacccagccaggttttctatttctttctgcttcattgtcagcaagttatgtgtgtctaagaatttacttgttttccttgggttttctaagttattggtgtatcattgttcatattagtctctaatgatcttttatatttctgtggtaacttgtaaaatgtcttctgatattatttatttgatattctgatattatttatttggcttttctgtttttcatagtctagataattggcaattttcatatttttaaataaacaactttttatttaattgattttttgcatttttttggcctcttttgttcagttctctggtctttattatttctttctactaattttgggtttggtttgttctcacttttctagcatcttgatctttctacttttttgatgtgggcatttattgctataaacatccctcttagcactgcttttgatgtatcccacagtttttggtatactgtgtttccatttttatgttgtttcagattttttatttccttcttaatttcttcattgactcattgttcattcaagagcaagttgtttaatttgcatatatttatacaatttccaaagttgttattgatttttagttttattctattgtgttctgagataatacctgactttgatttataaaaatttcttatgacttcgtttatgaccaaacatactgtaaatcctagagaatgtcccatgtgctgatgaaagggtgtatattctgtagctgttagatgaaattttctgtaaatgtctgttaggtgagtttgatacatagtgcagtttaagtctgatgcttctttgttgattttctgcctggatgatctgtccagtgtttgtagtggggtgttgaagcccccaactgttgttctattggggtctatctctctctttagctctaataatatttgcttatatatgtgggtgccctgttcttgggtacatatatatttacaattgttatgtctttttgaattcactcctttatcattacgtaatgactttctttgccactttatgttttttgacttaaagtctattttatctaaattatattttgtctggtataagtatagctactcttgcttacttttggttttcatttctgtggaagatttttttttcatcctttcccttccagtctctgtgtgtctttataggtaatgttttttgtaagcagcatatagttaggtggtgttttttaatccatctgtccagtctatatcttttaattgggaaatttaattcatttacattaaagggttttttttcaattttaatttttttatttttttagagacaaggtctcgttctcttactgaagctagagtgcagtggcatgatcatagctccctgtagccttgaactgttgggtttaagtgactgcccccctgcttcagcctcccgggtagctgggcctacaggtagatgtgtgctaccatgtctggctaaattttatttttatttttgtagagatggggtctcattgtattgcccaggctggtcttgaactcctgggctcaagcaatcctcccatcccagcctccaaaagtactgggattacaagcatgatccactatgcctagccctacattcaaggttgttattgagagatgaaggcaaactcttgtaactatgttaagtattttctggttgctttgtatatcctttgtttctttcttcctctcattgtttttctttgtggtttgctggttttcttcagtggtaatatttgattcctttcacttcctcatttatgttttcgcactaccagtgagttttatacttttgtgtgtttccatgatggcagatatcattcttttgcttccaaatgtagggtttccttaagcattcctcatagggccagtctactggtgatgaattcctccaatttttgcttgtctgggaaagacttttatttcttcttcctttttgaaggatagctttgctgggtatagtattcttggctggttttatatatatatacatatatatacacatatatatatatatatacgtgtatatatatatatattttttttttggtcagcattttgaatatatcatagtgaactctcctggcctgtaaggtttctgctgagaaatctgctgttattttgatgaggattctgttttattttacttgatgtttttctcctgctgttttcagacttctcactttgtcttacttttgacagttgaactgcaatgtgccttggagaggactttcttaggttgaatatatttaaggatcttagagtttcctggatctggattctttctcccacaaagggaagtttcctgctattactttattaaagagggtttctatgcttttctccatctctcctccatttagaaatcccaaaatatgaatatatgtttgcttaataggatcccacatgtcaggtaggctttcttcattcttttttattctttttttctgaattctggtttgactaggatatttcaaaagacctgtctctatgttcagaaattctttcttctgcttgatctagtctctttttgaggctctcaatttttttatttaattcatttaattattcagttccaagactttttgtgataaatatctctgttgaatttctccatgaattctcatgaattgtttttctgatttcgttgaattttccatgttcccatgtatctcactgagtttccttaagatcattattttagattcttttttaggcattttatggatttccttttctttgttctgttattagagaattactgtgtttctttggaggttttattgtttccttgctttttcgtgtttcttgtatctgtacgttgatatctgcactgttagcgaaatagtttctttttttcagtttcatggagtatctttcatagggaacagagttttttgtagatgtatgctatagtatcatttgggtaggatgctttgggtttgattctgggtgagcgtaaaagtgtagtcttcgtatgatttcttggactgtaatcactgtcagtggtgtctgcaagtgcctcagtggcttaagctgaagttggttttggaggcgtggtgtggctttactgaaaacaaggacagtgggtgggctggttttcaggcctccaggctgcgtatgtggcagcttactgctggagggagcaaagttgttggtggaggtagtagcaggccccatgcagtcagctttcaggctctggggagactgtgcattggctccctttgttctaggggaagccttccttctgtgctggaccacctgttctacagggtgtaggatgctgcttgggttcaggtgttgggattagagctgcactgctgggtccagctggtatcaaaacactgcagctctttgggtggatatggtgagatgttgacaggaccccagggatgtggagatgctggggcccctaggaggatgcactctagtgtgaatccagtctccaaatggtgccttgctgcagcagcctgggactcagggagtaggggctacccagcatgaacggtctttctagagtaaaacaactgcatggatgccaggtacctccctttatggggctcaaggcctatgatggctctggctaagattgtaggcatctgtggtgtgaatgtggtctgctgtggacctttagcttactttttcctataacagggagtcccccttggctctgagtcagtcctggctggctgcttttctttcctctgtgctgccatcctgagcttctgtccctcggagggtcttgttgcttctttgctgaattccagtgttctcccttggacattttacttgctgtgtggttatctattgttttagttctttgtggatgaggtgattgctgggtgtgtctctagtaggccatcttaatgacgtcaagctccttgatttttaacgttagttttaccacatatgtaagtctaaactacattgtttaattttgcttgttttagggctttatgaaaatggatctatgtagtatgcagtcctttgacttccccaacgcctccccaattgcatattgtttctccaagtcatctgtgtgattgtgtggggagtggtgatttcttggttttcactttcttggtatgatagtgaatcatgtgactataccacctatgtatcttccctccatcagggttattttctcttctttaactgtcataagcagtactgccctgagcactgtgcatgtccctgaggcacagtgcaagagtttctgtactgcatataagtagaagtggagttgctgccttgtacgtatgtcagtattctgcattacaagataagcccacattggttccaaagtagtgattctgttttactttgtccagcacatgatgtgtattcccattgattttcaaccttcctaacacattatcaacctttttcatttttacccatctactataaaatgggatcgtattgtggtctcagattatgaatgaacttgagttatttttatgtttattcaccatttgtgctacctgtccttgcaatgactgtgtattttgcctgctgcctaattgagttattggtctttttgttgttgaattgtaggagttcttatatattcaacaccagtcctgtacgattatatgtgctgtttccaacagtttctttacaagtatatttaatcctattttgatctatgaaaatcaataattcctacatgagaattcactgttaagccagactttctgtttaactagaacagtcctttttttttttgtaccagcaatagataaccactatttataaaccttagcattttcaagtcacaagaaaatcttgtgttctcacagctgtgccgaaagggctatatgcattttgttttgtttcaatgttcagcagcatattttaaaattaaattttggagttgataaagataaatgcaaatttttaaatgctggaattttattaaaatgtttttttttttttggccaggtaactagtcttagacaattgccttctcagtcatttaatgagctttcctaaactttatctttcattatctgtggctgcactaatcatttgctaaaaagaattggaagattcactctttattactgatctgtatttcatgaatatttatgtatactccctgtactttcacccttttaccaaagtagctgaataatataaaatttaaattttttaatggaattattttatggctcccgtatgaataaaagaccccttattatgtagaataacaatgaatatatcaagaagtgggattgttttaaatgaagcaccttaaatttgaatccacatgcaaggtagggcctcagtgtaggatggaatagtttgtaggcatcttgtatctgtgtgtctactgtggtgatggagaccatcaacacctactgatggaggccgaccgtaggcctttcatccactctctctttcacatgtttgctgagtatatatatgcatgctaggcacccatctaagtcttggcttacaaagggacaaagtccttgtcttcaaggagttaagtgcagtcagagaaaataaacgataaataaattaaaatgtgtgtgaagtactggtaagggccatggaaaaagagaaaacagaagaaaggaatggagagtggtgcggcagctattttatatgaggtggggcaggtttggcttggcagagaattggatggaatcagagaaggaatatgagagaggcagggagagcaagggaggggacatttgaacggcggcttgaacaaagtaacagaacaaagagtcctgcagagagctggggaagagcattccaatgcgaagaccccaaggtgagaatcagagtttggaaaaactgcccagggtcaaggtcttttaggctttggtgcagctttggatttggttctgtttgggtgggaagctgcactggggtttgcagagaggactgacacaaatacctttagtttttaaagttccccaaagcgagtgccaggagggtagaacagagagactggtagactggagaggtgctgttggtctggagtgaagtgcatgggagagaaggggtggatctgaggcatattttgaaggcaagtctgtggggtttgctgctggaaagaatggggagtgagagacaagagcttgagggatgagtctcagattgggggctggatcagcccacttaatggttgtctaatacccacttactcagaagggcagactgcgggaggcacaggaggtagtttgtttatttgattggtttccttttgtttttcatggggagaatgaagagcttagttttagacgtgagatttgaagtgcatgttagacatccagatgcagatgttcaccaggtagctgggtgcaggagtctggcatttggggatagagcagggtggagaccaacatttggcagcaacagatggatgacactcaaagccaagagggcggatggaggggaggctcctagacggcctggctacccctccatctttagttcagaagcacaagtagagtgagccagaaaactaagaaggaagggtcagcaagggacaggcagcagggctgtgtgatctccgcgcagctggtggacggtgtgtttcccagaaaggctggtcagcagtgtctgctgtagtggacatgcaggtaacaagaggacctttggatctggcagtatggtagggacaaaagccaattagtggaggctcaaagatcaggttggggaggaagtggagatggcaagaggagacagcttctggtagagtatcccctctataaaggagagttggtggggttaggggcaagggaatgtaatcacaatatggaggagaatttagcatgtcttatgctaaatgagatgatccagaaagacacagtagctccagggaataattataggagcaggttccttccagaggtgggattcagtccacggaggaggacaggcctcagagaggcacccagacagctcacccctgtaacacgtgggacacatggagatgttttcttccgattgcctgaatttctgttaatgaaataaggagggcaagtgaaaaaatatgcagtttctcctactctactctactctcacaacacacttctgtcagcaaatgtctgggtatctctccccaacagcaagtaagcagttgcttctgcagcagatgccactgaaggtctgctaatttaattcagttctgacactgttgacctggagacagcatcagtcccatagtttggggactcagtcctcaagactgcccctccacccccacttcagatgccagttgcacgtcccaggttgttttaaccagtaattctggctataaactggggttcccatgttgccttcctcaggttcaattaatttgctagagcagcacacagaactcagggaaacacatttactgtgttttgtaagggaaaataaaaaatctcaggacctcctgctaaactgcttatgcaaaagggtggcttaggcccagaggctgaatcttgcatcccccttttcctaatgaacagctgttaccaccattatgcatcagccaggtccccacggaaaggtaaaaggccgtgggcatctgaaaggctgcccccacagatcattcttaagtaaatcctttcctggcttcccagaaacaaggacagaccagttgtaactttaggtcagtaattgaggtctaccttctaattctccacactgatagtgtggattacaagcttatcttcccaggtgcagaacaagtccagactcatttcttccacctacccagagatgactgcataattgtctcttccgacattcactttatctgatgtaaaatgtagatttactgggcactaaccaaagtctcacaggcatgtaaccttttcgccttaaccgccaacctaccttcccctactttaaggaaatgtctaaatactaaacttgaaaacctctttggaaaaacagatggctctgtggcttatgttttttccctcgaaaagccctaaagttggcttaataaacttctgtgattgaatgtctacctcagtcactcattttgggtgtcactataaaggatatttttaaggatacagatgtagaggtgtaggtagggtgaggtacaggggaaggggcacggagcttccatgccttctccaggaacctccccgtgttcagatatctggaagcccatctgaaccctgtctttttgggtttttatggaagcttcattgcataggcatgactggttaaacccttggccatggataatcaacttgacctcagcccctctccccttcttggagggtggagggtggggttgaaagtcccaaccctctaatcctgccttggtctttctggtgaccaaccccatcctgaagctgcctaggggctgccagccaccagtcacctcatttgcatacaaaaagacacttacatttgaggctaagccaggaaatgggaagatgaccaaatgtgttttatacggtatcatagaaggtcattcatcaactgaggctacagaaaggggaggagatattagaggatggaaaagaaagatattaatagacccttcagagaggggaagggagctcgcttagaaaatggagttaagttgccaggaggcaccaagagtccacttgaggccagagatcagaaatgtaaaatggcactagctgccctggggcaggtgtgaagtaggtgagagttagatttaagcagacctgagatgtggtgaagggaaagtagtaatagtatttgtgggggtttttttctttttttttttgagccggagtttctctcgtttcccaggctggagtgcaatggcgcgacctcggctcactgcaacctctgcctcccggtttcaagtgattctcctgcctcagcctcccaagtagctaggattaaaggatgcaccaccatgccagctaacttttttgtatttttagtagagacagggtttcgccatgttggtcaggctagtcttgaactcctgacctcaggtgatctacctgcctcagcctctcaaagtgttgggattacaggcgtgagccactgcacccagcttgtttttttctcataaaaagtgtagaaatcctaaacactgaggaaagtttgtaacattttttcctatatacaccaatacttaatgaaaatatatacattaaaaaaataaaaatctgaatcatattatacatatgctttatgactgtgttgtctgccctgctatcagagttgtttaaatttccccttggtccttttggcagtgacatctgactcttgagttatagccactgagatctctctaagtgctcttgactcttgacttgtgtcattatgttttgttgcccctaagtcaagggtacaagtaattatacatggaattggtgtgaagtactcacagcaaagactgcaggtgggctctgggaggcctgactgggttggggacagtgaatgcagaggtggggacgggacccagcccgtggcaggagagggcggctgtggttttggaggaatgagttttcaggggggtggacgctgtgagaaatatgataggcaaccagtgggtggtggggtgggggggttcttactgcttgccattgcttagcaggagggacagtctagtggagataaaataccatcaggcttcacagcacagttttattattttcttcaacagcatgtggcccaggagtgggctagagtctgcataggagaaatcttaagttctagttaagtataccttatcctaagtgcttgggatcagagtgttagggcattcagaattttttgaggttttggaatatctacatatacataaatgagatatcttgggaatgggactcaagtctaaatgctaaatttatgtttcatatataccttatttatgtttcatatatatatagcccgaaggtaatttcatataatatttttaataatatgtgtgacccatcacatgaggttggatgtggaatttttcacttgtagtgctcaagttttggattcggagcattttggattttggagttttgaattagggattcttagcctgtatttctgtactgtggtcccataagaaaaaaaaaaaaaaacctagccctcccctctttattttgtaaaggattcatgtgtaaaaagtggactacaggtactgctggttacaatcaaggcagatatactgattctgggactggggtagaaaatatgcaagaaaagcccagagcatcttgtggtgccagaaagtaaggatgtgctcaaagaaacaaacgaacgaacactcgcagtgatggtgatacgtcacagggacacagtagccagctgaaaacgctcccatacacaaagctggaacaatttaagaaaaagcaatattggatggtagcccagagtataaaatagccgtaagatcacagtgatataaatgatggaatacgttaattagtaggggaagagaaatctcctgtgcaaaaggtttccagataattcatgtagatgctttgccctcaaggagatggaagagttaactccccacccttaagcgtgggctgttcctggagacttccttccaaagagcatagcatggaagggggcaagtgtaacttcagtggagaatcctgacaaacaccgcctcagccaggtgatcaaggtcaacatcagcagtctgcagtcctaagccatgttgacctttgatatggtaagatgagaatagcatgttgcctctgtggtcttcctcccaaaagctaatactggagcactgatcaggtattttgcagaaggtcccccacttaggatttgtctgatgtttttctcatgacatcagacaaatcctaacgggtggggggacattctttaaatacctgaccaatgctcttcaaaaaaaagggaagtctgagaactgccacagtcaagaggcgcctaagcagacgtgacaactaaatgtagtgtgggatcctaggtgggatcttgggacaagaaaaggacattaagggaaagctaaggacatctgaataaaccatgaactttagttaatgtatgggtagttgttcattaattgtaacatgcttatcatactaatgtaatatgttaataataaaggaacctattttagtctaaaaaatatttttgggccaggcatggtggctcacgcctgtcatctcagcactttgggaggctgaggcgggcggattatgaagtcgagttggagaccagcctggccaacatgatgaaacccccatctctactaaaagtagaaaaaaacaaaaaaaaaaaaaaacagctgggcatggaggctcttacctgtaattgcagctactcgggagggtgaggcagaattgctcgaacccaggaggaggaggttgcagtgagctgagatcgcgccactgcactccagcctgagcaacagagtaagactctgtcttggggcggggggggatatatatatatatatatgtatgtatgtatatatgtatataaaagaatatataaatatatatacataaaaatagatatatatattttgaaatatcaagcacagatgctagaaacctttatttcctcattctgttttcttaaatgatagggatggtttctttaacagaattctacatttggaataaatattagcatttattgttccaaactcatttatagaggtgtctatagtaattaaacccaaagtaacccatgtcccctctcctacacagggtccctgctggcaggtaggtacaggttcttgtccctagagcggggtgcagaggggctttctataatccactctcccacttcaataggaaaatctaaagcatagataccatgcttaggaatgtgggcataaaccatataaatctgcagaactaaaatgattttagtagcctaataatattttaacattatgagacctgggtagtgtggaatctgtttttaaaaatcactgtgcttcttgtttcaaccttgcatgtttcaaaatcaggcagggaatcgtgagtaacaaggtggcaaggaaaaaggtcagatattgattaatgtagctgaattcatttgtaagaactgaggaaactcatgacatttatattttgaattttttttttttttttgagatgaatcttactctgtcacccaggttggagtgcagtgactgatctttactcactgcatcctccgcctcttgagctcaagtgattctcctgcctcagcctcctgagtagctgaaattacaggcatgtaccagcatgcccggctaattttttgtatttttagtagaggtgaggtttcaaatgttggccaggctggtctcgaactcctgacctcagatgatccacccacctcagcctcccaaagtgccaggattacagatgtgagccaccacgcccagccgaggtttttttgaagtagatgtttaagttacaaaatttacaagtaccttacagctgtgaaaaaaaaataggaaggcctgataaaccgctaaaaatggtgactgttatccgtctactttgggagcagggagtatgcactacctgaaaagacctcacttgtgtttcctaagaagccaagttccaccaaagacatctatgtccattttcatacgtgggtattttcccattgttggtatttcctcttcaccccttcaccatgctgtcttctggcttggcagaaggcagtgttgattccagtgcagttatatggaatttcatttgtttacagttaacatcatgtaagaaaattggcttattaaatttatgttgattttccaaaatgctggcaccagggaatcacttgacagtcacagccttcctcccagtgtgattagtgtctaagacaccaacgagaaagccaaggaaggttacaaaattgtgtacttttgtagctggagtggtaaattatgtgtaaaatagcatttcccagattctagttgaagcgacagtgccaccacttcttttttttctgtaaaatttcccagacactaatgagctatgttgacttagagtctagtctgcagaacgctagtgtgtcttggcatttcagagagtaaatgagttgctcaatgatgaactcctgaaaactggatgataaactcacattttaaggcatttttcttctataattttgaggggtaacctgatcctggcagtaaagataaattaatggtagatactcactgaaaaaaaaaaataataggagggtgtagcagaaaactgtagatgatctttatgatcagtataaaatttttctttttattgagaattgctatgtgctaataaattctattgaggatgcagtacaaatactgttcagttaagaaattgatgtatacgttacacccaataggatgactgctgtcaaaaagtagacaataacaggcgttgacaaggatgtagagaacttggtacccttgtgtactgttggtggaattgtagatgcagcctccgtggaagacattagggcaatccctcaaaaaattaaaactagaattaccatatgacccagcaatttcacttctaggtatacacccaatggactggaaagcagggacgtgaagagatatttgcatactcatgttcatagcattattgacaacagcccaaaggtggaagcaacacaaatgtcgagtgatggatgaacggaccaacaaaatgtggtatatgcatacattggaatgttattcagccttaagggaattctgacacatgctaccaaatgatgaacctggaaggcatcatgctaagtgtaattagccagtcacaaatagacggacaagtgattccacttaaatgaggtacctggagttgtcaaattcgcagggacagaaagtaaaatagtggttgccagggactgggggaagggagaaattgagagttagtgttcagtgggtacctattccagtttttcaagatgaaaatagttctgcagatagatgatgttgatgtttgcacaacagggtgaatgtacttgaggccactgaactgtacacttaaaaatggttaatctgcaggggttgggtgaaaaaaaaaaagaatatggttaaaatgttaaactttgttaaatatattttatcacaactttgtagaaaagaaatgatgtgggatattgtgtgcttgaacttttgctgaataatatgtactataattactgtttaagcagtggtgaatgccgctgtagggtcctggcctgtgtcccggtgggcaggtggaaatgcaggtgtgcagcggaactggcctccctagaagtaaagacctggaacaagagccagccagccaatgggaagtggatgagctttcagggggctcccagggtgggagaggggcctggtgggacacgcagggtacatcagggaaggagcagatggcaaagagggaggagaattcactggataatcacccatcccaagtacttaagcataattttttcattgactggttctctaaaatgaacaacaaatagtttaaatttacattttataatagcttgactacacctctttgtttgtaaaatgtattctgttagatgctgtggttgcatcaaagcttttctaggctagctagatacaagctgatagcattagcattagccacactgggagcattaaaaaaagggagctgtgacccaagacttattgggatctcttcgtaaaacctcacagaactatgtcatcccaattttactacctttgagtgttggcacatctttctgtttaagttttctgtttttcaatgacataatctattgcacatacgtttttgagtccccgtgaaccttatgttcaagccattgagcctagtgatgactgggcattacgtggacattagcagagcaataatggctaacacttgtccagcacagactgagtgttaggtatttcctgtagactggctcatttaatcctcaccgaagctctgacccatctgcaaacacagaaatggggggcagagtggtcaagcaccttcccccaaagtcacccagatggttgatatgaagctggcttttcaaaccctggctttctgcagctgaagaggatctttcacaaaagtggtcctatcagtgtccacagaggaaacctctgtaatttcaacggtcggaagagagtttaccggcagcagattttgaccattacccaataaaaacagaagacagatcatgaaaggactctctccaaaataacatactgagcaaaggtcttactgaccagaagctgctgccctgtaagagtcagccatgctcagtgggagcagccacagagaagatgcttctttgctcccgagaatagcagtgcacacggcctgcctccaacacgctgcaagagagagggggcgagaggaactgagttagtggatgtgtgctttagattcagtaaacttctttcaactaggcctgccttcctctacccctccccagtaaaatattgaaacaagccccttcccaaatgatatctactaaaagcctgtatttgaatgagtttccataaattgatcagttgcattttaaggcatgagatattacaaagaaaaaagtcttaaggagccacagcgaagtagattgtgttatttgaataattcagactgcatgttgaaaatcaaggtagggatgacagtatttttcatacagactcaattttttttctactaactgaactctaaaccaattatttgcacatagacaaatatattttggtatgcacacatgtgcacatatgtatttttgaaatttcaagttaatatcctggaagtaacatgttagacttgtttttgtctccctgcgtatattttgaattaagtttaagaaatcaagaccaggtgtaatggctcacacctgtaatccagcgctttgagaggccaagacaggaggatcccttgaggccagaagcttgagaccagcctaggcaacatagatattttttgtagataaccccatatctacaaaaagtaaaaaactagcagggcgcggtggtgcacacctacagctactcaggaggctgaggcagatggatcgcttgagcccaggagttggaggctacagtgagctgtgattgtgccactgcactccagcctcagatgcctttctgtgatgccatcagaaagaaggaaagaaggagggagggaagactctggtcttctctgtggcgggataaattggttagtcagtggaaaggtgaatgaggcaggtggatattaacctggaatcatcagtctgccttctccttcagcttcccattaaaccaggtggctgaagcctaaacacccattgtcaatacacagtggggcctcctagacaataagtaagtgaccaggtggtctctggtgctaaatgctctaatgctcttcaggaagtcagacaagagggctaggagagtgacactttgatgggtatctctgaagcagtactgcttgttcactggcttgaatcacagaagagcagccactgggcctgtcttactctgcaaggaacctggtgcttagaaaactcagtaaatcctagttaaatgaagcagagatgggtagaacatggcccctcctgacaggtatgacataaatattcagagggtattcattatgactgtagttgccattcttaagtctctcttaatgctggcacatccggcctcaggactttgtttacaagctcctcatgaggtattaccctgggctattgaagaggcagctgggctaaggtggcagtaaggcccacacctatataaatgttaaaccttgccctctaaagcactttgtattcatgtctctcctgagcatcagaagtatcttccgaggcaggtggcggtgtcccattttacagaagaaactgaaatccaaggagaacatacaaatggttcagctaagcttgaatctcagacccttaactcctttcttctgtaatatttggttcaccttgatccccgtgacctctttggaaatctctatgaccattttttaatgttgtaggggcactggctactatcaggagtgtgttaacccagcaagatacggttcataggattgtctttagaaagaaaatagggtcttagagtaggattgctcgtattttaggcgttagtgaaaactgttgagctgagaaagtttttatacctatcctatttgtttttaaacccattcccatccaagacttgaaaaggcagcttagctcatgaggttctgagagctgtttttccagcataacttgggggtcttgctaagctgtgttttagagtggtcacatgacatacaagatgtaatctggctatataatatcaaatttgtagcccttctctccttgggctagacctgagtaataaacttaactagctgtagtaatgaagccaaaaattaggtttccttgaactgctaagctagagagaaaaacatgcgttgttctttggatcagacttctatgatggtcttgcctagactaaatcagaataccatctctgacttaaaatttcagtagtcaattagctggaatgcattttttttcagactttcttctgttgaggctttttcacattggaaatttgtcagtttgtatgtctaattttattgtagaataatgggtcatctgcagtctctttctgttcaaatccatcctgcaccatagcaaattactcttaactgaaaataccacatggtcctgttgggttttaagaaacagcgtccaagggatgcaacctcaactctcggccaacaagaccctccagatgggcttccagccagcctttccaacctgtgttggcaaagagagaaaagagcgaagcctgtgaggatacagggtgatggggcactcttccttcccacttgttttggggtctctgagggcagcagcccagcccggctgtgtaaatgagggagccattgttgtatcagtgcatggccataactcagcttcagaacaaaaaactgtagggggtgcctccttcattgaggataccgggctgctaagtcggtgtccggcacagagctgagcttttttttttttttctgagatggagtctcgctctgtcgcctaggctggagtgcagtggcgcgatctcggctcactgcaacatccgcctcccgggttcaagcgattctcctgcctcagcctccggagtagctgggactacaggagcgtgccaccacccccggctgctctttttgtattagagacaggtttcaccgtgttagccaggatggtttccatctcctgacctcgtgaagcgcctgcctggggctcccaaagtgctgggattacaggcgtgagccaccgcacccggccagagctgagctttctaagggtcttgggaagtgtggcttccagtgctccaggagtttcagaagcggaagcgttcagggattggttaacctttagctactgaggcgtgattacgccaatggagctgtcattgattggctgtccctctgaagcagtctcactgcagtgaggcagttgttgattggctggccgtctggtgtgacttagtttttgattgctggatttcactggagtgaagtggtcgtttattggctggccctctgatatgaggtggtggtgaattggtgggcgtcagtgcagtaagtgagcgagccggacgtcgattgactggtcttcagaagcaggttcggttttgttttgttttggtttggtttaaattgatgggggctgtcattgagccattaaaatagggttaaacccattgctatggctaaccaataggcagtcatttcctagttgtatgggaacttttaattttcacgtgtcctagaatcttagaattctgagttggaataagcctatcaaaatgcagaccacgcatcggacggttgggcgggtcggggaggggaggtccacaggcctgggctcaaatcctgactgtcattaaataaggcactcagtctctgtgacacagtctcctaaaggatgacacctccctgaaaggtgggtgttttcccaagattaaacgccttggcatgtggcaggtgcgcatcattgctcaacatttacttcccattgcatttcgcagagctcagggttgtggcccaggggaagttctgtggggtgttgttttgtggctcggttctctcacttggcctttcccatctaaggctcggaagaattacatggcaagatgtaaaactccttggatgctcaggcctctttcataaagatactgatataattggcttgcagtagggctcaggcagtggaatttttaaagcttctatatgatgttcggtgtgcgtgaaaatagatcctgcccagccagctctttacttaactacccttcatgcagtaggaaatattaataaacagctttgattggcgagatcttgactggtcttaagcgatgggctgctcttgttaaaaccttgtggaaattgtgtaattaagaaatgtggtattcagatggaatattctctgaatattccattcctgttactgctattgctcttcttcttgttacttagaaaatctgcctttatgactttcaaaagtctaatctgacataaagctcaggttagtgagttctacatggtatgcacttgagattttctgaaagtggataacaaaattgtctccagttctgataggagcttcatgtaaactttatcctcttgaatattgtatatattatgcagaggctttcctccttcccaaaaggtttgttatctttaaatttggaagttaattcatgaaagaaacgtgtattatttataaaaaaatttttttagcatctagtagaaaatatgttatttaaaaatggtatttatgcttccatggagtcaatgtgcataggtcccctgtaatcctaaagtcatccctatacaataatgagaacttctctgtcagggaggaaggggattttagtcctgagtgttttcatcattcatttctccctagtttggagaaatgtctagttagtttaaggactgaatattgaatttttctgcttaaagaatattggttcatcttctacctaagaagtagagagttgctaaaatagttgattatttattttatttattcagccacacttttgctatttattacttccaaaattgactttactggatatataatacacgcatctatttattgttgttttgataaacttttcattttggaaaaatgttatgttcacttttgatgttgcacattttatagattttaacaaatgtataatgacaggtgtccgccattatagtattgagcagagtagtttcacagccttaaaaatcctgtgcttcacccttgcatccctcccttccctcttgccccaggcaagcacttattttcttactgtctccatagatttgtcttttccagtatgtcataccgttttaaagaaaaaacttattcatgacatttgttgaagaacagtaaggcagattttattcagagggactactacagtagggttttgcagtcaagaaagagattgggtttgactcctaatattaagacaacaaggaagagtgggcatttataggcaaggagcaaaataagggagttggtgggtggaaaattactaagaggaaacatcaggggtggagcgtggggattctggctaaactgaccgaacaggattcttctgaaggcaggacagggtgatcagctgtcacctgggggatggtagaggatgaggaacctgatcagatgttgagagtggaggattccagctagagcaccttagcaggagagtcttgcaaaaattgggcaatgcagagatggacacggaagtgcaaaagttgaggccttaaagggaagaagattcaaaggaatttggctgaagtttggttaaggataaactgtcagaatcacacagtgtgtagccttttcagattggcttctttcacctagcaatatgcgtttaaggttccgctatgtcttttcatggcttgatagctcatttctttttggtactgaataatatttcattgtctggatataccacagtttatgtatctataaactgtgtcctactaaaggacattttgcttgcttccaaatttgagcaattatgaataaagctgctacagacgtctctgcacaggtttttgtgtgaatgaaagttttggggaataattttatatttataaaaaagttcccagtatagtacagaactttcccttataccctttacctggtttctcattgtgttaacatcttatgtgaatgcagtaacatcttactggtgtgttgtccaaactaagagattgacaattatttattgttattattattcttagactttattttgatttcaccagtatttccattaattttctttttctgtttcatgatccaatccaggataccaccttgttattagtacaatgttaattttaatttataggagtagtttggttatgttgacttattaaatatgtttataagacacagcatatcctgagaaaatgagtgtcaacctaacagttatcaggaggcagtgttacttaatgaaatggactcatttaattataatgttatttagaatttttttcaagtttgtttttgttagagggtcagatttccccatgtacagcaaacagtaacataagatttgttttataaggttgctgtttctaaaccaaatactaaagcttgttgaaagaaggtcattttaaagttgagcatttcaagacccaggagaaaaccggttgcagagttgtaataaaagctgtcagtgcctaatttttcaagttggtgcaaaggatgaagtgtccgggtagttctctaatgagcatctccaaatgttttgctggcagaaggactccatgaaagatgacagaagaagttattgtgatagccaagtgggactacaccgcccagcaggaccaggagctggacatcaagaagaacgagcggctgtggttgctggacgactccaagacgtggtggcgggtgaggaacgcggccaacaggacgggctatgtaccgtccaactacgtggagcggaagaacagcctgaagaagggctccctcgtgaagaacctgaaggacacactaggtgagtgtttcaccctcgagagaggaagccttgtgcatttcaagggacactgttcgtctttctagttagtttgctgtttcaaaaaaaaaaaaagtctgttttaaaagttaatatcttcctagttgtcttttttaataatctaagaattaagagatgaagatggagaaagaggatgtttttcatttcctggagattctggagtttggggtcctgtgtatggagacactttgtgtgcttgggacccctgcacaggtatctccttgtatcaaaacgttagaggagcctgacttggaattctcacctctaagtctacccagctctgccagtgtcgtgacatgaagttctttctctcttatacaatcctgtccatttggcctacgtgcctagagcaggggacagccaaagcactttttccctctctgaaatggatgctacatcacaccacagtcctgggtgccgttagctaagagggcagctttgtgacatcagaggccgctccagggtgggggcctagttcagccatactgttgtccccatgtgcctcttttttttttttttttttttgagacggagtctcacactcttgcccaggctggagtgcagtggcacgatcttgcctcactgcaagctccacctcctgggttcacaccattctcctgcctcagcctcccgagtagctgggactacaggcacccaccaccacatccggctaattttttgtatttttagtagagatggggtttcactgtgttagccaggatgatctcgatctcttgaccttgtgatccgcccaccttggcctcccaaagtgctgggattacaggcgtgagccaccgtgcccggctccccatgtgcctcttgttttcccaggtgttgtcaggttatgggcagtgccctcctggagttacacaaagttaacagtatccagtcttgcctttacatgcacacggaactgacttacagtatttactgcctcagattacctgagaaaataattgcgaggacttttttgaagaatgactcatctgagctgacatttaaaacattgttgttaccttcttatgagtataatgttgtctgtatccaagactgcaggttatcacttaagggtttgctagtgaaatgagttaatattatcacctgtgtcacatttacttggggttttaaaaaaatttctaacaagaggatttgttttcttttggggaatggagaatgaggaatacgtaggaaaactgaaagtaaaattatacaccaaatgtggtgggtgttgcaaaatgttcatcttttcttttctgccatgttgaaaagtctaaactccctctgcaaaatcatcgaaagccttcatgtattaggtagtatttttgtgtatggattaggttcttaccatgatttggagagataagtgagacatggaacttcgtatgaatcataccagctcactggccatcgtagattctcagcctgatggagaaatttcatttttgattagcaatatgctccttctccactgagctgcctccctttcatcttttcttcccccacataagcatgccacttgaaagaaacactgttttatgcttataactcttaattaactgtggttaccaaaaaaagagggtagcatgaatagagaaaaacttgaaggttgtcctgagctttatttttccaatttctacctttcaccaaagtaccatctttttagtgatgccaaacattgttacgttgttgacttgttgtgtgtcttctttttttttttttttttttgtatttacaagattctagtaaagcatgaagtgcttagagacttgtaggaagtagaacaaggcaaggcgagttctctgggtgacctggaaattcccttgaaaaccttgtcagttttcttcctcagttttctagaaggagaaaagacaaagccacaaattaaaactatgaaccacatcttccgcccagcatgcttagttttttcatgagctgtgatcggttcagccaatgcgtgtactcccaggctctcagactgagccagccgcccgtcctggagccggcactgggcccgcgcccgtccccgacagatggccatccagccctgctggagcgcagcgtcggttcgagtaggccaatcccatttttggcgaaaacagattgttagaaagctcttccttaaatagagtcagatttttacatttctttaactttcttccttcctttggctcttattctgccctctaggcctgtgctgagtaggtcagatcctcttctgtagagtgtcagccctcccataggcttggtctcagttcaggcaagcagttcttgggaaacattcctgttaagcattagctattgtaaaaatacagaaaaaatgatgttctgaacccctgtattgagtatagcagttgatcttcatagccaaaaggcccttggggatcagtatccccgtcatgagggagaaatatccccatggttagtatatattttttgttttgatctctttatcatgctcacctggaggtttttgttggacaaagggatgttgttatctcagcatgagttttcccttgccctgttgagctgcatccagtggaagaggaggcacccccgatcaggtctcaccatcatgcagtaacttctgtgcacttctgtgcaaagcttatagatgtggcgttgccaagaaggaaagtgagaatgctttccatagcccctcctgcctctcattagttgcatttgtgtgtgtgtgtgttttgttttttgttctttgttttttggggttttttttttgttttttttttttgctaaaaagataggagccaaagtgttcatggcttcctattactgttggtgatgataattaaacaggtataccatcagaatgacagtatgactttaggccaattgtgcagcctgcagaaattatccctgctgtgtattaggcatggaaacagcatcaaaagtacaccacatgtatactgaccacggtttgtttttgtttttgttttttgagacagggcctcactctgttgcctaggctggagtgcagtggcacaatccctgcttactgtagtattgacctcaggtgatcctcccaccttagcctcccgagtatctgggactacgggcatgcactaccacacccagctattttgtattttttatagagacaggattttgccatgttgcctgggctgatctttaactcctgggatcaatctagtaactcatggcaccacccacatttgccatttttactgctttgggagtccacctaattcataaatccatggtaagattccttcctgctttggaataaaatggcaccggcctccccagcaaaaccacagtgttgtgtattgcatctccaactgtagattaccctaactctgtgtagttctctcctgctttcttgtactcatttgctgtcctgaagttgttaataaacttaattttgtcacatacagtactttgttaagagtagcttgaggaaagacgtgagaacctttgacaaaaagctctctcatgaaagtatttacctgctttctttctctgcaataatttaaaattgattaaagcaacctgagctcttattttcacatgggcaaaacatttgtatactggatctcttctcatattcagcttatgatcatgaatagtcagaactttgccacagataacagggaacaatgatcaagaactgtttctgctggcagaatccagttgatgtttttgaagggctcagactgcacagctctgagctcagtggagagcggtcctgggctgaggtctggccttaatactgcaactccacttagaaaattgtgcaggcgaggtgttgtaaaagcactatgctacatcttttgagatggggaagctgctcccagggaggtatttttcaaagattttccctcaagctactgaagagcagttttttgttactactttatgacaccagctggagccttgcaaagccccaaaggttaattctcttttcggtggttaacataggcttaagggctgactcacattacccaaaaagttacggttccatttacaacctgatcatatcctcaggagggtttgttcacaggcccacctgcccgtggctcaccctgccaccctacctacctgggacttctgcatccagcgtcacctgccccagggctcactcctcagcattcctcccaacaggaccacacctaggcctagggtggttagaaacttgcatgatcagccccagaactcctgcctctgatccaacccagacctgggagcacagaggctactgagagggctccctaatgctaactgtgaaacagcctttgcactggtttgagctgatgcttttggatggggacagggtggctggcacccgtgggtgaaattgacagggttctgagaggcatatccctgctaggatcaactttggaattgaactgatcaaagtcacaaggagtacagctgtaggattgttacgtaagatccaaaagcagtgaaaagcaacacttggtgttagaattaagattacagtactctggagggagggaggcagagcctcagtgaaggtacaggggcttctgtcttggtgatctgccctggggtctgtggggcaggctcacgggcacacctgccttggaggagtttgcaaagctgactgcttatttctgttggtattatacttccgtttttaagaaatttattttagaaaaatgtcagttcaaaacaacaatcagggctgggcacgatggtttatgcctgtaatcccagtgctttgggaggctgaggtagaaggatcagttgaggccacgaatttgagaccagcctggggaacatagcaagacttcatctctacaaaaaaattttttaaaaaatagagcatggtgtcatgtgcctgtggtcccagctactcaagaggctcagttgggaggactgcttgagtccagaagttggaggctgcagtgagcagtgattgcaacactgcactccagcctgggccacagagtgagaccctgtctcaaaaaatgagccataaaaaaacaaaaacaaccatcagaacaacaaaatgtcagaacttttagagttcctgcatccacaaggggaccctacccaccaagtgccagcctccgtcccagaggtcaggatggacagagcccctgctctggtgtagtgtgtatgttccacacaggctcagggacctgctaagccgtaggcgtctcagaatgaggaggggcatcgcattgctggagtgaagttcacagcggggcatggaggatgagcgagcatgtagtcagaaccgcatggggaggccttactgggctgtgcacaggactcaagcatctccactgggtgatcacaaacagttgaagatttgagcaggggcatcccatgttcctctgcagagctggggaggaattggggatgaagaaacgtggaaagctcagagaggagaacacactggtccatagagagccgtggatgccggcggcgctgtaatggagatggaggagtgtagatccatgccccgcccgcctgtgcatttaccaggattgcctctcatgcctggattaaccattccttgcgactgcaacttgtggggcacacgagatggggaattttctctctacttcttccaagtttccactcagtgaagccgtggatggagccccaagggcactattgctacactggaggaacccaaggtcgttgtggatcccgaaagaagggacttggggcaggtggcttaggagagtcaaacctggtgtggaaaccctccaggcagcagtgaaggtaacaattgtttacggaaaactatcaaccattttctaaattgagttcttgtgaaagtaaaatatagatatgcctttactagggagaagagagcaatttgaattacattcttcagttactttttacacctttatggagtctgattttagattttaagtggactaacaaattcctcattatgtaaaaaataaatatctgcctggttttaacaatagatgcccttacaacatttttaaagcattaagatcatgcacgatctttaaagacaatgtatacagacgtcacatgtcttgtgaaaggaagtctggctcgtgcaccaggttctgaccacctctctatggggaaggaagcccacattaggtgctgtgtgctggatccaggagccaagtcgctttccttctggtatagctacctgctgaaagtgatagtggctgttggtgccgttgaggtttttctctttttttttttttttttttgagacggtgtcttgctctgtcacctaggctggagtgcagtggcacaatcttggctcactgcaacctccacctcccaggttcaagcgattctcctgcttcagcctccctagtagctgggactacaggtgtgtatcaccacacccagctaatttttgtatttttagtacagatggggttttaccatgttggccaggctggtctcgaactcctgacctcaaataatccacctccctcagcctcccaaagtcctgggattataggcatgagccaccgcacccggccagtttctctcattttaaagcacaccaagtcttaccacaagaatcatgctcagcaatttatcttaagatcagactggcctggaattctttcctccctccctccctccctccctccctcctgcccgctccccccttccctttcttccacctgcataatggctacaagaagtagcaggtggggatcagggtaactggctgtaaactgcaaccagggaaggcagccctgccccgggtaactaaaggccctttagttagggttagcctgcataaatacatgtaatgagagcagcaacagcttgcaatttatacagcactttgcaatttaccaggcggcttaacacttacaggcatttttttatatcagtggtaaagactctagaattatgtctaggaagaattagagggcttcagactagtgggaagggggtcggtcttgagcctgtgcttcatactaagcatgctgattttacttagatcgaaagacccaggttagtcgagtagtcaagcaagattttagttacatggtacataaatttatgaaaatgtccagttcatatgaaaatatgtaatagcaccccaggccagcctcagtagtgttactaatcacagatgaaaaaatgaagcctgagaacacagcagtcacaggtacgagacccagaggggacttcagatctaatctgaattatttttcctctaccaaattgactatctggatttagtggtaggccgctttgtacgtttggggggactctgtcccagagtcagaattataccaagttctttgttttagaaatgagaaacctcgggagtaactagcaagccttgaaggggttcaagggtgaggtgatagtcatgtattgatataaatttactgattttgatgaatgcccttatttgtggaaatacacataaagtattcgggtaatggaacatcgtcttggcagcttagtctcaaatggcttggggaaaataatgttttttgcgccgtttttgtaattttcctgtgcactaaaagaagcagacatatcagcagtggtttagagactaccctaggccgtaaaggtagctgggagtctggagacttgggctcccctgctgtgcctgggcagtgccctaagtttggcataagcctttaagaggccagaaagaatcatcgagtatctgctgcagttggacttagaacatgagaataataccagatgtcaacgtgcccagctgatgcttcacagaatggttctaacagtacatgattcagaactttctctaattattcatcatatctatatccccagcatgcaagtgaaaaccatctctgcttcttgctgggtcaccccaggctgttttgagctcctgggctcacagcctctgtgattgctgggaaatcggaaattctcatttcggcattataggattgtgggtctgtcatcgtgattataaatattctcacaggtctcaacaagggcagagctgttcatctctgaaatgaaatgtgggtaacaaatgcagcagcctggttctcgtggaagccgagtctaagcttcagttgtccctttctctatcccttggaaatcccgtctgagccactgcattctctgctgtgagtgacctttgagaacagtaaccaaaggctttgaaacagggatgcagacacgatgcagcaaccccaacagtgtaatagggtgtgttccgatcagaagggggagcctggtcagatgttatttcatctggtcgggatgtgaaggaaggataaggcttagtccctgactttctgaagcttgtatttgtaatataatcgggaaaataatactggcacaagatggacagtcctcattcaaacaatagcactgtcccttcctgtccaatgggaaactagggctgagttatgcagctcgggcacctgtgctttcagagagcatgtagcattgtgggcaggagggaggactctggagtcttcgatcacctgcattcaaatccaggctttgccacctactgctcttaatcattgagtgactttgaacaagccgctgaagcttctgagcctcagttgcgtcgtctgtataacgggatacgtgactgcttgtctcataaagtttttgagaactgaaggaagtcattcatgtgaagaatactctgagctgggttgagacttggcgagggggggtggggtctcacttgagggatgcagagtgcaagtgaggatgtgaagacggaaacccataggtgtggggaaggccatcggcgagccagccggactggggtgagcaagagggctggggcagcctctggggtggggcatgccacaccgtaaaggccctgggtgtgaaaaaagaaccctcggaggtttccacagggcttaagggggagatgagtgctggggtgtccggcaggggtcctgatccttgtcttcaggacacgactggaagggcctgagcctggcagtgggaggtgggggacggggcctgagagtgacccagggtgacatcccaagccctgagctcagctgtggggatggaggacaaaagagaaaaggaagattttgaaggaaaacccctaggactctgttgactggatggggaacacctcggagaagtattagaatgactcaagagtttccagcctgaaggaccaacagtgacccagagagtgggggaagtaagaggagactgagccacggtgcgtagtggagtttgaggttagggtgggacgtcagtaggatgcagagaaggctgcaggtgtgaatctcaggcttgggaggtacacagttatccttatgacatacttctttatgtcagtgaattttcattttcagatgtgtaaagataatgtaatccagggcctacctcggagagctggcacttctgaggcagctgattaggtacctcagccaggcattcaatttctctcatgttaaagactggacctggccttctcttctttgtccctttcacacatgagtttggccctccgaacccacgggaaagatctgtaacctctagctcacatgtgcatgtacacacacacacacacacacacacacacacacacacacacacacacggttccctgcaaatggatgactttagatgcagttaacaccatccaaataatactagaaagaataacactggaataacaccatccaaataacacgagtaccttcaactaaaaagcggtcaccagagccctccccagcaggaggcctcttggtagctggtgtcagggccgcaggctccctcagccagcatcagtgctccctgacctccctgctgaggagtatgtggcttccaccctgaagccaaacagaaagctcatgcagtagaaaagcctaaaccaagtcccccaaactaatctcacaagcgttttcccagcaaatgggccgtgataattatttctcctcgagtgcctaaagtgtgctaggtacctgccaggtgcccgaatatgtttttatttcatcttcacagtaagcctactagggaaatcataatagcctcattttgcatgtgagaaaactgatactcagaagttaagtgaggtgcccaagaacacacagtacgtgctgggactgacatttgagcccagtgtggcctgactctgcctcttgtgattgctgttcagtctcaggaattgggggtgctgattggtgtgggagggagatgcagttcctgctaggcatcaatactggcgactcccacccacacgactgttgaggttatttgctgcccttgcgctagcccccaaaatgctaagggaacagttccccagttctgcctggaccctagggattcacgtctttgtaacttttcctggttccttaatgttgaggtgagcaagagccattaatcaaaataactgagaagctgagtgtcataggagtatactccttttccgtaattgagtttaatctgggagcagttttgtcagcacacatgtgccgctgccgcatgagtcatcttcagcatctttgtcatcagtttctttgtatggcacagttttctgcaaacagatattcctcagaatcataatctctgaaatgcctgagttttataaaactattaatcagttgtcttcactcttaaagacagagatattattattattattattattattattattattattattatttgagacagagtttcattcttgttgcccaggctgaagtgcaatggcaatatcttggctcaccgcaacctccgcctaccaggttcgagcaattttcctgactcagcttcccaagtagctgggattacaggcatgcgccgccacacccagttgattttgtatttttagtagagacaaggtttctccatgttggccaggctggtctcgaactcctgacctcaggtgatccacccaccttggcctcccaaagtgccgggattacaggcgtgagccaccgtggccagctgggatattacttttaaaatttggaaactatagaaaagcataaaagagaaaagcaaatgctccgtgatcttatcactcagaagtaatcacggttgacattgtgtctcttttcccagtgttaatataagtatataatcaagatcctgttacacagatggcttcttgctgttgtcagtactagctgtcacagtgcagttcatctgtaacagcagtccccaaactttttggcaccaggaactggtttcgtggaagacagtttttacatggatggtggcaggaggtgggggcgatggtttcgggatgaaactgttccacctcagatcatcagcattagatagatgctcaaaaggagctcacaagctagatccctcacaggcgtagttcacaatagtgtttgcgctcctgtgagaatctaatgctgcaccgcctgacaggaggcagagctctggtggtaatgctcgccagcccactgctcatctcctgccgtgcagcccattcctaacaggccacagaggtactggtctgtggccccggggggttggggacccctggtctagagaacatcaggcttttcccacagggtacttggtcctgacacaggctggaaatgagatgtacccagtaatttttggtatatatgcttcctgggtgttgagtgcttgggatgctcagtgtggcttatatattctgtgagtcatgtaaaaggagaagctgattctttatggtgcatttgtcttagaagtagtttgtttttctgagttgaatgttcttcaggaatgagaaaattcctgttaatcatcctacataccattcagacatgctttctaaactaagccgctctccaaggaaccactttttcctttcaaatcagtacaaagccaaactgttccccttaaaatgtttgtatgtaacataaggggaagaaaattcagctatcttaattctattttaaatgttccgcttctccaacaaattgtttatcgtctctttatcacgctaagacaaggactctgtgggttttcagagatgcatttaatacttcacgtttacttttcatgtctctgttgtataatttaccattgtatgaacatgaattaaatataatgtatcagaatttagaattcattaaaattctgtcttgcaagattgttcataataggaagggcccacataacatggaatcttcggcagtagttgtggtgccagacaccccaaaataaatgtgggtttgtttttgtgtatctttagcttccaagtatttagaaccaaaaatgtaaaacaaatcacaacagattagtgggaggatacttcgagagaaaatagacacggattgtctaaaaagatttctaatggaggacaaggcaggagagaccctgggaagtgaaggtggggtccgtacccttggaatactaaggagaatcaggtgtggagttcacagtggggtgtgtgggattcacattgctgtgtgcgcttggctgggtgagagccagtcgtgtcctggtgaaaggcaaaacattaggcagagcatttcccaggaactggcatcttggttgcttcttactaagatgatctcaccctgcttcagcttcctaaagatcaccccttcctaactaattacttgagttactcaagcgggagtcttaagtttacgaataaagaaacgtgaaccaaatatgccagggaattagagaaccatcttcctagcatgtttctgtctgcatttacccatacggtgtgctttcttttttaggtgctatccatatgtccaaaatgttcctttgctctattccattttagtgtctgtttcctggaagcaggtatgaggctactgagagagcgctcgtttactggcttgatgtgtgaagctgcctgcctgcaagcaggtgggcatctgtagggctcctgcatggcccacgtgctgccttggtgtaaccgatggaccttggcaagtatgggtggagttgggtgtatttctgcacatcagcctgcattgactcatgtcagtttttgcccagaagtctgtccctatgatcaactcctccaggctgatgtgggtttttctttataacttccccttccgtttgggaattcacagattttgggcacgcactcaggttgtcctcagtgacccccacagctgtgagagccacccagagggcaactgttcataagttaaaggctggggtggcctgcgttccttcctggaagcaggccgtgctgaggcagctgttgatggggaatcttgcttggttttgtgtttttgtttttttaaggaacatagttgttgattgtctgatttgtgaaatttacaagtgggtgtttgtaaagtagagatgaattagtggtaaacatgcagttcgttctaatgctgctaattgaagttgactaaatctgtaatgtttaaccggctgtgctaagaaacttcattcagtggcgagaaaggttggttgtgtggtgtccaagaggaccacttgatccccttgtgcttctactgtgggttttctttttcttcttcaaagcctgctatacacagttacgtttaaaaagtgaagttaatcgatagtttgcactatctgtagaattctggaaaggcgatagcctggctcagcgcttttctatgaaaatgaagcagtcgaggcccggggcagccaagcgacttggccagggctatgagtctgcctcacagcaaggccaggagtgggcccctcgcagcccaggtttggaggctggagcccagttccatcaaggcccttctccaaagcacggaacaggtggaccgcacccaggcgctccagagcacttatgtctcagtaacgtttgtttgtccaaagcagcatacgatccagccccgctgcccacccttacctgggaaacggggctcctctcatagacccacagtgctccccctagcctgttcatacgtgccctcacatctgagctgctcctgaccctgagagccgaagtgagctgagactcacccctctggagctttttagggaggatagaggtgcgtgcataccttgttgagaaagtgccacaccggatcctgcatgtgtccctagccataacagcgaactggtatggggatgacaacacaatggcagccatcacctgggctcctgctgcgtgtcaacaccccgctgagtgccatcctcagttactgggccctcataacagccccacgggtaccaggggtttccttgtgttacagatgaagacatgtagatgcagagagatgttacagaaagtgccaaagccaagcacgaggaggcagagaggctgggctccagagtgttctgagaagctggcacaagtacggttcggctgtgtctttgccaaccacgtgccacctgcgtgttcccccgtgaatgtgctgtctctttttgtgtattcgtcacatttcactttcctgagcaggtgtggtcctgcagaacagcaggcgtgctgaacttttgccagtggattgacactttaagcagtgctccagaatgccgtgtctcatccttgccgcgtcttgtacactcttttgcatattcaaaaacgcttgggctcatggatctggtatatgtgttgagaggtactaaatatgtatttttaattaaaaattataatgaaaaaaatttttaattctcttcattggcatctgtgttcccatttgactttcattcacatttgtgagaaaattctatacttttagaccatttttttttcaggtttaaatattctatcattttgtttgcctgcctgctcacaaaggaatgggctttcttatgactggagtggaaagtcaggttcagagccctggacacaaggacccatgtggtggtcgggagggtgggtcctttgccccaacacctccctttcagagctggttcctggtgtgcccacccactggcaaagggactacctgcgcatagagatgttggaagacactcggccccacctgtatgggctgaagtccatcagtgagaccacagtgccacggggccaagcaggggccctacaggtgctcctcctaccctccccttcagagagcagccagctggaggctgaggaggcagggggccagcagccctaacccccacccaggcagggtggctgcttggggtttccctcagggatggcaactcccttctgtggcatgaggcttcttcctccctgccatcctgtggcagtcccttcctgaacttggggattttgaatggcgcacagtagaatgtttcattatggggtatgcatgcctagaaataagaaaagtcaggccaggcacagtggctcacacctgtaattcccagcacagtgggaggccgaggtgggcagatcacttgaggtcaagagctcgagaccagcctggccaacatggttaaaccccgtctctactaaaaatataaaaattagccagggtggtggcacatacctgcaatctcagctacttgggagacggaggcacaagaatcgcttgaacctgggaggcggaggttgcagccaagatcgcgccacctcactccagcctgggtgacacagtgagaccctgtctcaaaaaagaaagaaagaaagaataaaggtaaatatcctggagttattccagtctggggaaattcagggtggttcaggaaataatgtaccacagagccaccagacacagccagtaacagcggtgctttcaccctaggagcaacatcactgacatacgggtgtgtgagtgcccagcacatcgtaggatcttggtggaagggaaggaggaagaaatagctgcagagcagggtcagcgtgttgtgtgcttgggaggtctgctcatcgtgatcctggcctcctactttcgctcacacccctggcagtggaggtgcctgtcactgcagacacaggcctggagggtcgatgagtgcgtgtgaaatcggggtgatgagacagcgagtgaggtttattaattgcagatgtgtattgaatgcctgctccatgcccagatctgaggccacgatggtgactttgtttgtccttcccaaggagataaatacagagagatgaggaggatggtgagctgagcaccagtgagcgctcccacagcctgcgggagacaggcctttagacaggcaaggtgctgtcaggcgctgcgccacgttattgtagtgctggttactgatcaaggtgctccgcacgctttgggatcaaccctcattttaccatggagggaaggccagtggtgtttcctcatgggctgtgttgcctgcagtctgctcagggagatggggatttgctaagcttttgaaaaagataatggtttttcttttttcttttttttttgagacagagtctccctctgtcgcccaggctggagtgcagtggcgcgatctcggctcactgcaacctccgactcccaggttcaagcaattctcctgcctcagcctccccagtggctatcataggcatatgccaccacacccagctaatttttttgtatttttagtagagacggggtttcaccattttggccaggctggtcttgaactcctgacctcaagtgatctgcccaccttggcctcccaaagtgctgggattacaggcatcagccactgtgcccggcctggtttttgttttctaaagctaaactactagaggtaaaaagtttcctgggtcaacttcctaaggtcaattaggaccttagagagcggggaggaaactacatgacacctgacaacaacaggaacctgaagggacagttttggagatgggctgagatttcgtgcaagggaaattggtgcccaaaagggacatggaagactggggaagctgtcaagaatacatttactgctttttctccatggtggtcaggaatttagaatttcttcttccttaaacgtacgcagttcttaatggtgagattattttctgccagcaggacacttagaagagaaaggtcagttgacgaatatttttgctttgctcgacacgtttctgccagcctcagctggagagctctatgctcctgccctgcccagatccctctctgcagctacgggatcagctgaaggtgcctgctgctgcttgcacgctgtcacccgctaccttccccccgccaccaggcctgccctgtgcccttgctgttcacagtgtggccctaacacctccttcacatcactgaatggctctgagtccttctgctcacagccgtggtgtagcctgtcttccttgccacgggtacttcctgtcctcacctgagcgcctccgtgtcctgcgggaccgaaagagacatgctcagggaggtcctccctgacctcctcctctttattgcgattgtcaccgttggtcatctgcaacttgggtttgtgtaagtgattctctatttcactagtctgtgaggtttaggaggctgggtaggttcttcacactttccctcaggctgagcattaaacaacaaatgagcaaagaacccttcttgagaactctgaagaaatgaagaaagaggtacagccagaggtggcatttgtaggtattctagtgtaaattcatggcagagccaagggacagcatttcaggaaggaatggagagcatcgtgatctgttagttgactgaaagtttttgcaccttaaatgccatttgttgctagggaggagtcagaaatgattcggagaaatctctgaaaaagtaactgagtcccctttctccttcatccggggacacctctgttgagcagtgagtacattctgatgcccttcccggaagtggacgttagcagcgcctgtcctctgcctgtcttggcaggtgtgctgtgaccctggttggggccagaccagtggcatctggtgccctcacccggctgccaggaaaggtcactgtccttccatatcccacacccccagttccatgatccttggccagcagtcagtgtcatgtctgagcctccatatgacaaaaggaatgggtgtcagctgaagcagctagctgatggcatttgtgcgtgagtctcttccaacttaaatttgaccttgtctgaaatcgatttgtacccaaaagtctgtcccactctcatgagccactctcaggatgttctctgaccactgtgcctaagatactggccccagtgaattcatgtgggcccaccctaagtcaactctgagagcccccagaaaatcgaggttacatcatgttggtctgtgaggcctaatggatgtggcctcccagcatcacaggtttctcattattactcctgcagtaaatattttaagcccagattctccaggcttaggaaacatgcacgccacccagctatgaattatgtctgctgatccaccgccaccaccaccctcactcccacacccaaaacccttggtcactgtgttcttttcagctcacccatatttaccacgttttcagatgggaatcaacagtttggctcgtttaaggggatggttggggagaggaacagtgaggctgggggaagggtggttttattttttgggggctcttaattgaagagactgaaagtcaactcaaaagtaactgaaggggaaaaaaagaaaacgaaaagttggctcagatgattgggaagtacgattggatccaggggtgcaactcttggttggggcctgtctctctgagcctctccctgctcacctctgcccttcactccttacatgaacctctgcagcgtgggcagatgctgctgcaaccctggccatgtcctcctagggacggtatttcccccatgactgtagcaagggtcccgggagtgccctgaccacacagatatgagtcatgggccttcccccatggccagcaaaggcgggggaaggctcggggtgagatggggcccttcacagagaggaattttgtttgactaagagaagggacaaagggttctgaacagattaagacaatagaaccatgacattaatctcatgtggccgccctttcaaaaaatccttaagttgagtgaatttgagttttttccctttacctattgaaatattatgatgataaatttgtgcccttcgtactctgaatagtggaagctaatcttagcagcataactaaaaaagtagatgcaaattaaatgaatatacagcaacacaaaaacttgtagaagctgagctgaacgttagttatattctgactcttatatggaaatgtactttggtcactttataccataatcagatcttatctccatagtatttaataaaagctttttgtaatatttagctgactttaataataggttctgactctagtgggggaaacccccacagatcaataatctcgattcttagcaaaaatagcattttcaataaaaggaagttttctgattaaatttggtttatgttacacatctgatcagtagcaaaaattaaatgattttgccatagagcccccaaaacttgagcacaccgcgtctaaacgaattggcttgaatatgtttccaaagtaccaagtttgtttgacgcttcagcttaaatctcccgaactccagctggaagatgacaggcagagcatgttttaaagtcatctgttacaacatctcttcatctgaaaggggatataaaagattttgactttaaatttactgacattaataatgtatgacatattcaggcttttattaggacccaatctttaatgtctgtaattttattcaggaaagttaaaatgtgcttattatcaataaaaataaaacttgtgatcagagatccagtagcttgatgctgcaaaatcaccaccaaagcagaaactatagtttacctttaaatccaagtcagctatttgccacttaaaattatactttctgtctgctcactgagtgacaaatgttattacctgcagtacacatgttattttattattatgaaatgcagataaagtcatggcacagttggtggctggtctttaatgtggcacctgtggtggtagcttggttaaggagtttgttcacactccttgctgtccatcttgggcagctctatgctcaggagctctgtgtccttgccctccaacctggctgctgactggcctgggagacctcaggcaaatgctcagcctctccaagcctctgtcactcgtctcatctgtggagcacactgtcaagcacccagggcccctgtgtagagcaaacagaacattgcagctgctggaggtgctggcggtacggggtctcctgccccgcccagtcccctgggctgtacacacatggaatcctgggactcatttcccacagcagcagcctgagaacaactggccaagctgctgcagactgaactgcaactggccaagctgcctcagatcgtgttccccccattcatatgttgaaatcctaacccgtaatatgatggtattgggaggtgattatgtcatgagactgatgccctcatgaatgggattcgtgcccttataaaagagacctcagagagcacccttgctgcttctgccatgtgaggacacagcaaggaggcaccatctgtgaactaggaaatgggccctcaccagacaccgaatctcctggggccttgacatggggcttccagcctccagaatggtgagaaataaatgtctgtaattttactttataagtcagttggtttacagtattttgttataggcgcctgaaccaattaagataccatcagatctctaaggtttcttctagaacttaaacaccgtaattttatgatgatagatttaaagtgcttgagatgcttttcagtgtaagagttaaaatcctgctcactgctgagcatgtctatgaaacagcatcttgctttttttttagttactttcattctttcattctttttcatgcaaagatatagcagtttatacattattgaacaagctgtagataaagtcattactttgtgagaaaatgctgcttcatctaatacacagcatgccagccattggaagggttttgtaacggtcacattctagatatgatcatcgcaatatgatttatccaaagcatgctgctgtgacacctccaaccaaaatgctcaaaaccaggtaaattctgtgcagtaggattttatgattaacttgagaattgaaagaaaaacacatcatttcatctcttgtctcaagtcttgctaaaacacatgaccgcacaccatgcctcggtaagggcaggatgggaggcattggaactgtctgggtgttctgcatgggtgaggacccacctacctcacgtctccctgaaggatccacctggcctgcagcctgctttggagttcactgttgaccccaaggtgagcaggctccagggacatgctagcgaatgtgctcttccaaaatgcaacatagaaagactggtgagcaggggccctggatgatgggggcttccagtctgccatgttctggttggctatggtttcattatggtagctaaagacagcccaaatctgagaagtgggtatgaggatttgcctgtcttgttgagaaaatatgttaaaattctatgagaaaagaatcatgttaccctgttaaacacacattggacttcaaattgtgcttctgttacaactggaagcagtaggtggttttactttaatgaaagatgaggcgatgaagcggagatgtgtagaaaaactacacagagagaatgaaaggaaactgggatctgggtgccgcctctttacctacaaggtaatgagtttgccttcgaattagagagaggcagtcgcttagagcctggaccactcagggacttgccctcggtctggacgcacagctgcagtgctccgtctcccagacatgcatgaatccctgcttgttctgcagcagaaaccgtccctttgagatgtcccggctgccacctggcggggtcacagctccaggtgaagtccaggcaagaggagaaggacaagggatcgctgagtcccctaagcctgcccccatgtaaaggctctcctgactctagggttgcagtttacttaattatcctcacacagaaaggccacctgcactcttggtgcatttttctcttcccactcctcctcctaccactgagacaccttgcccaggcacccttcccctccctccccctggccacagctttcttgctctggtatccttagcagtcaggagggcggcacacattaaatcttcatatgccagcattcaggatctcccatcccttctgttctagatgaccctggctctggccattgggcaggatcagggtgcagggaggagaagggacctgctttctcagcaacccagcaacttggtcccattgacgtctttcccacacagtacccctccagcctgctgagacctattaactgctgttctggggccctggcctgtcactggtattacacttcttatccaaaatcttcattatctgaacctcagcccctcttccatctggagacacaggggcctcttcattctgtagagaaagagaaaaggtttctctctgcttgggcatgcaagcaggcagggagggagtggagtagattcttggcaccccaattcagagtcctagtttcatttcctatagaaatcatattacagatgataatgctttccataaaaaccattctggacaccagccgctatcagaactatgctccttcactattatggattgaatgggaatttactgggagtacagtctgtgccacatcactggtgggtatgttgggccaattcctttacctcctgtagcctcagtttccttatttccacaaattaagaagttgcccactttgtcacaggactgttgtgagggtttagataacatagtaaagtcaggtccctctccatctccagacacctgcctcttgaatttcactgcaccagcagctacatacaacattgctcccatggaagagtgtttgcttcccaggtgtcaaagtctggcaggcaggctttctattttgatggccatccaacactggtaggatcatggccaagtgtttttaaagaggactttggccctcttttggtaaagtattgttcagagcaacaagaaagccacagcttagttaataagggtaatcattgttatccacagagcacttcctgtgctttatagcatcagctgaacgctggtgcctgtcatgggccagattgcatcttcctgaaattcatacgaagtcccaatccccaggacctcagaatgggactgtgtttggagacaaagcctttacaggggtgattaagttaaaatgaagtcactggggtgggccctcatccagtctaactggtgttcttataagaaaaggagattggaacacaaagaaaaggagattggaacacagacacactcagagggaagaccatgtgaagacacacaggaagaagacagcatctgcaggtccaggagagaggccttgcaaggaaccaaccctgcccacaccttgatttggacttccagcctccagaattgtgaggaaataaatgtctgttgtttaagccacccagtctatggtacttatcatggttccctgagcagactagtatgttcacatttggggggtaagaaaaccagtacacagagagacatttattaagtaatttgactaagagcatgcagctctctgtcagtctgcactgaccctctgagttgcgccaaagactatttagatcacattcaagcaaaacaggtaaaatttccgctgcatgcttgctatgtgcaatgttccagtcttgatggagaagtataagctctatgcaggcagaaagcatgcctgtctgctcatttcacccctcaccaaagtctagtttgctgcctggtatgtctcaggaactcagtggctgtattaattagattactgtattttgtttttgaaagaagtcactaaagtagaatattcgtctatcagttataaagtgtctttataacgtattgtgatggccactatcaaatgtcttttttgctgatcttttcacctttatcttcatggcctgatgaatattccgaaacctgctcttccacaggcgttttttctcaagtagcttttgtaattcacatgtttgcaaaggtctattaaaagtttattgttcaatgttatttcttgacatcattgttgccaataaaagttggcctcagcgtagccctcacgccccggcttgctagctgttttgataaggccgtgaggccttcctggttgagcttcgggcaccactgccttctggacaaaaaagtttgctttcatggatggcctgccttctggattgtggagctgtggcggtatcatggtgctttcattgtgtagttgaaccatcctgcatttgaaatcctatgaaaggatgagttctcagatttagaggtttgtgtttttatataagttaacacaaagtagaaatctaagcgtttcacctgttctaatattctggcttactcttgtgtttcccatgcacatgcataaaatgtggtacaaagagaaacggcagaggccattagcataaatgaatcagtgtatttgctctgaaacgtacgtggcctcacatgcctcctggcgccgcgtgggcacatgtcccagggtagtggcagtgggaggggggcagcagcccagctctccaccattgaggacaatcagcctttttaccctcttcacctcctgcccactcagcaaggccatagaagcacaagtaattcttaggactgatcgccctttactctagtttaaggaagaaaaggagaaaggggtacaagctacccatggaagtgcttggaggaagtcattttgaggagtctacaaatgactaaacctccacactgattaaggtagaggtcgaagcagagctgtggtgggagcactcatctctcaggacagctgaggaagggccagtctgcttgtgtggggtgtgtccccagctctggggctgacatgctttcctctcctagaatgttccggaattccgtgcattttaacacagttaaaacatttttaccttagggcttttctagcatttttcctcatgcacaggaagaaatgtttctcaatctgattcgatactcgtatctgtgactgaagaaacagtacttactgtaattgtgtttgatgcactgaaattttctactttattcccttaaattcaacacatacctataggctggttgcagcccattaaagtgattttttatgatccactagtgggctttgaatcacagtatgaaaaaatttgccttcgattgaaggtatcagctaagttttcctaatgcactcatcacaatctgttgtgggaaattagtctgctgttttgaaagaagagaaggattgtaagaagagaagaaaggtgaagatgatgggttttgcccagtagggctgttatgctgcccaggggtgagggtgggggcagtgagtgtcccaggagtggaggaggcagcggcaaggcagctgggggcagggcaggttatacaggctgcgttccctaagactggatggtcttagagttctaacgggtctttgaattcatttagtctgacttcccacccattctaggaatgaaaaagatattttctctgcatttatactttatttttctgagaggcgcagggatgctctaaaaatggttatttcagaaggaaaccacctactcttgttatcttttgtgtcactggtattcccgcattttttggttttagagacagggcctcactctgttgcacaggctggagtgcagtggagcgatcatggctcactgcagtctcaactctggctcaagccatcctcccacctcagcctctccagtagctggggccacagatgtgcaccacaggtggctaattttttttttttttttttttttttttttttttgcagacacggtctcgctatgttgcttaggctggtctcagactcctggcctcaagcaatcttcccgcctgggcctctcaaaggctgggattccaggcgtgagccactgtgctggccctgtgacatgtttttatggataaaatagatcaatttaattctcaactttaagtaacttcgcaactacaggaggcagctgccagcaaccgtatttttctcatggtaattacagtttgtaagcactgtccatgtgtcgtccccttgtatttaaccgccagagaaactgcgtggaaatcccggtaggctagggagtgtggtggtgcccaagtgccctgcgccactgagccttgctgtgtctccacaggcctcggcaagacgcgcaggaagaccagcgcgcgggatgcgtcccccacgcccagcacggacgccgagtaccccgccaatggcagcggcgccgaccgcatctacgacctcaacatcccggccttcgtcaagttcgcctatgtggccgagcgggaggatgagttgtccctggtgaaggggtcgcgcgtcaccgtcatggagaagtgcagcgacggttggtggcggggcagctacaacgggcagatcggctggttcccctccaactacgtcttggaggaggtggacgaggcggctgcggagtccccaagcttcctgagcctgcgcaagggcgcctcgctgagcaatggccagggctcccgcgtgctgcatgtggtccagacgctgtaccccttcagctcagtcaccgaggaggagctcaacttcgagaagggggagaccatggaggtgattgagaagccggagaacgaccccgagtggtggaaatgcaaaaatgcccggggccaggtgggcctcgtccccaaaaactacgtggtggtcctcagtgacgggcctgccctgcaccctgcgcacgccccacagataagctacaccgggccctcgtccagcgggcgcttcgcgggcagagagtggtactacgggaacgtgacgcggcaccaggccgagtgcgccctcaacgagcggggcgtggagggcgacttcctcattagggacagcgagtcctcggtaagtgcgctgcgcccacagctccggctgcaggcagtaaatgcgccttgcgcggtgggtctgtgtgccgcgcccttttcacattgtgtgagtacactagaaagagcgggagacgcagatgaatgcaatttagtataatgtttgctactccgtgatttacttgcatctgttttggggatagtgggtgtccatttctggaggtgggagattaactaaaaagatgtttttagctcacagaggtggttctgcttctctcccaagattccccctcttgtatttcacaggctcaaacatcattttctctcctggttgcccattctgtgtacgtagaaggcccgagtgatttactttgtttctattcggtctgtgtcccagagaaagcattctttgcaagactggtggctggtttctgacacctccttttgttgtttgcttgctttctctttgtaaaccatataatcccaaggtcattgccacggcaggcagcgccactgagttcatctctcaaaagcttttaaagcacttacgagataaattgaaaagaaaacaggggttcttgggagagatgagttttgtttgtgtgcagtgagtcggagatatgaggccactcgactggggcagcagacccagttcagcggtgggcaggctgggggcggtgagtttcaggcatggggtcaagcctgcatcccagaaggcaggcttttcgtgtgtgaaggaaatactcgaccagttttgcaaacgtctttccgaatacaccttctacaatcgagagacttccaaaacaagcatttaggagatagagtttaatgtatttgaattgtattggttctaggaggcttcaatttcatttttaaatgcacgctataagactagtaagtatgtactacctgctgccactgctgtcctctgaaaagattactggcacaatgaataagtgctcattcaagggtcctgttgactgatcagagaggcattcaaagccctccagagagaggcgactgggatgtgctcctctttgaggacggagcatcgtggtggtggaaactggactcctttatggtgtcatcaattttgcggagccttacatgtgcttggacgggaatgccaggctgaaagctaacttcatctgaaatctgaactctgagatttatcaagtcaccagagtttatcattcctggcaagacatcacattgaattgttctcacatgacgagagctctgtgcaccacttcttttagatcgtgtttgaagccttaagcaaattaaggacagcagcgcttttaactcaatcgagcagaaacttagagaaagcgctggaaaaccaattacaatattaagtgcttggtccagagtccttaagggctaagtataatgcacaaaatatgatcttggcttaaaattttttgagtttgaggagacttctcagaaggaagtcctgcagtgtggagacattggtcccagtcattattctttctgcctaagatttggggaaaagaggaaagactttagagggtagatgaaaaaggtgttctccggggttgctggccttagggaggacctatggcttttctgtggaacatgcacaggtggtcattgctgtctgaattcagggaccaagtccctttggataaggagggatgcatgcattgtctgggtttcatctcagaactctgcaccccactgtctcagttgtcttatattgttagagaatgagctaactttttctaaagaactaaagcacgaattgtttgtatttccttttaacagttttttaatgggggcctttcagggttttttgcattctctcctaacttagaaagtcaaggaacaacatatatgattctaggaatatagggcggaaagagctttactgggacttgcatcggctctgcacacatagcagcaccgtctttgtctgaggttccacgtggcctgatgctgtgcagggcagcttgtcctgatggatcttgccgtgacacgggccattttcagctgttagtgtgcatgccttgttccatggggattctgcaagagccctgaggtgtgtgtgtggcttcttttctcctgacagcagaaccatgccaggtttgctgtatttcctgttcataaccaaggcgttctcagctgtcatctgtgactaccagggacctgtcctggtggacaagtggacaagtcctttgcttgtttttttcccaccatccactgcctccccccgtccccatgtgttttcctgctcattttggcatttctcaggttagagctggctttcgcagccaccactaggccaccaagagcccttaggttcatgatctgacataattccttcgcagcatgccaggatggaaaggtttctgaggggttcagcctccctgcaggactcagtcaggcatctttatttaatttcctttttttcttgcagtctttgggcctgggcctttaattgaggttatcacatgaggcctggcttctggataagcacagctgttttttttggaatggatcttcaataaaatatcctgagtgattgcagtgtaaatgagctagacccttgcttgacgatattgaggggtgcgtatttcagggaagacaaacattgccacatgctacactatccactatcagtaagtgctgggtatttcagaagtatctgttggatatgttagatgaatcagtgaaccaacaaacgaacgaacctcttggaccctctttcctgtcctgaacttcagtacctactgcttgtccttccatttcttcctcctccctcgctctcctctctcatctacaattgtcatttatccttagcagctaaaggtgatgcattgttgttgcttattctccatatttcgttatcataccttcacctgtgagccatacctgcttaaatccagaaaactcagaaatcctactcaccctgtgtgtgtccattataaatccttttatattacattttgtccacattgattctatggatgtggctagaaagctgtacttaaaatgaacagtaaccctttactgggtttctggtaaactgtacaagttgtcaatattttattttcttaattgctgcatctcccatccttgtaaagcttgttcagaaaatgacagatcacaactaggatatggttggaaaaggtgcagagctggcctgcaagtgcgggaggccattttcctctgtaagattttagttcccgaagatatcatgtatttattatgtcctgcaatagtattagatactaatattttttgtcatacagtacttttttttccagtagagaaaaactgtctcgctaaggataatttaatgcacatatttgtttcatttctcttttttaaaatatatgaaaagtatttggctgggaaataaaatagaatagctcctttctgtatttttaaagttataatatttcttaaagaaattataacttttacccaaaactctattttcaggcaatttcatcattccatttctctaaataatgattctctaactgtatgtagtgtgtatcagaattgccttgaagcttgttaaaacaaattgctgggtcctacctgaaatggtactgattcaggaggtctggggcccaagaatttgcatttctattaatagcacgtttcttggtggtgatgctgctgcttttgggaccacactttgaaaacccttgatccctatgatgcattcttagtggttttatatattcttgcagctgttattaaaaccatttctgcataatactacatttccatgaattataaaaatattgtcataaagctgaacttcatttagaactgaagcttttgttgagtgggatttatctcttgaagtatatttctgttgagttttttggggggcttttttgtgtttttgtttgtttgttttttactgtttagagtttgaaaataaacgtgctgtatttgctgtgtttctgctgatgaattaggaggaggtagattgtcagagcaatgtgaaagctgcttccagggtttcatggttaggctccgtgatccatggtgtttcttcataaatgagttaatgttaagatgacttaaccttaggttgctgtgagcagtgcctgtaggcatctttccagtttcaaagataacaagttatttttaattgccaggctttttgcccagtaccaaatggaagttttaagcctggatttttgtaatagttctaattttaagcatatttaactcttgaagatggaaaggcctgcaagatcatgcagtacaggctgttatctggaagtttagtgctcatcacctgattctgattctcaaatgggccagagcccttgaagactctgccttctcactctggctggctcttcaatgctgacctttaaaacagacaacatccagcatcaccagcaaacttgctagaatgcagattgccccagcttgctgacttcgaatctctggggtagggctctgcaaccttggtttgaagaagccctctgagtcctttttttgttccaaatcctgagaacctatgaactcctgaataattctgatgcgccaatttgagaaccactacgttgtggagtatgcacttgattcaagcccttttgcatactgttgtgtaatatggtaaaattctgacttaaatgtatcactcagtcacatcaggtatgacactatggaaagacaaagaataacaaggacaatattctacaggtctatatggtgaggtattacatgtgactttaggaaatacatttggggatagggagggctaaccacacacatgcatactaactggaaagtggacagggaacgctccgtttgcctagattaggtagatgggacttggacagctgctctgtagttgatgattgacttttcatttatgtaaataagattacttccaaagttaatgagatgaatatttgaacatgtcagtgtggattggcttcaggcctgtggagtaaatattttatagagtgaacattgataggagaataggaaaagctggtgagactcttcacacttggggcaaggaagagataatctgatgtaaaaacaaagaacatagggtcaactgacagctagcagcataagtataggcaggagtaatttttattaaaagaaggctaccttagacaactagggcaggtgaccaaatagaatggtaaaactgaaaggcagtttttctgagataaaaacagagaaactattaatcagtggatcacgatttgcctctaacccatttgttctcacttttgggaggtaaatgaaccacttctgtggacagaagagtgccttctgtaaagaagtaaaaggggaaaaacatgtctttaccaaaagaaaagaatgatacaacttgtgataagaaaccaacagggtgacctctctctgggggtagaaggagatgtgtagattattgatgcttggagacttcagcgtggctggagatcagtccagggtctgtgtggaaggcctggtgaatcacacaaagggcatttctaccctcatcatttcataaagtccaaagtgaaagataaggagaagttttaaggtttaaagaaccaaaagtacctggagcaaggcccctccctcccgtttcctcatgactattgtgcttagaagaaaatcgcattaatacataagctttcaggaatggaggaggaaataaaggatattaaagtctgtcctcggcattcatttttttccttctatgagaaaacaatgattaaatcttgagagagggagaggcgtatctgatcaggacatctgttttataaaactgcaaaggtgcttttcagcaagtatttgaggcaatggatcaagctggcaaagccatagagatgggatcaaagagtgtgctctctactgttcttttctaaaagtacccacttatcgcgagcacaaattgcaaagagatgaggtgtaagaattacctaaaggaatgaataatggaagaggtagtcaaaattagaaatttttaagtctgcacgtttgttgaacaccagatactctgagcccggtgtggggatgtggagctaaatagggttcttgcacttagttgtattcaaacacagaatctaaagcctaaacaaaaataatgatgatagaggccccgagagaggttggttttccgccaacctattaattgtccttagattccacttggaaaatgacttctgaaaagaagggtcaaatgaatgggttgtactaattgttcattctccagaaccattgattcaaaaactatgagaatggaaaaatcattccttataaggagtactcatagaaggacataacaggaagaagtggtctgatgtttgaaaatttgaagaatttgcccagtagtcagcacagagaaattactatataccaagtaagtacagtgtttggagatggaaagtgtaggaaatgcggacagtgggaggtagcacaaaggtggcaattaaagaggagaaatcaaaggggagatgtttcaaaacccggggactgagtctagttaggttttagtccaatcatagaaaattgtaatgagtgtcctgtccatctatgatggcttaaaaagatgtccataaattctttggtactctttgcttcagaaggtggagcctgaccctcttcccttcagcatgggctgcactgagcaactcacttctaatgaccaagatgtggcagaagcgatggagggcagcttccgagatgggcattgtggctgcctctttgctctctcttgggtcacttgatctagggtgagccagctgtcatgttgagagtacattcaggcagccctacagagccccctaggggttcatgtgagcagactgccttggaagtagagcctgcatccccagtctagccttcagatgactgcagcctcagccagcatcctgactgcatgtttcaaaaatgtgttaagattctttgacaagcttaaatgtagagtactctaccatactatcagtactctagtacttgttgaggagcaagtgtggcatggtcctttttcatccgatttcttgaaatctgttctagaaagccaaccgtggaaggactgcaacagatgagaataggactgatggagttgctttcatgggaatcattccctggctccctctggaggcagagttgttttgggtcgggagtaactccatctccatcagatgcagggactggtggctcactttgaaaggaggagaccatacagcagtgtcccagctgtcccttcaggggaaattccctatgagagatgtctggagcagagccagagtcctcaggacagaattggaaaagtatccacagactggagctccctccatcatgggctgctttgcccataaatggcattcccatctttttctggtgaccaaacatttgttggtggctccagcactgccgatgtttgttccagattttctttcttccagttctcaaactgcatcagagtcccctgaagggcttattaaaacacacggtgctggaggttaaaacacagatggctgggctccaccccagaatttctgctacagcagggttgaggcagagcctgagaatttgcatttcttttttttttttttttttttaattattttgagatagggtctcactctgtcatctaggctggagtgcagtggccctgtcatacctcactgttgccttgacctcccgggctcaagtgatcctcccaccctggcctcccaagtagctgggaccacaggtatgcatcaccacacctggctaattattttaaattttatgtagagatagggtcccactatgttgcccaggctgatctcaaagtcctggcctcaagtaatcctgccaccatggcatcccaaagggcagggattacaggtgtgagcttccatggctggcccttgagaatatgcttcctaaccagttctcagaggatgctcatgctgctggtcttgagagcacacttggagaacatcttaactagttcatcttcacacttcacttagaggtgttcagtggtcatatgtaacggtgtatgttagtatacagattgttctttttcagatttcctacagaaaatctacttagtttaaattaaagaacactccccaacttttagcactcctgcttggcataaattggttctacatccttaacttttaaaggtttctgctcaggagcccacgaaattaaaaattacctcttctgctgcgaaaattttattgctgcaactcatgcatgcatacaggcacacacacaccatgatgttaaattaaggagcttgaattaaaagcaaatttcccttatgtagaaagtcatctgttgatcatttggcttaattaaaattgggtgtatcttacatctaccatgattcactcccatactgcctccactaaaaatgatgccacattatctctaaattgagcctggcttatagtaaactctataagtgagactgcccttcatcttttcctaaagatacaacttctagtacagaatattaatcatctataggctgaggcctaatctgagattaaccttctggtttcttcctggagtttcatccaggagtatgccctgggcctcacatggggatgagatggggcttttcgcctcaaaggtttgttcttatttggtctatttgagacagaggcatgcataaatacaaactatacttacaattgttcctttcattcttttctgttaacagctatggctgctgggtgagcccagctgccttgcacaatttgagtcttctcagacactcattcccctgagttgtcattggtagaaatggagtgattccttgttttgcaagggttgcacacttctcatcaaacatttatttgggcttttgtgaactctgtaatagacaatggcctagtcctttgttaactgtctggaggtcctgctgggaggtcgcagagcagggctgagctgctggaccctcagagcaggaagtttctgggctttgagaaaagcagaaaactggtctgggaattccaggaagaatttcggatgttaggctgtggtcctgccactggccaggcatgtccgaggtaccagccctgcctcggagagcacatgctcagctccacattgtccagagggctctcctgcccccacacgcacttatacattcacacagatgaactcacacgctacgcatactctcacacactctcaatactcacatactccctctcacatctgcgcacgctcacacacttagagctgcggtatctcatgctcctctttcatgcaactcttttttttgtttgttttctttttttttttcatagaacttactgccctgtgcagccatctgtacacctctatttatctgttccccacaccagattgtcacagagcatatgtcctgcatgcacacacatgtatccagggcaccgcctgcctggcatgtgttagtaactaattgttattcatttaatgaattgatcaaaacttgatatttttgtacaaagaacatttatcgttcagtatcttctttcctgcatgcttttcagcaaatgagataaaagaccaatttttttttttttttttttttttgagatagagttttcgctcttgttgcccagaccagagtgcagtggcgtgatctcagcttacaacttccacctcccaggttcaagcgattctcctgcctcagcctcccaagtagctgggattacaggcacactaccaccatgcctggctaattttgtattttttagcagagatgaggtttcaccatgttggccaggctggtctcaaagtcctgaccacaggtgatccacctgccttggcctcccaaagtgctgagattacaggcgtgagctactgcacctggccaataaaagacacattttaattaaaataatgacatgtttctaaaatattctgaaatagaaggcacatcacagaatttaaatatttttcaataaaatctgtaatcaaaccatagttcagcttcctctgggatattgtgaactatgtttaaaatgcgaccggaattttccactgctgttcatatttttaaatgcttagaattagaaaaattagccaggcatggtggcacatcgggaggctgaggcaggagaatctgcttgaacctgggaggcgcaggttgcagtgagccaagatcacaccattgcactctagcctgggcaacaaaagcaaaactgcgtctcaaaaaaaaaaagaattagaaaaattttgatgtcttaatttctaatagggttagacatcagaagtagtaaaatttctagctactgcctgcatgcaaaccactcttaataaattcccagtttatcaaaaaatagtttgggaaatgaaaaacagcaaatttcttgagcagtcagggcaacactgtatattccatagtgaagtgctgtatattccataatgagtttgcacttttcaaataactaaaacgcatttagcactgaaactgggctaagcagaatttattttttctttggttcagaatttcagaatcgtggactacctccaggtctttctgaacatcagatgccgttctagatataaaacagagacccggctgggcgtggtggctcatgcctgtaatccgagcaatttggaaggctgaggctgggaggggggtggggatcacctgaggtcagaagttcaagaccagcctggccaacatggcgaaaccctgtctctactaaaaatacaaatattagccgggcatggtggcaggttcctgtaatcccagctactcgggaggccgagacaggagaatcgcttgaacccgtgaggcggaggttgcagtgagccgagattgggccactacactacagcctgggcaaaagagtgaaactccatctcaaaaaaaaaaaaaaaagcagagacccagtgtttgagcaatgggtggtttggatttagacgcacaagagatgtggatggatttagacacagctccccgctgtggcccggctgtaactgtgttctgtttcctccccagcccagcgacttctccgtgtcccttaaagcgtcagggaagaacaaacacttcaaggtgcagctcgtggacaatgtctactgcattgggcagcggcgcttccacaccatggacgagctggtggaacactacaaaaaggcgcccatcttcaccagcgagcacggggagaagctctacctcgtcagggccctgcagtgacggcgccccggccccacactcgcctcccgggccccacggtggagctgcccgcccggccttgtggcagaggctcctcccgcggggacggccccgacggcttctctgcgagtctctctttatgttcaggtcgcttggtcggttcgtctcccatttgccatccaggcctcacacccacactcgagcccacccggccggccagctttagaggaggggaggagcagggcgagttcacattattccttttccatcggaagtggcgctcgtgcattcaactcgttcccgctcatggaacccctctttaaaaagacgcagggcacctgtgagcgcaggagcgagcctaaggccacccagcggcagcgcccgtgtcctgggcactcagcgtgctgggcagagcaggtgcgatggccccagtcctagcagccctcgcccatgtcctgtgcccttacatggctcccggactgtgcagggagccgatacgtttgctgatagcaatactggaaccaccgggtgcgatggcagtgaggagactgcccagtgcctttggggctgtgcttgcaataaagaaagaatttcctggaaaggcagtctgcaaaagagggaaccggtgactcagaaagacagatgttttggtaatttaccccaaatgtgccatccacatagtgctttttcctcttgcccttcggcttgtttgaatctcacaattatgtatttaattctcaaagaaatatgtatctgtagccgtttgttgacactaatacagatgattaaggaaaacagctgatctttggggaagggagctaccaacactttatacacacacacacgtgcacacacacacacacacacactatatatatatatattatttacagggaaatttttcagggtttacaaaagagtatgtgattggtagtaagagacacacagaatgtttatgaagaaattgcattttctttttcctttacatttgaacttctttatagtttaaatataacgtcttgagatggcacattcctacgattgaagaaggggtcttgagatcccctaaacttgcatacccagttttttggatattgtaataaaaaaaagtattatgacaaggctctgtgtgtatttatctttgggaaaactcagactcaatcatgggagagtaattactgaagcattcactcattgcggagtggaaatcatttttagagaagagcttaacatttattacttgtgtgttttcattttctacccccacatttttgtatattgaaataatgagttttaattagtgaaaccccaagggaacccagaatctcaagcttggtctgaactttgctctttggaaaatatttgtttagaaatatgttgctgaactcttggcagccagcgctctcacaccatgtgtcccccacgactaactctcgatttgtcctcttgatcgggagcatttatattgatgtgccaggccctgggggtgcagagtcacatgacttggcatttgtgccctcctaggccaatcacgtatcaagcgctccctctgcaccatgcactgcgcccccatttgttcctcatcacagccccatgaggtgggacctgctatcatccccattttatagatggggaaagtgaggtctacaggcagtgcacccaacatgtggctgctgcatggtggagccaggatgcacagccaaggatctgcactagcgctggacccttccaaccccagcgtaggaaggtgttcgggagaagcgaggtgttgcacacttactctgccatgcgagttccctgtgaggaaattgtatctttttgctgctgccttagattacaataaattagaactctggtgtcttgtacctgaggttggtggcacccagtcattgtgaatagacattcaggtgagggagatcattacatgagacagaatacatccagggaaaaaccagtccctccagactctttcgggtctcactaatgagaatgacattttgacctgatgctggaatcccactaaatattgagtgcctggacagctgaatgactttgatgtacacatagcaattcaggtatagccgagcaactaaaggaccaaagacagatgtacattttggcttcaggaacttacttaaggctcatagttgtaggtgacagttattttcagtcttgtcacatgctggcttgtgggcgtcctctgtctgcctgcaggaggtcaagattagtatttttatattaaggaaccggcaccccaggatgtcagatggaccactggagggtgaattgatagtcccgtgatgagccactagtcagagtgggaggtccaggcagggtccccacgtcgcttggagtgtggccactgatgctctggccaggcgggccaatgccatcaatcttcctggacagatcttgttttgctgttctgttgcctctttgcacagacagcaagggacaataaaggttagtcattctgcactcaggtaactttgctcacttgtttgtatctaaatatgccttttaggtaaacatcgtgccatcctgctggcacgtaaccaccaagaccgtcacgtatggtttatggcccagtgccattaaatgatgtttcttgtgagctacaactggccaacttttttcccaaactgcatcacaaattaaaatcttctagtctttataatggctgaaaccaatgtttccaaatcattttcagtgctagttcaactgtgtcttgctttctatgtgctaaccagtttacaatctacttttctacaattcctactgctcaacaccagaataccaaagtaatttcttaagaccaaagttcagaactgaaaggatagaaaagtttgaaagtattatttaaatcttacatttcaataaacatgagtctggttttggccttttcttactagaatgcagcactgtttattgttggcatctgtgtcattgatgtggttatttcgtttctaacgtcttgccacatgctggctgctctcctgaggagcggcattgcaggctttggttacctgtttaagccaggcacgatggcagtgcctagctgtccttaccggccctgggacttcaagcaaattactcagcatctctgaatgtgtttgctcccgagtcaaatggggctgccctgttgagggtgcttgtgcaagtgctacctaacagtgacagatgcctttgggggtggcctgcgtgtgtcaagggatctactcaacatttttctcacttggaactaactcattggtgccctgttagccaggggcttcctcagggcccccctgaagagccgactgcctcagaccgtcagtgtgatccttccctagcagtcttagggccaatgcacccctgcttcttaaagcttaagactcctcgagtgttgaagggaggttgcttcaacaaactgttgagctgtctttcttaaattagaagcccaaaccaaaagccacactcagccatactcagcactggccttcttacctgcagtggttggtgaattcacatccctaaaaatgatcctcttcagggtaggaagtatctttgttttctccttaggggttgggagcagggtgggatggtgggaaaaagaagtccattaaaccaaccagtattccacaaatgttgggatgttccccgcaggcttcaagtagatgagagtagaacccaaagtcaggtctaaaccccctcatgagaacctcccgctggaacattctcagcccaagtgacacagtggctattgagcattgggcaaaagttcagtaagccaactagtgtccagaaaacctgtgttcccccctacccccagcagatggcattcccactgctgaggaagccggccgttcctgagtgtagcccacttggacctccagccattaggaaatgtgctccttcttgtgctgttcctcagactctgatttgcagggcaacagggcagtcatctttttttttttttttataacttgtaagttcagggggacatgtacaggtttgttaggtaggtaaacttgtgtcatagggatttgttgtacggactattttgttccccaggtactaagcctactaccaattattttttctaatccccttcctcttcccagcctccaccttccagtaggccccagtgtgtgtggttcccctctgtgtccatgtattctcatcatttagctcccacttacaagtgagaacatgctgtctatggttttctgttcctgcattagtttgctaaggataatggcctccagctccatccatgtccctgcaaaggacatgatcttgttctttcttatggctgcatagtattccgtggtgtgtatgtaccacattttctttttccagtctacaattagtgggcacttaggttgataccatgtctttgctattgtgaataatgctgcaatgaacatatgtgtgcatgtatctttatgatacagcaatttatattcctttggatatttacctgctaataagattgctgggttaaatggtagttctgtttttaggtctttgaggaatcaccacactgctttttgcaatgattgaactaatttacattcccactaacagtgtaaaagtgttcctttttctctgtgacctcaccagcatctgttcttttttgactttttaatagtagccattctgactggtgtgggatggtatctcattgtggttttggtttgcatttctctaatgaccagtgatgctgagctttttttcatgtttgttggccacatgtatgtcttattttgaaaagtgtctgttcatgtcttttgcccactttttattgaggtgggtttttttcttgtaaatttgtttaagttccttatagatactgaatattagacctttgtcagatgcagaatttgcgaaaatgttctgccattctgtaggttgtctgtttactctgtggatagtttcttttgctgtgcagaagctctttagtttatttagatctcatttgtcaacttttgctttagttgcaattgcttttggtatctttgtcatgaaatccttgcctgttcctatgtccagagtggtattgcctaggttgtcttccagagtttttataattttgggtttcacatgttaagtctttaatccatcttgagttgatttttgtatatggtgtaaggaagggatccagtttcaatcttcttcaccagccagccggttatcccagcagcatttattgaataaggagtcctttccccattgcttgtcatttgtcaacttggtcaaaaatcagatggttgcatgtgtagtggccttattctttggctctctattctgttcctccattggtctatatgtctggttttttttttttaccagtaccatgctgttttggttactgtagccctgtagtatagtttgaagtcaggtagcatgatgcctccagctttcttctttttgcttaggattgccttggctatttcagctcttttttggttccatataaattttaaaatgtttttttatagttccgtaaataatgtcaatggcagtttaataggaacaacactgaatctataaattgctttgggcagtatggccattttaacaatattgattcttcctatccaggagcatgaattttttttccatttgttggtgtcatttctttaagcagtgttttgcaggtcttcttgtagagctctttcacctccctggttagctgtattcctaggtattttattctttttgtggcaattgtgaatgggattctgttgctcatttggctcttggcttgactgttgttggtgtgtaagaatgctagtgatttttgtatgttgactttatagaagttgtttataagctgaaggatctttgcagaagttgtttatcagctgaaggagcttttgggctgagactatgggtttttctagatatggggtcatgtcatctgcaaacagggatagtttgacttctctcttcctatttggatgccctttatttctttctcttgcctgactgctctggccagaactttcaatactatgttaaataggagagagggcatccttgtcttgtgctagtttccaagggcaatgcttccagcttttgcccattcaatatgatataggctgtcggtttgtcatagatcacttattttgaggtatgttccctcaatacctcatttattgggagtttttaacatgaagttgtgttaaattttattgaaagccttttctgcatctattgagataattgtctttggtctttagttcagtttatgtgatgaatcacatttattcatttgcgtatgttgaaccaaccttgcatcccagggataaagcctacttgatcatggtggataagttttttgatgtgctgttggatttggtttgcctgtattttgttgaggatttttgtgtcaatatttatcaaggatactggcctaaagtttgctttttttgttgtgtctctgccaggttttggtatcagggtgatgctggccttatagatgagttaggagtccctcctactcaattttttagaatggtttcagtaggaatgggtaccagctcttctgtgtatgtctggtagaattcagctgtgaatccatctggtcctgggctttttttgttagataggctatttattactgattcaatttcagagctcattattggtctgttcagggatccagtttcttcctgtttcagttttggagggtgtatgtgtctaggaatttttccatttcttccagattttctagtttatgtgcatagaggtattaataatattctctgatgatgatttgtatttctgtggggtcagtggtagtatcccctttgtcatttctaattgtgtttatttggatcttctctcttctttattagtctagttagcagtctatctgctttattaattttttttcagaaaaccaactcctggatttgttcatcttttgaatttttttgtgtgtctttatctccttcagttcagctctgatcttggttatttcttgtcttctgctagctttggggttggtttgctcttggttctctagttcttttagttgtgatattaggttgttaaattaagatctttctaacttgatgtgggcatttagtgctataaatttccctcacaacactgtcttagctgtgtcccagagattctggcatgttgtatctttgttcttattagtttcagagaactttgtgatttctgccttaatttcattatctacccaaaagtcattcaggagcaggttattcaatttctttgtaattatatggttttcagcaatttccttagtcttgatctctaatattattgtgctgtggtctaagaaagcggttgttttgattacagttcttttgcatttgctgaggagtattttgtgtccaattatggggctgattttaaaatatgtctcatgtgcagataagaatgtatattctgttgttttgaggtagagagttctgtagatgtctatctggtccatttggtccaatgttgagtttgggtcctgaatatcgttgctagttttcttccttgatctgcctaatactatcagtagggtgttgaagtctcccactattattgcatgggaatctaagtctctttgaaggtctctaagaacttgctttatgaatctgggtgtcctgtgttgggtacctatatatttaggatagttacgtcttcttgttgaatggaaccctttacaattatgtaatgcccttgtctttttaaatttttgttaaagtctgttttgtctgaaattaggattgcaacccctgctttttttgttttccatttgcttggtagatttttctccatctctttattttaagcctatgggtgtcactacatgtgagatgggtctcttgaatacagcataccaatgggtcttggattttgttttgttttgttttgttttttgtttttttgtttttaatccagcttgccactctgtgccttttatttggggcatttagcccatttacattcaaggttggtattgatatgtgtggatttgaccctgccatcatgatgttagctggttattaagacttgtttgtgtggttgctttatagagtcactgttctgtgtacgtcagtatatttttgtgttgactggtaacagtctttctttttcatatttagtgctcctttcaagatctcttgtaaggcgggcccagtggtaacaaactccctcagcatttgcttatctgaaaaggatcttatttccccttctcttatgaagcttaatttggctggatatgaaattcttggttgaagattatgtgtcttgaggaacgttgaatataggcccccaatctcttctagcttgtagagtttctactgagaggtctgctgttagcctgatgggattccctttgtaggtgacttgccctctccctctagctgactttagcattctttcttgcatttcaaccttggaaaatctgatgattacgtgttgtgggattgatcttattttgaagtatcttactggggttctctgcatttcctgaatttgaatgttggcctctctagctagttgaagaagattcactcctgtggcagtgttggatgcatgcagacatgcttactgacagggcagggaaggcaaaacctgctggcacacacactctggcaaagcaatgttgggggtggctatgggccttggggaagctgctgttgggggaggaagcaagcaggttgctgcatggccgtgggggacacctcactggaattctccattagtcagccatggtgcaccagtgcaggatgtgggcccccaaggtagctgaggctttcctgcaagtggactcagccaggctggggcctcaggagaggccagcagaccaagggcactgaggtccagactggccctgtctgatgggcaagacagctctgcagagttcaggtctgacagttcccagagggctaaagtctcctatgagaacaagtcgagcctaggaggctgggcatccctgaccatgctccactgcagatgctcccacaccaaaccctctgggctctgcatcagttggcatgccccactaccacttctctaagcagctctccctgcaaactcgagtgtccacagtggtcgaagggtctcctgccaggattccaggtgcccgtggtgagagcaggttgctccttgtcagttcaattcacccattaccccagagtcactgggggccaggagtgagtcctggtgtgcagtagcccttccattcagggttcccaacttcctccccattcagctcagcttctgtatcttccctccatgtactctcacagccttccctctgaagatctgttaggactgtgccagtggtcttggtccctcagtggcagctgttccacctggctgcatctagttggccttcttgccccaaaaaatctctatctgcatttttaacatgctgctggaagattccaatgaggtggtttggacctgcactttgggttctagtctagtctacttgaaacctctagggaaacacgttgctctcaatgcatgccatctacagcatgtccttctccttgggccatatagaataggggtccctaacccctggaccatggaccactactggtccatggcctgttaggacccaggcttcacagcaggaagtgagcagcaggcaagcgagtgagcattactccctgagctccgcctcctgtcagatccgtggcagcattagattctcataggagtgcaaaccctattgtgaactgtgcatgcaagggacctaggttgtgcactcgttatgagaatgtaactaatgcctgatgatctgagatggaacagtttcatcccaaaaccgtcacacacacacacacacacacacacacacacacacaggtttgtggaaaagttgtcttccacaaagccaatccaggttggggactactgatatagaaagaaatgtctgatctttaaggcccagagtgattatttttctcttttgttaactgtcttacttgccttaacctccatcaggtttcccacagcacagctactagccatacaaactcactggaaagactcgtgctgttctatctttggcagatcctgctacctgacactaaatgactattgaagatagacaagcctgacagctggtgtgaaagctcgcctttgacagctttcaaaa

SEQ ID NO: 143 - DNA, 1534 bp, Homo sapiens
gcctgggcgggcgcagcgcggccaccgccccgggacccgcgccgctgccctccggctccgcgggcggcccacggcgagatttcatgtgttctttgtatacaagcgacgtcccagattataattctctgctgagatttgagttggatttgaggatttggagaatccctgcagctttgtaacttcagaggtgtaattagctgaaaacatcatcgttttgaagagttctgcgttttgccagtcacctctcaactgtgtgccaaaggctggcagaaggactccatgaaagatgacagaagaagttattgtgatagccaagtgggactacaccgcccagcaggaccaggagctggacatcaagaagaacgagcggctgtggttgctggacgactccaagacgtggtggcgggtgaggaacgcggccaacaggacgggctatgtaccgtccaactacgtggagcggaagaacagcctgaagaagggctccctcgtgaagaacctgaaggacacactaggcctcggcaagacgcgcaggaagaccagcgcgcgggatgcgtcccccacgcccagcacggacgccgagtaccccgccaatggcagcggcgccgaccgcatctacgacctcaacatcccggccttcgtcaagttcgcctatgtggccgagcgggaggatgagttgtccctggtgaaggggtcgcgcgtcaccgtcatggagaagtgcagcgacggttggtggcggggcagctacaacgggcagatcggctggttcccctccaactacgtcttggaggaggtggacgaggcggctgcggagtccccaagcttcctgagcctgcgcaagggcgcctcgctgagcaatggccagggctcccgcgtgctgcatgtggtccagacgctgtaccccttcagctcagtcaccgaggaggagctcaacttcgagaagggggagaccatggaggtgattgagaagccggagaacgaccccgagtggtggaaatgcaaaaatgcccggggccaggtgggcctcgtccccaaaaactacgtggtggtcctcagtgacgggcctgccctgcaccctgcgcacgccccacagataagctacaccgggccctcgtccagcgggcgcttcgcgggcagagagtggtactacgggaacgtgacgcggcaccaggccgagtgcgccctcaacgagcggggcgtggagggcgacttcctcattagggacagcgagtcctcgcccagcgacttctccgtgtcccttaaagcgtcagggaagaacaaacacttcaaggtgcagctcgtggacaatgtctactgcattgggcagcggcgcttccacaccatggacgagctggtggaacactacaaaaaggcgcccatcttcaccagcgagcacggggagaagctctacctcgtcagggccctgcagtgacggcgccccggccccacactcgcctcccgggccccacggtggagctgcccgcccggccttgtggcagaggctcctcccgcggggacggccccgacggcttctctg

SEQ ID NO: 144 - protein, 380 aa, Homo sapiens
MTEEVIVIAKWDYTAQQDQELDIKKNERLWLLDDSKTWWRVRNAANRTGYVPSNYVERKNSLKKGSLVKNLKDTLGLGKTRRKTSARDASPTPSTDAEYPANGSGADRIYDLNIPAFVKFAYVAEREDELSLVKGSRVTVMEKCSDGWWRGSYNGQIGWFPSNYVLEEVDEAAAESPSFLSLRKGASLSNGQGSRVLHVVQTLYPFSSVTEEELNFEKGETMEVIEKPENDPEWWKCKNARGQVGLVPKNYVVVLSDGPALHPAHAPQISYTGPSSSGRFAGREWYYGNVTRHQAECALNERGVEGDFLIRDSESSPSDFSVSLKASGKNKHFKVQLVDNVYCIGQRRFHTMDELVEHYKKAPIFTSEHGEKLYLVRALQ

SEQ ID NO: 145 - DNA, 81684 bp, Mus musculus
  misc_feature (1)...(81684): n = A,T,C or G
nnnnnnnnnnnnnnnnnnnnnnnnnnnnnnnnnnnattgccaagtaggctagccgcaagccccagggaatctacccatctctaccacccagcactgagattataaacatgtaccacacgtccaggattattttacctgtgtcctcatagcactttacagattgagccatctccacagtcctctgtcacttctgataaatctgcctggggttatggtagaagggctcagtcagtaaagcccttctacataaatttggatccctggctcctagtaaaggcttggcatagcaatacaagcttgtaatcctaccaaggggcagtgagagtggatactaagcaatccttggagctccctggccagctggcctgacccatgtgaagagctccagactcagtgacactcaatgagagattccatctcaaaaactagagtgaaggactagtaagaagactcagtgtgtaaaggcacttgccaccgaaccagataacctaagttcaaccacttagtccaatggcagaagaagagaaccaagtcattgaccttcacatgtaaccacacacataaaacacacacattaactaattcaattaaatacaaggtggagagtgaggtaaacattcagtgttgacctctggcctctgcacacatgtgcacatagccacacaaacacataaatgcactgtgcatacacttacacattccttaaaggttagatgggcacagtgatacagaggggtagggtacaactctcatcccaacactcaggagccagagacaggaagatcactatgaatttgagatcagcctggtctacacagtgagttgcaggcagccaaggctacagagtgaaaccctgtcacagaaaaagattacagttggggaactccagcctgaacaacattagtgcaaccctagtctcctccctaaggcctcatgtttacattcagatggtcagatttccactcttttaataccccaccatggagatttaactcctacctgagttcagataggacagaccatagacacatctggcaccagcgtctaagatgggccatgttcccatcaaaggagaatcatgaggctggagagagagcaccatcagaaaagtatctgctttacaagaatgaggctgtgagttagatctcaagagcccatgtctaaaaagccaggtgtggtggggcacgcttgcaatcccagctctggggaggcagaggaatggaggatccctggaactcactggctgatcaccctagattattttacaagcctaggtcagtgaggagtcgtcaccaaaacaaaactaataggttgtgctttgaggaacaattcccacagttgtcttctggtctctacatgaaagcacacacaggtgtatacatacacacaccacaccagagacagaggcggagagagacgaatcctagccataaatgttaccagtgggcttaggcgaaagggagcctgtcctgaagccccaaccaggcagagatgagccctacctaaggtagaacttacagtgagaggaaaacaggttggggtctcaaccatggagagtgtgtttcagacttgtgagagcagctgatacctggggaatgcatgctttgggactatgacctgtgatccctgaacatgaccaatggatttgagtcccacagcctcaagtgtaactaggagttctgggagagggttacagtctgtgactgagtagaggaagcccctggtgtagctggagtctggaactgggggaggaggtgtgacactggctgtgtgtacctgggatacacaagggcagtctgtagcccaggcttcaaatcctgttcccccaacaggaatgtagcagccctgagaaaaggctaagatccaagtcagtgcctgtgtcctgtgagatcagctgtatggaactggcttcagactcagatgtgtgcacatcacctgtacaaggtagcccagcctgggaaagtctttctggcataccaagtggctgaggcaggggaaatctccatgggtggagccccagcagggccacagggaagacaggagctgatggcagaagacagggtcacttaggcaggaggttggcaatacttaggtccagaaagaggtaccacctccaatgtctgccatctactcctctctggaatgcctctagctcttctactccttcccccttctttcttccctgtacctcattttcttcctcccctctccctcctccctttcttccctccctcccccttgcctttctccttcactcctttaaaattgtttataattgtaattaatgtgtgtagcggtaattttagctacactgctttgtactccctatgggttgcacataaacacccgcccaagacctatctgaattcaaaaatgaaagaaagacacgcgcacacacacacacacacacacactccttctggtactcttagtttaacaccctctaattctatattctatctttgttgccctggctcctgctgggcagcccttctgggggccacattccttctcacctatttcggatgattttccttctgcaactcttaatctggtcgtctccctcgttcctctctcccagtccctagccagtgcaaatctaaaggtcccgcctcagtcaacctgcctagctattggccggctctttaatgatggatcaaaaaccagttgaagacacagaccttcggtgtttggacacccagattcccgattttgtgggccagattaattcaaatcattagaaccaaaccccaacatatgtgtgtgatggcgtgttgggaggggcatgcacatatcataacacacattggaggtcagaggacaggagctggttctcctttcactgtgtggatccagggaattgaacttgcagcagcatccttgggagcaagcacctctacttactgagccatcttcaacctccctcccactccccttttcctctttctccttccctcccctgttctggctctctctttatttccctcttggtctctgaatctctaccaaaggccacacttctgtattctcactcaagcagtcatcatacaaatccaacctgctattttgaacgggtctgagcctccttggcttccctcagtaagaaggcacagtgaacagctcctgagtgttcctgggacagcctccatgtttgcccaggcacactatgatgatgatgcagtccctggtccaaagcttcccgactctctgccctgagagattgctagtgttatactcgtaggctggaggtaggcaggtgtagagctggatccttcctcattcctgtgtcccctaggccttgaacccccggtgctggagtgtttggaaaaggaccatgtggagccagaacatgtgtgagtgtctgtcccagaacagacaggagtgccccagggatcctgctagggggaggtgggaagaagctgggaccacccaccactggggccaggggatgcaacagtgctgtttgtaagcaaccatagctggggctggggctcatctgatagataccctatgactacataagccaggcatgtggtaatatctacctgtcatcccaccacttggtgggtagaggtaggaagattgggaagagtgagttcaaggtcatcctcagctaactgtgagtaggaggttggcctgaaatacatgagaacttgttccaaaaaaagggggggggtgttttttatgtagcttaatcttacttagactcacataatggggcctctctctcaaacaacctttgcctaaaggaaagacaccccagaatcttcagggcacccagttaagagtgtacatgggaccttgggcctggccaagtaatcgtggttcgtgtgtgtgtatatcccatctcttcctaggttgatagtacaacaggtgcttcaggagctgaggcagtatcatgggtaagtgagaagggagcaggcatgaaggagaggacaaacgtgggacaggtaagggagatatgtggtgtgtacacaagggacaggtgtcggcatctgtaggggagcacacagttacaggatctggtaggaggaagaagggggcttatggctgtgatgatacatgcacatcacctcagcgttaggagactgacaaagcaagaagactgtgagtttaagactaacttgggctgtgtagtgaaactctgccaaagaggggaggggaggtaggaagaagagaaggaggcaggagttaagaatacaatgaaggtggtagagggaggggaagaagaagaaaaaggaaaaaatgaggaaggaaatggtgctgagggggaggatggagagatgaagcaaggaaaccctatggagaatgagacaaagagaaggtctctgattcctgagatctgttagagaactttcccacgtgctcaagtggtttgtccaaggctcagtactgctgccctctgctggaaagctgctgtagtgcccctggatgtaagtccacagtcagtggtgggccctcagacaggagcccctgtgatgcacctctaaagctctggggatgcagaagtgaaggatacgagttgagttgcctgcatacctacatgtccgtcccactctgcccctacagggcccgtcagcgagctcgcatgtccaccagccctggaggagcccactccaacctcacctggtttgagttcctgtctgagtaagcacacattgccagaggtggctatagtagagcctttatgccaagtctcctaagagctgacttcacctagagagcaaaggctgagacatgataatcacaggttcaagggctgcctgggctgcagagtaaggggatggaaagtgaaaggagaggaaaaagaaaaccctagggaagaagagacagggagctgggaaccaaagatgggatcacattagggggcaacatattcctggggcaccttccagagttgcctcagaaggtacctgaagctttcctcactgtccaggagcgaggatggtgcgtgcaagattgagaagcccggcaagagcaccagagtgaagcgcagcctgagctccctccgcagcagggtcacgaggcagaaggagaaggtgagggggctgaactggaacttggggactcgcacttcctttccatgctccgtaatgtacccttgacttgggaaccctgggatccaagccaggactagataaacagaggtggagggcgtaaaaagactagcctctgcaggagatatcctaagacccatcattttctcgtgcaggggaagagtccagcacatctaaaagataagactcaggatcttccagggaagcgggagtgtgtcaatgggcaccagctgatgcgaggaaccttctcgggccactccagctgtcctctgtgtggcgaacctttgctgaactcaggtgagtcccagccccatccatccatccaatggagtgtcagccttttttcttcataatgtccctccattctctggtacctcctggctccatttcaccctctccaatgtgagcaagtgtaaatagcaacctggaaagggccagagggacccgttgggcactgaagatggtgattaagctctctgtctcagctttggcctttgtaaaaatccagtaggatctggactcaggcagagtatttatcagatgtggtgacaaaatagcatgtgtttcctggttaaaatctcagaaatgtgttttgttgtagcactgggacctggctggccaaggtcatgttatctacaggtgtcgggtttctccacacccttcttgcacattctggtagctctccaacctcgtgacagcatcatcctacaatgttcttgtgtgcacactggagttccaaactctcttgtctctttttccttccactgtatgtgtgcttattcacgtgtgcacttaaaggtgctcgtgtatgaacaccaaagaacaagcttggcagtctttcctcgtatgcctttccatcatggtttaatgtgtgatttgtgtccaggtgaatccatgtacatacatgcacacatgtcctcgtgcatgtggaggctagggattaattctgggtacctgcctctatcactctccacatgatattttgagacaaggtcttcggagaatctggggtttgctgactcagcaaatcctcctacctcggacttgtgcactgtgtgccctcatgctcaatttattgtttattatttttatgtgggttctgggggattgaacttggatcctcatgctttcagggaaagtactttttctgatgtgtcaccatgccagtctccaatctccttccctttaaggacccatcgtcactttggagtaagggctcaatctagaccattatgaagctcattgtgagttaagatgaagtaaatgtgcaaggaaaaatttccaaacaagatcttaatctttatttcagttgcatcttatttatttttatttcctgtgtagatgtgtgtgtgtgtgtgtgtgtgtgtgtgtgtgtgtgtgtgtgtgtgtacatggaggtcagttctcttctctcactatgtgggttccgggatagaattcaggttattagtactttactggcccatgggcttattctgcaataagagaagggatggggctataatatattagttgagaggagacagttcaactcatagcacagagtttcctccctcctggagctgtccaaaactgctaggcaaggctgggctggcataagtctgtgcttggcaaatagacctaggttactggaatccctggagagagagagaactctgattgtccctgggatttagaacttacccttttgaaatcaagcccaattttgaggagaattaaagagaaggtggtatgtatggtagttgctccttaaaagacatgtatgttgtatcttttaagatgtagttcagctggcagagcatttgtctagcatgcagaaagctctgggctccgccttcagcacaggtggtgcatgcctgtgttcccagaattcaggatgtggaggcaggaggatcagaagcttaataccatagtaggttagtgttgggagccgcgcccacattcgccgttacaagatggcgctgacagctgtgttctaagtggtaaacaaataatctgcgcatgtgccgagggtggttctccactccatgtgctctgccttccccgtgacgtcaactcggccgatgggctgcagccaatcagggagtgacacgtcctaggcgaaggataattctccttaatagggacggggtttcgttttctcgctctcttgcttcttacactcttgctcctgaagatgtaagcaataaagttttgccgcagaagattactggtctgtggtgttcttcctggccgggcgtgagaacgcgtctaataacaggttagatagtaaattcaagcttggatacatgagatcctatcgtgtgtgtgtgtgtgtgtgtctgtgtgtgtgtgtgtgtgtctgtgtgtctgtgtgtgtgtctgtgtgtgtgtgtctttgtgtatctctgtgtgtgtctctgtgtctgtgtgaatgtgcacatgtgtccatgcatgtaaacattagtagcaaaaggtcaaactacagagtatttacaagcaagactcaggcaagttcaaggttcaactgcaggacatcagcactgttggcctttgaggctaatcatccccctagaatgaccttgacccactaggcactaatagcacctgcctagtctaaagtcgtgacaaaatgtctccaaacattgtcaaatgtcttttgttggtgcaggatggcccaaggtgagacctggttatctaagactaccagcaggccctagggtgtgtaagaacaacagacctagtgcctcccagacacctgaaagaccggcttttcttcatcaccctgtccccaccccttttttgtcatagtgtcattttactcattcagggactataggacagtctgcctgtggctactgctgtttattgtaatggtgactggacacaagagacatgacacattaggccagtattccacagctgagctacaccccagtccctcattgggggattctaggcgggtgctctactactgagacacacctccagcctgatttttacttttgagatagaatgtcttcttttgagacagggtttctctgtgtagccctggctgtcctaaaacttgctcatcaaccaggccggtctcaaactcagaaatctgcctgcctctgcctcccaagtgctgggattaaaggcctgtgccaccactgcctggcggttgtcttcacttttgagtaggtgtggtgtcatgatttctttctcctttttcttctctcctctcctcttctcctcctcttttccctctaccccttgacctcccatctttctttctctttctcttcctttctttcttttttctttttttcattctttctttcataaaacagtctcatatagcccaggctgcccccaaatttcaaacttgccatgtagtcaaaaatgagtgggacttccagtccttctggaattatagtcatgtatcattacagccagtttatgcggtgctggggctggaggccagagcttcacgaatgctagacgagcactccccaaactgagctgtatctttagcctttcttattgtatgtattgcctgcttgtagcattcaggtaaccatggtagggctgagtggattgtagcattgtctgctaagctggagttcttttctggagggctccttagaggtacacactggcagcaagcacctttactcactgagccatcttgctgccccaaggattttagttttgtttgtttgttgtttgtttttggagacagagtctcaggtaacccaggctgccctcaaattgaccacgtagccagggatgctttaagcttctgcttctccagctcccacctacctagaagtgggattgttgatctccatcaccacgaatggtttttcatatgggttgagggtggaaacccaaggcttctcaaacaacagacaaacactcttaaacatctcagccctccaaaaagtttatgtatttctctttcttagttttttgttattctttgaggaagggattgctttgttttatattgctttttaaaaagtaaagccttgatatatcacaaaggctgtttccaaactcctgggcttatgtgattcttctgctttggccatttaaatacctaggactacatgtgtgtgcccctttgccaagctagaagttatcttgggcaagagaaagctaagtggtcaaaagcacttgctgctcttgtagagaatccatgataggttcccagcacccacatagtgagtggttcataatcatccttaactccagtttcaaggaatcgaattccttctctgggcctcctcaagcatatgtgtgtgtgtaggtcaaagaacaactttgtggtaatcattctctccttacaagatgtgggttcctgttatcagctgaggctggtggcaagcactttagcccactgagaggtttcactgctatctcacctccaatagggtctttgatatgtttctcagtgttcagcagcttgtttgcagatatcggatgcttcctaagtgggagtgtctggtatgcgaatgtgtgttagaatagagacagtttattagagaacaaaaagatacccctaaatcaagggacaagactgaggctcaaaagctagcagtaggtggtctgagaaatccgttgtgcttctcataccctgtctaccagctttgaggatttttgttgtgacagttttgctttctgttcttttcccgtttttcctatgtgtttgtgcatgtggtgtgtgtatacgcgccagtatgtgtgcgggcacacgtgtgtatgagtgtgtatacctatgtgcatatgcatgtggagggctgaagttgatataaggacaggctccgccaagtgcaaagttctaaagtcccaggtgcttggaggaactacctattgccgaggctctgcccccttccgggccccgcccctctggggacggcctactcatgcgcagcttggtctcgcactgcataccgcttccggctcctaggaggccgggcggagactgcgagagcgacccgggagccagcagggcggagagcggcctgtgagggaccccgcggaggtgagggagccacggcgattttcgtggcgcaggggccggggtcgcggactctttggaaactacctggtatacaacaccccctcccccatggtgccgcagggctgagcacgcctccgatacaggtgacctcttccatacaagtggggctccaagtggagaatgtgggggtgcagtgatgcagaccatacccagtcaccctgtccctgcgccgtggacgctgtagccacttttcttggaaaggagagagaaaagccacacaactgcatgcagatttttgtccctggcttggggacaccagggccaggggcaagggtggagtgtccctcacagcaatctcttgcaccactttaggccctctggaaatcttgacatcgttgcctgcgagcgtttgggtgcaacaccgtgcaaactgggtgttttcgtttttttgctttctggatttcttctaggcgaagaattaaacccgtgcggtacaactttgattgctcccaggcaaactgagcgttttgttgttgtcctctctttatcttcttttaaagaattaccgcctgtagctcggtgaaagaaacgactggccaagcgagggaaagtttcttgaagtttttcaccctccgtctttgctcggggcattgggacctggagctgacgttcaaggcccctttccatttcttgctgggagcgtgacgagtatgggcgatttgaagattgaagggcttgggtttgggttttttgtttgggggttttgttgttttgttttgttttgcaggtgtatggatggaatggttagcctttgaactgtgaggagagaaatcttgagtgtcacatcagacctgagcttctggtcccagttctatcatatgagccatgtaacatcaccaagcctcagtctcttccttgtcaaaatgagaataagaacttgatgtgggttcagtgaggtaacacgtgaaagggatgtagtggaatgtctggcatatggtcggtgctcagtgttacataacctgtggatatggacctgcttccagacccagaggattgctgtgtgtgagtgttgtgtgtgtgtgagtgggtgcctgaagccagaggacagctttgtagagtagattgtttttctccctgaacatgagttctgggattcgaacttagctcgccaggcttgtactgcatgtgtttttgtccactgagccatctctgaccccgaagcctagactgtaggtggtgtgagtctaggacagacagttggatgtcttccttgttgggtcaggatttagacttgtcctgtttgtcactcctgttggtccccaagctcatctggaggggagggacagtggcttctttaaaaaataataataatctttgtaatatattgtgttttatatcagttgttttatttttattatgttgagccttgaacctagttccttgcacatactaggaaaactctccaccaagccactcccctatcccttatttcaattatttattattattttctggaggtcagatggcaacattgtgattctgtctttccacctttggcaaacgggcacagctcgagtcttaaccccgtcccaggctggccttgaatccccctcccccctccacttctcaagggctgggcccctttttcaatgtcacgggttagggagatccagaggttctgtgatttctcttgtaagttccttggtgaatgcccagactttctctgttggagtggcccacggcaactttgttgcatagctgggtgtaatttgcattcttgtcacacaggagcaatttggccacttgcactgcttaccaccccaggcaccctggctgtggtaagcagctgagtctccctgtgtttatctactgcgagattaacatagttctgatttaacatagttctgatcttgtagaggtctccttcatttctcccgtcctgggtcatgtttccatttctttcaactccctatgtgacttttcagcaattttcacctccagctgctttaaattctttaaagccccaaatcctgtcgaagacccacccctcttgtttctttctgtcttgttaaagcaaacactttccctgctgaacgggaaggggagatggctaccttgtgaaaaactccctcgccaggtgcaagacagttcagggggtagctctggagggactggaggaatttatttttaaaggaggaatgcagctagctagctgagggaggaaaactttaaaacaacgtcctccctgagagcacggtgctggtcagttcctgctgccatctgtctctcctgggatctgtttctttctcattcaaatcaagttgggagtaaactgaattcagctgttttctctgcttttgtgagcaaaaagagccatcccttcaattaagtttaaaaggtagttaggctctgttagaatgtggctcctttggtggctttcctgagtgcacaaagccccagctctctgtaagccagggtgtggtggtagcacaagtggtggaggcttagacgaacaggagttccaagtgcttccttccttggtgctagcgagtttgaggcaatcctgggctacatgagaccagtctgaaaaacaaacaaacaaacaaacaaaaccccaatgtactgatagcaaatacactgacttgcatcatatcttgaaaaaaataagtgttctagttacacatttaagaaatactgtaatggttgcattttcaatatgtcagcttggttaggctcaaacattcacttctgttactcttttaatgtgacagtttcattgggatacaagtcatatgccataaaattaccttaaaactatactgctcagtgacttttgtatcagtgggcagatgtagagcaaaaccattgagccttgttgggtatctgcagtaagggtgtgtgttgcttacaggggtgggtatggtagttactggatcactgtgatcttcattatgcaatccatggaactgttaactgaattttgggaaggacagggacttgtgggcatggctctgttctgcagtggttgcctggcaagtataggctgtgtgttctatccttctagccagaggagaaaggagaggggcagatgggaggctggaaggtggagatccttctatacttctgctagacatttagaatggtgcagctagctttggaaaaactgattctgacagtcctgaggttaaacctaggattaagtgtctaacccagagaaaggaatacagagctctatagacatgtatggcagggctgcaggaatggctggatgagtatgggtacttgtgtaagcatgagaacctgcgtgcaggtaccggcactagcccttatatttaaaaatagaaagaaagaaagaaacaaacaaacagaagccaggagtgtccgtgcttcgcttgagttctaggccagctgggtctgtatggtgaattcaaggcctacaagggctccatatgaaactctgtatcagacaaacacactatgtacacacatacctcttaatcccagtgctgtgggggagatggagataggacctgggcttcgtggctccaggtgaagcccaggtttagtaagagactctgacttaagggaataagaaagtgtcagagtaggatacacaccatcctcctccagctcccacactcatgggcacaagtgcctgcacacacacacaggtgtgcacacaccatatacaagtacttttggaggtggtccttgatttccaatgggatcacatccttgtcagtgattggagactgataactaagtaaggtggtaggcttccttttggtgtgataaaaacattttaaaactggcaactgggtctgtaagatggctcattggataaaggagctcactgccaagactgatgacctgagtctttgttccgggactccagagagaagaaagagccaactcttacgtgttgtcctctgacttccacacgcatgctgtggcacatgcatggacacaagtatgtaaaatgtaaaattcatggcaaccgtgagttgaggactgttgggaggaaaggagctagaagtgggtatgtgtgcacgtgtgaacatgcacacgcatgcacatgtgtatcagggtcagaagatagcctggattatcagtcctcacttcttttgaagtatggcccctctttggctgcagcagtcaactgaagctgttgggatactcagggttcctgttgttcacctcccacctcaccggaggaatgacagggttatagatgcgcactactgggcttgacttgactttgggatctgaactcagatcatcatacttgcccatcctacacttcatcctctgagccctcttcccagtcctgccttgtttttttgacactggtctggaactcatgaggtagcctagtttggctggctagcgcagtccaggaaattccccagtcttagcctccccagtatcagggaagtgccacacacatgtgccaccacacccagactttttaagtgaattctagagttaaactcaggtcctcaatgcttgctttacccactgagagatccccccaggcccatgggatgaactgccaaaaacaaattttaattacatgtatttatttcttgagtccacacatgcaccgccccagtgtgtatgtggaagtcagagacagccagcaggaagttctttctttctactgtgtgagttccaaggaccaaactcaggtcagcaatcttggcagcaagcgcctttacccattgagacatctcgctggccctgggacagaattttaaggaagagtttgaaactgagtaagccagaaggtcaagggataataagcctaagaatgctaaagaaacatggttgagctcaggatcagcctgggctaaagagtgaatcccagtgcactggggtaaagtcccttaagatagtgccccacagaagaaagctacaaagcaggtccaatgtggcgagggttgaggcagaggcatgggggtgcaatctacatggtatagccctggtagggcaggaaatcttccttgggcagaaattgcagggttgagccttcaaggttcctgataaacagaacagtgtggttgaaggcattgcgttggtccttccaacataagctcaggctgccaggttaagtggcaagcgccttcaccaaatgagccatcttgctggcccaaaagcattggtttgtttgtgtgtgtgcctgtatgtaatgtgtgtgcgtgttcttgtgtatgtgcacatgtgtgtgcaggtacacatgtacgtatggaggcaataggaagatgctgttttatcactctctgccttaatcctttgaaattgggtctctcactatacctggacctaggttgcaggcattctcctttctcagcctcccacagttccagggttacaggcacatatagacatgccccactttttatatgagtaacgggaacttaggtctggcacagcggacattcttttcactcacagagccatcttccgaccccccacctatttttgaaacagggtttctcactgaacctggagcttactgattcagtaaggctagctggacagtcagccccagggatcctttgtctacacccctggtctaggattacagctgggcttaggtggttgctggagatctgaactctggtccgtgtacttgctggacacagcccccaggctgcagggatcttcctgtctctgtatacccagcactggggtcatagcctagcttttaaagtgggtaccgggatccaattcagatcctcacactatgccagttgacgcatttgccccctccagaacccttggcttctagcctctctcagtgagaactatgtacaatactctcccagcattttgaagttcaggtagtagatttagactcacttaatccaaaaaggaagcaatgatgagggtgtcaaactctttagagtcccgggctctctggagataatttacggtaaagaataattgagggccaactaggtgactcgtcaggtaaaggtgcttgctgctaagcctgatgactttggcacacatgccccacctcaaatgtaaaagtgaagccgctgtggagacactggcatataactttagcatatgggagttagagacagaagaaccaagagtttcaaggtatcttcagcttcatcatgaattcaagggccatcctgtgctacatgagaacctgcttcaaaagattcataaataaatggatacattgtatcgtagtgtgtcagatactcatgtttgtccctgcggttcatactctttccagcccccaggtaaccaccttaaaggggctggaaaatggttagactgtttgttgctcagggggaaggaccagaatttgatcatcttcagacccggaacccacataaatgaaaggttggcaatacacctgtgattctggcctcaggaagcagagataagggaccccgagagcaaactgactatggagactagccatactggtgagcccttgcttctactgggagcctctgcctcagtgaataatgtggaagactaattgtgtgtgattcccaatggcaatcccaggcctccaaatgcttgcttgaacatgacacacacaccccttgtactgacacccatacacatatgtgtatccacatgcatggaaaacatgaacacacattcacacacacccattcacacatgtgaaaacgggaaaggacaagactctatctttaaagacaaaggtggggggaagaaaatgtccctcccatcaacccccctcccaggttgcaccctgaccttgatacacgccggatatgttaaaatatattcaagctcacaccattttagttgtaaaaaggatgctaacggaggcctttgcaaagttctggaattttcctgccataggaattagctactgatttacatttaaaaaattttagtgcatttttacttattttgtatggcaggaaggcttgtgtggaggtcagatgacaacttgcatggctcaattctcaacttccaccatatggggcctgggcctgggcctgggcctgggcctggggatcgaacttaagtggccaggcttggcagcaatcctctttactcactgagccatcttgctagccccatttacttacatgaatacttggcattcttctttttatgttagaagcttctttaaaaatttttaattctctttttttttttttttttttttggtttttcgagacagtttctctgtgtaaccctggctgtcctggaacttactctgtggaccaggctggcttcgaactcagaaatccgcctgcctctgcctcccaagtgctgggattaaaggtttaatattcatcttaattttatgtgcgtgagtgtttttttcttggtgtgcgtgtaatggaccatatttgtgcctggtgcctgtggaggtcagaaggcattggctaccctggaactggaattgtggacagttgtgtgcctccatgcccatgctggtaattgagcccaggtcctctgcatgcacagccagtgtttttagcctctaagctgttgtagcctccttaggcttgtggggaagttaaggtgctcagagaacaaaatgcctgctcccagtttgcaggcttagcactctggcgctcaggatgattgcccatagttaattccctctgcatttccctcactctaatctcttctgctgtcaagcataataataatgggtgttccctcacctcccactgatccctgcctggtggaattggccctcccttccagaacaagctaattagatacagtagagggaccagcaaacttctctgcaaagtggcctgcacaagctcaaaccagccaacgtctcagtgaggacagggaagggctcatgaagtgctacccctaactgagaagtcactgacagttggaaggagagttggggttcttcacagatgtggtccctgaaaggctacccgtgctcctgtcaccaggtacatacatatcagcaacagtgagtgtgcaccacaagtttggggttttttgtttgttttgttttgtttttaatttttgttttttgttttttaaagagcacaggaaattgggaggagaatgtggtgcaggggatagaggagttggaatagagaaaggagaaaatgaagacgtgaccttgttccaataagacttcatttacaaattaaaactgtctgacccatgaatcattgttggtcagtgtttgtggtaagggtgaatgcgaatgaggttggggtgtgtttgtgtgcatgcttgtgcccgtctccacctccccaaagctgggatgataggagcatactcccatagcctggcttttttacatgaagtcctcatgcttgcccagcaagcactttactaccccagccgtctccctaccccttagatttggcctttctacagttctgtctctaggctgtgtggcgctgtaaaagttgaggtgtgaaggccacaaatgagatagagggtgtactggctagttttgtgtcaacttgacacaactggagttatcatagagaaaggagcttcagttgaggaaatgcctccatgagatccagctataaggcattttctcaattagtgatcaaggggggggtggtgtccccttgtgggtgggaccatctctgagctggtagtcttggttctataagagagcaggctgagcgagccaggggaagcaagccagcaaggaacatccctccatggcctctgcatcagctcctgctttctgacctgcttgagttccagtcctgacttcctttagtgatgaacagcaatgtggaaatgtaagctggataagccctttcctcccatgtgcttcttggtcatgatgtttgtgcaggaatagaaaccctgactaagacaggggacagctgacttagtgtctcagaatctgggtgatggtgtggacccactcttcctgcatggggtccagggcatgggttaacagagagttcaggggctgggtgtggtggtgcacgcctttaatcctagcacttgggaggcagaggcaggtggatttctgagtcagccagcctggtctacagagtgagttccaggacagccagggctacacagagaaaccctgtctcaaaaaaacaaaaaacaaaaacaccagagttcagggactaccaggttattgatttatgggtagggccatatgtggaggttaaaggacattttgggagagtcagttctctccttccaccgtgtcaatcctgggaaccaaactcagtttataggacatggcagcaattccctttatctgacgagccatcttgccaaccttccatccgaggctaaaaacaataagaccttctagttattctactccctacgtcctcgtcggaaagattcacttaccttgggcaagttcagaccagagcgtccctcccgcagcagatctttctgggattcccctaccctgactccatttggtgtatttttccagaatgcagtgggtcaaaacactcatttccaaagtcattaagaaaagagatcctccccccaccccccaggaggagggcattctgtgtacaaggtttggttcctgcccagggcaggttgcttttctattcactgaaagaaaaaagtactgagctcttcaagtattcgccctccttctggccacctctgctgacacacattctttatttcaccaataaagcttggctctgtccctctgttttaagagttatttttattttcacacgtgactatttccctgaacgatgtctatacactgcatacatgtatcagcaatggaggccagaagagggaatcgggttcctgaggctggagatacaggcagctgcgaaccacaaggtgtgagtgcagagaactgaatctgggtcttctgcaaggacagccagtgctcttgaccgtcccacctcttttccgtagaggggtgggtggggcttggagctttttgatatgcagtcactgtcactgaacatgtctatcttctgtaacgggctgctttcattatttccagactctaaccttgattttatctaagaatacttttattacatttattcatttattaattgagtgaccatcagagggcaacttatgagggtcattgtctccttccaccatgttgatcctgaagatggagctcaggttgctgggcttgcaggcagcacctttactggttggccatcttaccacccagttttgatgtctgagtgaccaactgagtcaacataacatttttaaaaagattgaaacccagtataatgtaaaagagaaacccatgttagtgttcacccatcatcccggctctctgcaggtagaggcaggaggatcagttcatggtcatcctcagctacatagtgagtttaaggccagcctggggtaggtgagcctctgtcttggaaacaaatgaaaacaaaacacaaaaggtacctgcaactcaggctcatccctgggctatgtaagagaattcggggccagcctgggcttacataggtactggctttaaaaatataaataaataaaaactcagaagaaaagcagctatacttctggggatgcctacctgaagtgggggagttgttttgctaggacctccatagttcaaaatctaggttgcctgtttgctttgtttcagaggtttatttcttttcacttttttacgtgtgtgagtattgtttgcctgcaaatacgaatgtgtaccagaacagggtgtcaggttccctggacggggagttacagaaagttgtgagccaccttataggcactgggaaccaaggcctgatcccctgcaggaatagtatgaactcctagccactgggccattgccccagcccctggttttaagttgttttacactaactcgttaagtatgagagtggtgaaggtgagagagaaaatgcatgcacatacatggcacttgtgtgaaagtcagaggacaacacagggaagttctcttccaccatgtaggttctggggatcagcagcaggcgcctttacctgttagccactccactggcccagcatctggctttgatttggccagaagcatgtaaaattcatgtgggcctttcagtaggtagggcaggtatgttgaggcagagtctttagcatacccttgaactctcagtatatagcccaagctgacccatgagactcagccttctatgtgctaggataacatccatgcacctagctccaagtatatgaagtccctccaccgaattccagaaaacagtgtgacattgcaacttgaagtggtcttattctacaggacaagtaatttcactgtgcagctctggtaacagtgaggtgacttgcctcaggctttatctcctcagtccccttcatcatgagctcattcctctggggtcatacatggatatccctctccaagaacacatataaaggccatttcttctggccagtgacttggttggtctgtctgtctgtctatgtctctctgccactgaaccgggagttgtttgttgtagcctgcaagcctcggtgctccttctggtgttagaggtgcgcgtgaccactgtccacatccagcttttatgtgtaatggagatttgaattcaggtcttcatacctgcacagcgaatgcagtgaccactgagacatctccccagctccttactggtggctctaacgggtgatggtcatagttcgtcaacttagaccatccactccaccaccgtgtagcatccacagttaaccttgatgatggctcgctccatctgggaggcatctgttcatgagctggcctgtcagtaccacatgggtttcagagtgcagaaatagatgcatgggcagggaccttccaggtgtgatggtggtggagctgtgtcttccggaagccactggagtcctgtcattcaggacagtcggccatgaagcttgtagggcaggttccaggttatccctttttcttttcttctttgtcttttgctttttcctttttgttttgttttgttccaagtcaggtggaggcagagcccaggatcaccataaggaagggcgtggtgtgtgtgtgtgtgtgtgtgtgtgtgtgtgtgtgtgtgtgtgtgtgtgtttcctttccttctaccatgtagggtctgggaaatgacactcagactggaagaccttgggttagggttagagtgaagggttcccccctttcttgtgttcaaataacctttattttaaggcactatggatgataaagttaaaatgccacagaacgagggaagtacttttgacagttccatgactacgtacattatttcctttttattattaacttactaatttcttactatctatttatttatggttagcatacagactggtggctgtcacagtgacactttgtacacaagtgctgttgaactttgtgcatacttaccctcctgagaccctccctcatcgcaccgccatcctcatcctcccaaatagccttccttctgtggtactggttttgtgttttgataaaaggttatgtagaaagggtatgttgtgtagaccaaatttgccttgaacttgttatataacatagattggagtttctggtccttctgcctccgtcttacaagagctgagataagactgtactaccatgcccaggtcttcattgtttgtttgttgtttttatttgagacagagtctcacgttagccaggaactctctgggtaaactaggctagactgaaacctgttctgtttgtgcctcccaagcactgtgactacatataccactgtgcctactttttattagttttattacattttttaaaagatttatttatttatttattatatagaagtacactgtagctgtcttcagacacacgagatgagggcatcagatctcattacagatggttgtaagccaccatgtggttgctgggatttgaactcaggacctctggaagtcagtgctcttaaccatctctccagccctatgtatgtatgtatgtatgtatgtatgtatgtatgtatatatgtatatatgtatatatgtatgtatgtatatgttcatgtatacttgaatgcatttagagggggttatgagccttttgcatgtccacatgtgtgtagcaaacgtgtgtatatgcatgtagaagcctcaaatgatgttagattccccccccacacacacacacactttattgagtgatctcactgaacctttatctcactgagttagccagtctcagtcagttagttcatctaggggacccttgtcagctttccaagtgcaggaattaacagcagccaccatgcctgcccagcctttacatgggtccaggagatccaaaatctggtcttcatgctaaaatggtaaacactgtccattgagccacctctgcagcatgcgactgtttttgtgtttatttaaacctcggctctatgtatgagaggagctatgacataattcttaccccgtcaccctctcctgtttctccccacatagtctcttcattttgatgtctcacacaatctaaattgcacacataacatagagcgccatttatttatttttggtatgtgagaatgggtatggatcagtatgtgtgtgtgcctgtgagtgtgtgagtgttcgtgtgcacatgcacaccagcgaatgtacccaggtgtgtacacagaggccaggagagtacatcaggtaccttgttctatctgtgtccactttagttcctcgaaaacagggtctctcgctgaagctagagctgggcaggcagctggcaaaccccagaaatccctgtctctgaccctctccactcccgcacacactgcaagaagttcaaactcaggtccccatgctggcacagcaagtgttttagcccctgaaccatctttctggtccctaacgtggtttataaggcaagctaggactcaacttggtcatgttgccctcaagcctgatggtctaattcagtctggtgaccatgtggtagatggaaagaacacacaccaaaccaacgtttgtttgcttttcttttaaggctagagcacacacctctaatctcagcttggctactcgggagggttggggtggggatctgtctgccaaagtgtgcatatggagttcagaggatagcttgcaacatgagtcctgtggattgaacccaggtcattgggtttggcaacatgtgcctttacctactgagccatcttgctgttccgatgacaatgatgactttgacagtgacagtgaccataaaggcaggctacagtcttgagtcttagagtccatatggaaaagccctgtcacctcagccttctactcattctggaacatcaagtcagtccatggaagctggttgaccacttgcttagctccaagaatatcatattcttggggaccacaggaaacgtgcgcagggctactgagatcattccgagctgactggcctctagccaagcccataacaggatgggtgaaacttcttcatccaaactatttattagtgaactgtcatgaacctgaaaggaggctgccccaggccaagctcctgtgcgggcatctaaacctttgcttattactttatcatgtagagaatgatgagggagaaaacctccttatctaggctggaggccacacagactactggaggggcctgaactaccttgtgagaggctaagatctaaaaactctcagcagttgcctgaggcaagccagctgtaaagaaacccacgctccagtctaagtgaagtcttcccagccccaacattgttggcattggagctaaagagactgtggtgggctgccctggggaatgtcttccaggagtacccttgctccctcatggagataactagaggcaatacaggaactgagcatgttgctcaggggttggaagtgtggcttaaagatggaaccactacctagaatcccccactgcagagctaggagtgtggcttgggtggagaacctacctggaaactccagagagaaccctgtgggcatcatacatggcttagcgtgtacaaagcctgcctggcatgcatgagatcctgggtttaaaccctgtgtttgcctgcttttgacaaacgccatcctttggtgttatcagtgtctactggacccttcagaaagaaggaacccaaagactttgctttctgtcccatccccgaccccccttccctctacagaccctgcctcatcgacccaggtcatacccctgcatcatctgtatccttccccctcccgacccctatgtttcacagggtacagtgttctgctcacctgtcattccatcctcgggcttccttaaaggccttaccatttgaaatgcagatgaccaaactggtttcctcctctgtccctgtaatgactggcctgcctgtaacattccctctgtgaaatgcaggttctgtcatgcctcttcctctactgacaccctagccggggaagtaaaggcacgaaagaataaaccaccacgtgcccagccctgctggcaaaccccatgccatccctctcaactaacttgtacttagtaagccttcattcctttgtctcacctcctgctctttcccattgttctctcctggaatgcggttcctcttccctctttcctcctaacagcctcttactcatactacaaagcctactgcagatgaccctatgacatcttccttgggtgaaagaaacatttcagctttcttcggtaaccattggctatactgccattctttggtcacctggactcctctgggctgtgacccagtgtcattcccttaccatactgctaaaatatccagagatattttaactctgagcagatttgtaaatagattttacttgggggatggtagcctgggcatttgggaatcatcaactgcagagctgacccccagttccacccatccttaaggacttatggattgtataaagcccatccatttggtctcttcggcattctagaaagtaccaggattaattgcttaggcagtagcttggggactagggatttagcagagtagccctgctctatctctggacactggactctttgtcacttggtcttagcaagaccccagttagctgagcaggcgtgggagggacatcacttgttaggaacatgaggtttatataagccctggggaatgtagacagccgattttgcttaactctaaacttatattgggacttgaatgagtcactgggtgaaggtgtttgccaccagcctgatgatgaccttacgtctgtcctcaggacccacagagtaggagagaaacaactcctcttggcgaccacagtatactctacatgcattgtggatgtgcacactcatacagttaaatatagtaataaaggcattgtgtgtgtttactttttgttttgagacaggtctctcttcatagccctgtctgtcttagaactcgatatgtagatcaggcaggtttccacctgcctctgtctcctaagggctgaaattaaaggcttgtgccaccatgtcctccctgaagtatttatttaggtttggtttttggtcttcggagccagggtttctctgtgtagctctggctgtcccggaacttgcttgaggagaagtttagcctcaaatttaaagatctgcctgcttttgcctcctgagtgctgggattgaaggtttgtgccaccaccactcagctttgaaataattttttaagtttatgtttttggagaaaactcccatatatcacaatatctttaagtctactttcctaaacttgggaaaagaaaatagttctaccccccccccccccgcctccagtgctgaggatggagcccagggcttcaggcacttttaggcaagccatctcagtcctatttatcctaaatataaacataggattcattcccattttatctatacctcatacacacggcttgaagataatttcttttgataaattgtttttggagaccatgtatgtggaggaacttataggggcagttctttgcctacctgagtcttggagctcaaactcaagatgtcaggcttgtcttgacagtaaaagccttttttggctctagctgagccatttgaaagtaatttggggcagtcatttttcttgtttttgtacaggtctgttttgagtgtaacccatcatgacagactcagtgtgaaattactatatcaatttggtactctaaaaattttggattttggtgcagtttatgtttcaagtgtggagatcaggaatgtttggccttcagaattcaaaagaagctagacatttgaaaactaatgtatcaagcaagctaagtgtgatggcgcgcctgtgagtccagtattcaagagcctgaggggagagaatcaccgctaatttgagaccaggctgggctatagagtaagagaaaaattaacgatgagcctggtgccagcctgccttctccacctgagagattgaggctgggtgttcggaagttcaaggtaaatccctggctatagagaaagctggacgccagcctggcttacaagaaaccctgtctcattcaagagtggaaagtctggagccggcactcagtgggtagagtctcacttcacatgtctgagaaccctgggttctaccttcagcactgcactaaccaggtgcagtgctgcacagcagaaatcccagcacctggaggataagcttgtcttccactccgtagaaagttggaggacagcctgggctacatgagaggagagaaaaaaggaactgagggagtatgggggagaaaacaccttgcagccatcttccttaagccatttatttatttatttatttatttatttattgctcttattttgcaattagtttaaatttatagagtttaataggattgtgtggagttctgcctgctctccctactatcaacctcatttagagtttgtttgtaattctgtgtttatgggtgttttgcctgcctgtgtgtctgtgcaccactttgtgcctggtgcctgtgaaggtcagaaggcagcagcttctgatcccctagagctagagttacagacatatgtaagcatccgtgtgagtgttgggaatcaaacctgggtccttggagagcagcgagtgcttttaactgctaagccatgactccagcttcctgaccttcttcttctttttttttttacatttatttaatgtatgtgcctatacacaggcaatggcatacctgcagaggtcaaagggcaacttggagaagtcagttctcttctaccatgtgggttccagagattaaactcgggttaccaggctttgtggcaagctccctaatctgctgagccatcttgctggccctccacctgatttctttgagacagagcctctcattaaacctgtagctagctgattggttagaatggccagccagaggactttggggatccacctctctgcctccccagggatggatgtttctaggcctagctttgttgttggttttgtatttcgagacagggtttctctgtgtggccctggctcttctccctctgtagaccaggctggcctcaaactcagagatctccctgccttcttgcctcctgggtgctgagatgtgtagcaccacacccagctttctggacccagcttctatgtgggtctggggacccacatcaagtcttcccgcttccccagcctcactcaggaagccatcctgagtgttggctccacccactgtttaattccttttagacttaattttaagttcatcccatgctatcagcagggccaggtgggccaggggattattcagcgatagaattcatacccagccccgggttcaatcagtttgttcaaaatccacgtcaaggaaattggctgtagagaaagaggtagcatttcttcaggacccttggaggtgttccctaaggcccatttcttatcgactcggagtctttacaggtagaaaacttgttctcattcccgacactgcaggactgaccacaccaggcagccaactggtttctgtccaagaatgttccactttttttttttccgccttccaattccttcttagatgagtcacctgcagtttgccttagttacttcttatctttattaagcaagaatccagctgtgggtagtagacgttaagagacccgcagggcgtggtggcacatatctgtcatctcagtactggagagattgaggcaggggaatccagggttcaagggaagcctgggctgtatagtagcaaccttgtctcaaagcaaaaatagcagctgtcgaaataggtcagagagcagaggcactttctgccaagcctaatgaccggaatttgattcctggaaacaacatggtggaaagaaactgttcccttgaggaggccctggacttccacccatgggcacatacaccaaataaataaacgagctgagtgtggtggtacccacctttaatgccagcactcagaggcagaggcaggcaggtggatccctgagtttgaggtcagcctggtctacatagctagttcaaggccagccacatctactctctgggtggataaaatgaaacagcacacacgctgtgtggtatttgctgttgattgggtcttgaatgcctcttaaaaatccatgtgttgactgtgtcccagcctgtggtgctattgaagtgttgaggtttcttttggaatagagcccatgacagttgggtcactggggctcaccattgaagtgagtatttgttgggatccagaccctttctttctctgctttttagccgtgatgagggtgaggccttgtctgctacaccattttgtcatgatatctcaaatcaccatggagcagagcaagcatggaacttggaaatgaaataggcctactccccagttaggttgattgccccaagtatttttgtaacaataacatgaaatccctgagcataatcttggatatcaatttagaaaaaggccttattaaactgaatggtgtggcttagtgatagaggattctaggcagagaggcttgggatgtgactcagtggtaaagcatctgtctagaattcaccaatgaaaggtttggaggtacaaggtcatggcttggtggtacagctccttcctagaatcccccagttgggctgtggatatgactcagcaatattcttgtcactaccataaaacctttggagagttaacatttattaagaacaataagggtgggttgggatggaacttggtgttagagtattcgttcacattaatgaagcaaaagaaatgatttttcttttccaaagcaggaagggctgaagagatagctcagtggctaagagcatacactgttcttgcagatgaccagagttaagttcccagcacccatgattagaagcttacaactctctggaactctgactccagaggcccccacacgcctctgcaggcaccaacatttctcatacccatacccataattgtatatgtatatacataattaaatataataaaaatcccctttaaaagtttgtgtgggcagtatgccagacactgaatcaacataaagggatttggccacctacttctagccttgctacctgcttctctttaccccagatctgtgcatcaagggggcgtggggaggttgcccaggggtaccgtgtgttcagagtagaactctttggttgtttataaacagctgcactaaaggcagaaagtcccactaggtagagctttgtgggactgagaaagtagctttcttcttttccccttttatcctgttggtaccctcagcctgtgggatgtggctgttagggccagggtcagtgtcccacacttagctagtctactcaagagatcaaccagtcttgcttgctggcttagatgctccttatatcatgctaacactcaggattaacccggacaagagctgtggatgcccgggggacaagagagatctaaggacccgtgcttaaatccttggcacgtgtgaacagctagccatggctgtgtgcacactcctgtaacctcagcactttgctgggtggagacaggagaactgcttaggtttgggggccccagcatagctccaggtgcactggaagactctgcctcaaaggaataagcttgagagtgagagagcaggacacctgatgtcctcccctggcttctgcacacacacacacacacacacacacacacacacaccattcttgtatttcctcacatgcacacactagttaataaaacaatgactaaacagcaaaagataataaaacagtggtagaaaaactaagaagttaaagcaggagaaaataggagcttggggcatagcttagtagagcccttacctaacatgcagaggctctgagtccagtctgtatcagaagaatttaaaacccaccacagataataacccctgaggtggtagcagtggtccttacagtgcagacaggtatacctggatgcctgcctgcgtgcccttcaacacaaggatgtgatggtctgtatgctgtcactgagaggttggtggcatacagaagagctccttttgtcctctgtgaggtcggagtccttgtgatgacatcatttccagcattgtactgggtctgacttgcagagggggcaggaaggggcttggcaggacagctcagcgatcagggtgcctgccaccaaacctgaagacgcagtagaagaacagaactaactcctgcaagtttttctttgacctctacacaagcatgttacccactccctcaatatatatatcaaagtgtaataaagaaaaaatttaaaagagaaagcagagcttctaagagcacttaccgcttaggcagagggcccaggttcagttatcagcacctacagtgcagtcccccagccacctctgggcaccaggtatacatgtggtgtgcgtgcacatactacatgcacatacacaggcgaacatttatacttatacgcagagttaaggctcccaggctttgagtgtttgtgctcggtccttacatgaccctggggagaggactttctgtctgtctctccagctggcttctttcatatgttaatcttgatgtcactttctccagatcttatttaccagtcagcacagtgctcaagggaaatcttctacccagcagcttcccagcaggttacccaaaaaggccttgccctgagccaggtgaccaggccgtatccctagaggcccattcttcagtagaaggcaaactagtgattgtttgggggatgcaagaagggtcagtatctgccccagcggtaccccagcctggcccatgcttctgatgtagggagaccctttcagctgggaagaggccctagaaaagcaccgagacaattacaaaaagaagattagagagaaagcttatgccttgtcatgagactgccactaggttgagatcagcctctaccacacagtgagatccagcttaaaaatagcagtagtaataaagtagtcataatggcatggggagatagatagcagtttgtgggtagatagagatcaggctctagccccagggactacatggtgggacctttaagaggaaactgattcccctatccccatagcagaaataggagcctcatgccttcctggggagagcctgcaatccaaagcagggccagggaagggatgatgaatgtacggccaccagtgcgcgatttgatgcaaactcccttctccacatgagaaaccctggcaccagagttaggtctgttagccagcaactcagagacagtgtctcggtgagcccacaggactcagaaggaggaagaactgcttcaggcagatcctgtggcctgagcagcagtctggtcctttcttatgcaggtgtctcctcagccaccatctccctggtctcctacagaccttattgtgtagctgatgataacccctgatacagtgtgaacaccacatgcgtatattgttacgacacattggagatagtgaccagaataaaggtcacacaggactggcacagaaacaaatctctgggctcggtgggtaaagggcttgctgtgccagcacgaggacccgagttccaatccctgatccctatggaaaagccagatgcagtggagcacacctttaatggcagcactcctactgtgaagtgggagacagatgacaggatgatcaccctgacacctgagagctagtgtgagacacgcacatacacgcacgcacgcacacacacaaatcaaaattaaacaggttcccccaagtgttttacatccagaatccctcaaccctccagctgtcgtctgcagatgaggaggtgactgttctgggtttagagcgagcatcctttctgactcatacttaccttccaaggtacaagatgtccttttaattttgctgtgtcccctgaggtgtagaacaaagcagtttattcctcccacccatgtactttatacttttccatactccctttcctctctaacatcagaacgaggcaaggcagagaaatcgatcggtcgttcccaccctccaccttccacccccgctctcatcgatcctcaggtggcagaaacgccaggaactgtgaactgcaaactccaccttgcatccgattttgctcttaattgtctctctagcacaagcaagcacctgctagaactctccagacccagggagcgcttttcagcctgtaacaggaatctcccccaaagagtagatgacaaaatgcggtatcaatggtgcctctgtgtggagggaccagttttcgctgttgccccaccccacatacacttttgttttctctagagtggcctttttacagaaaactggacatttccattccagagccacttccttggagtggcatcagcgggccagtaagattactgggacctgtagactggaaggagatgagtggcttccatatttgttgctttaagatactcatttccaggcctgggatagtgtaggacacttgcttagcatcagcctggccttctttcctccacaggacaaaaggttgacagttttctttgttctttcttatttacatttttatttattactgttgtgggggaggtggtgtgcatgccatattggggatttggaggtcagaggacaacttgcttgcaggaatctgtttcctttcgatcatgtgggtcctagaaatcaaactcaggttgctgggcttgaccccaagcaccttcatccacactgggcattgtccggctggccttgagcctgtggcactgctcctgcctggaacaccctctccaagtgctgtagcattacagatacgagccgtcatgcctcctttaaacactggtgactctagaagcttctgtgttctgggattatacagtaaaggttacaagtgagaaagatcactgagcgcttcatactggtcttcaggtaattaactccctgattgcgtaaggtgccatatacataaataagaaaaaaaaaagtctttgtggccagtgaagtagatggctcagcaagtgaaggttccggtcacaaaggttaatgagttcccacatggcagaaggaaagaatgaattaactcccaccaattgtcgtctgacctccatacccgagtcatggtatacgcacactacataaaaactttaagtcatcctgaaagcagcctgttgtctgttaacagagagtgagtgggttttcttatccctgtgtccgttttcactgttggcttagtcccctccccctcctctcttgcagaaacaactctgtgtcaatcacacaagtgctaccgccaccagggacctgcagatcaatcccgcctctcggcagggagagcagacagtgctaattgggctctagagtaacttttgttttcccttcccaacactggagatccagaccagggcttttgtgaatgcccggcaagcaagctgcccatccagatcagcatttttccactttaagaaggggtctcagggaggctaggatgggtcaccagtttgctatctagctgaggatgtccttaaactcttgatccatctgcctctaccttctcagtgggggtagattacaggcaggtgcctggcttattcaatgatgggattgaataaacccaggaattcaggtcccagggcttcctaaaggctaggcaagtattagaccgtccccccaaattgtctttacagatagttttaggcaacagcaagctacatttcccctgtgtggccaggtctgaaccacactcacactgccccccatggctgtctgctttaggaaagcaggcatcaggagatgttttccacactccccccccatggctgtctgctttaggaaagcaggcatcaggagatgttttcctgtctcagagctgaatgactcatgcaggtggaatgatggaatgatgggcttcagaccagaaaaatggcagctcccaacccagctgtgagtgtgtgtttgcctagcagctttattgaggcacagttcacatactggcccagctggtctcttaagtctgcagcccagtggcttttagtgagcataatcaagtttagaacttccagaggtgggctggaaatgtagctcagcgggtagagcatttcttcagcatgcactgagcaagccctgggttccagccccagcacagcataaactgtcagccatccccagtactaaggaggtggaggcaggaggatcaggagttcgataccggcatgggatacatgttcatgattatcttcccggaccttgcccagcctagacattgcctatccatgcattcatgcaaacagcagtcttttgagtttgatttctaaatatttggagtttttttttattattacttactattatgtgcatgtggatacatgtgcaccattacatgtatgtggagagcagaggaaacttccggacatttgtcctctctttgcacctcgtcaagggaagggtttctccaccactccgctttctactccagggagctggtctgaacccacctcccatcttgctataggatttggtgaagttacagatgcatcacatccaactttcattgtaagattaattttattttagagcatgtgaatgtgtgtgggtgtgtgtacatgtatgtttgtgctcaagaaagcacggggtttccaggtcccctggagctggagttacagatggttatgaaccatccagtgtatgtgctggtaaccaaactcaggtcctttgcaggagcagtgcatgctcttgaccactgagccatctctttagccccaaatttagcttttccacacactcggtttgtcaggcatcaagtacttttccccactgagccttcctttttgctggacctgacttgcctgcagagcatggttgtgttcttcgatagctagacagcatttccctggctacactggagcacactggagtcagctgtgaccagtgggctggtagatgattgagcagtttctactactgacttccacggactgcactgctgtgaacggtccattttggcacagctttaacacatatccaggatgattacagcgtttctgtgggagtgtggatgtgcatgtggcacttacccttccttgtgcacgcagaagccagaggtcaacatccggcaccttcctcagccagtctccacctcagtttttattaagatttattttttaaagatttatttatttatttatgtattctgtgtaagtacactgtcttcagacgctccagaagagtgtgtcagatctcgttacggatggttgtgagccaccatgtggttgctgagatttgaactcaggaccttcggaagaatagtcagtgctcttaaccgctgagccatctcaccagccccaagatttattttttgtgtatgaatgtttgcctccatgtctgtatatgtgtactgtttacgtagaggagcctatggaggcctaaacaggacatcagattctctggaactggaattgcaaatggttgtatctgtgtgccacgtgtgctcagtgccatcctaaggaggccagaagtaggcatcagatcccctgagagctggagtcacatggtttgtaagctgtcattcgggtcagggaatctttttgttttgtttgtgtcttgatttttccctatgtagttctggaacttgctctgtaagctagtttgtcctggaatttgccctgtagacagggctggtcttgaactcagagatactgatgctctctgcttcccaagtactgagaaattaaaagcgtgcaccaccactgccccgcttgggttgggggatcttaacctaggtcctctggaagagcagccagtgccttgcctgctgagtgcctcaagcccctccaccttgactctgagacacattcttcccctgaccttgaagttcattattttggctaccctagccagccgtccagcaaagtcttgctgtctgcacgtgacaacacaggttccaggcatgcacggcttttacgagaatgctggtgacatacacacagttctcttgctttcactgcaagcattcctaacctgctgagccaattcttttaacattttccaaagcagcacaaggcttccatcctgtgtagcatggtaaatgctgtttagaagaagtgagagagaaacacatggtttcatttgtcccagcaggcagacctccaggtctctgggccgctggtgtgtggagaatggctgggcctgtttgatcaggtgtgatatacgacgtgcaaccactggaggaactgtcacagaggaagcctagctcacaactgactagaaacgggcagcacagcactgcatacagggcatactgggagaaagcagaaatgtagacaaaatcctcatgggtagctttttctagaagaagcaagaatggacagggttcagtttgataggtggggaggggtgtccaatgaccctttcatgggagttgcctaaggccatcagaaaacacagatatacagttatgaagtgtcaatggaaataattttatattggggagaaggggtagtgacgtggtgaattagttaaaccagtttggctccaagtaggtcacacacatcacagctgcctaagagctctctggattcacgaatgaaagacacacacacacacacacacacacacacacactcacgccagctgattttgatatgccttgactagctcaatggccaggcacttcttaaacctccctgtggcacatgcttccttctggtattcctggctcaacaccttccaaatctatattttatctttgctgcccttttaccttatggttcccattgggaaggttgagaaccttgccttatagtctcgtacttggctttgagatgatagaagcagacagaatgtagcctagagtacagctgggaaagaaggtgggtgggaaccaatggtgttctgagagactgaagcaggaggattgtcttgagttcaaagccaacatggagcctcaagtcagcctgggctaccgagtatggctcacattaatggcaactcctgttaatgacagaagtttatggaagggaggtatcttaattgcatctcgctcctgtgataagcatcttaggggagaaagggatttgtttcagcttacagttataggttgaagtcctgggaagtcagtccactagtcacattgcacttacactcaagagcagagagaaacaagcaagtgcaggcagactgacttgcccgcctgggtttagcctgctgtctgcactcttacacaggtcaagacccctgcctagggagtagcattgcttgcagtaggctggaccacccccacccccagacacatccacaggcccatccagtgtgatggttcctcattgagactcttcccgggtgactgattgtaggtcatgtgcccagtaaacggttaaagccaagcatcgtgagaaacttgttgtgactgcaggagcaacaagcttgtgaggtagatatcagagcatgctgatgacccatagctacatagaccgggcctatgagtgttgactatggcttggccactttgtgtagtattgaatattaattaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatactcacatacataagataaataatttttttaaaaaattaaaggcacaattcacacaactgtttaaggcagagctcctggctcataatttggtttgatggctgcaaacattacagagagagtcattttggacccatccaccataagatataaatacttgtgctagagggctggctcaggataagagcagagcttttgagaggatcagagtttggttctcggcacttaactgctggcttacaatatcctataactccagttccagaggatctgatatcttcttctgacctccacaggtaccatgaacttggtacacagatgcacatgcaggcaaaacactaatatgcattttaaaaaatacattattataaacaaatactttacattgcattctacattatacaaagagcatttaagtgtgctgcagtactttaggtgttggtgatagtttttgcttggaggattgtttgtttatgacagcgtctcactatgtagtcctggctgatcttgaagttgctatgtcaagcaggctggccttgaactcaaatatctacttgcctctgctttctgaagtgctgagataaaaggaatgcactaccatactctgtctgctctaatagtttattttactgttattgtttgctgtctgctgtactggggaaactgaggtctcagtttgggtctgtagtctcattagtaaaagaattttttttaatggacttgaagctcaaagataattttattttgagaaaaatgggggctgaagggatggctcagtggcttagactgtgtgctgctcatacagaggacctgagttcagttcccagcacacgatgggacagttctcagtgtcctaactccagctccagcacagctcatgctctcctctggcctccttaggaaccacatacatacacacatactatacataaacagaaagtaaccatcagagctttagagtttgaagggaaacagcagacaactataaacagtacacctgaggaacagagaaagaaagaacactgtgccttttgcaatggaggttagcaaaacctgcgtggtggacgacatggagggcttcagagagaaactgaaaagcccagagcaaccaggaaagggagcttgaactttcggccggtatcccaaggaaaaggaacaaaacaaagaatggtaaacatttcgaggactcaaaactccaccaccgcctgcactgagggaggggctctttctcattaatgggacaatttacctttccttccctgtagcatgagtgacaagccaagctgacaaagaagataatgtggtctgcgatgttttgagtagcttataatgccaggtctcctcccagggacagaagaatgaataacttagattctattctagcttgaccaggaggaaatagctttacgttaatggggctttgatttaaaaactaagaggtaacttccctttctggtgttgggagatgaggaaaggcaggacaggacacaatgcaggaacagatggacaggaggtaggctcatactcaatgatctccaaggtagctgttagtccttgtaacaggtggggatcaaaccctgggccttgagcatgctaggaaacactcgaccatcaagacgcacctccagccttttgttttaggttcttgtttatttagtttgttttaatgttttcaactgatggaggcaaagcttgtttgcacacgcacgcgtgtgtaggtcagaggacaaattgcaggagtcaactgttcccatccactatgtgggtccaggggattgagggaatcaaaatcaggtcatcaggattggtaccaaagggaccttacccactgagttatctcactagcccttttagtgtactttatgcgtatgcactcctctataggtatatatttgtgtgcataatgtatatgtgtgtatgcatgcctgtgtgcacagctatgtgttagtatactttgtgtgtgcgcgcgtgtgcacgcatgcatgtacaggtatttggtggtgtgtctcagatctcttgaaactggagttagttgcaggtggttgtgagccgccatgagggtactgggaactaaacctgtgtcctctgcaagaaaagcaagtactcttaaccactgagctacctttccaagccctttgtccttttgtttttgagacaggctgaccttaaacttgtgatcctcctgtctcattgtcctcagcatttggattacaggttcccaaggcccaccattagcaatatgtataaacattctttggagctggccgttcctagatgatatttgtactttcttttctctgaacagcatgaaagcagaatctgttcaactttggatcagaccttagttcaggaactagctagccatgctaagaggcccagcagaggccgccattcaggtttgtcccatacttgtgtgtttaaatcatcatggccttgggtggggtttggtatggtgtacaaatagcaggaaattcctgccctgacctgagccgcttccatttatgatgtttttttctatttgtaaatgggcgtgtatgcattggtgacatctacgtggccaacatctaccataataattacagttgtcagacttttattaacttgacatcagaacatttgaggcaggggtcagtgacatccccaccatgccaggctgataaacatattgaatgttataagggctggctcagtgcctcagctggtagatcacttggctagtggatatgaagccctggattccacgtccagcagccaggaaaggatatggcggtacacagctgtgatcctcgtgcttgggaggcggaggcaggactttcagaagtccgaagctgttcttggctactgagctccaggcctgccaaggctacacagagagaccctgtctcaaagggggaaaataaaagggtatttttatttaataactaataaataaaaagtattatttaaatatgaaataaaaataaaaattaaaggatgaattttaattgaaaatatttgcagcatgtagtcattcatatcttaaacttcatgacctctctgtcagaaaatttccaatgtatccttagtctttttgttgttgttgttttatttttgagatagggtttctctatatagccctgctatcctggaacaagacagagacagagagagatttgtctggccagtggttttggagtctagagcaatagcacccagcaagggtcttcctgctatttcaccacatggaagagaagggcaggctagagagctaaaaagaagtgtactttttcttaaccaaataaatcgtgagagggttggggcatgcatggttcaggggtagaacccctgcctagaattctccagtgagggttggggtggggaatgctcagagagagtgagctggagaacacttacctagaatctcttaggaattagggtgtggttcagtcatacagacctgtgagcgagcatgcgcactgtctctgatttcatccccagctggctgttttgtgttaaacctttttttcagtcagtgggaaggaaacattaccatcagtgggtgtgtggatcctcctgtccagaccctaaaaagtaagcaattggaataaataactgttcagaactcctatgtgtgttgggtgtgtccataaaacagaataatgagcctcagatataccctgatgttagagtcctgccctatagcaggactgatgagcacagccagctaagtcagcatcgtgcctccaggtctgtgggtctctgcattatcctcatatccgatctcagatcaattatcattctgaatgtagtgtctgtgccaaacacgccaaatgcaaagctcccagtagtagattatttgctgtgaacacaagctgtcctctgccgttgccccctgcaaagagcaagcagagtgtgggagagccgttccttctttttttttttttttaattgttacccaaagagaaaattctgtgccatttgtacaccacacagtcacggtagggaccagtttccagcacaccagccccactgctccagccaatacagcagggggaggcacaccttctttttctagaaggatcccacccaaggcatcaaaaccagcacagcacagcctgggtacagcaccaggcaccagcatgggaaccacacactctaagggtggcaacaggcgggggtcactccctggccaccccgagctgcccttctatggctctctccccaagaagtggaacgagaatgtcttcttggataatgagctattgacctccaagattctgtccgtgctgaggccccagacagagcgaggcttcaggacaggcaacctccgctaccctgcccactttctcagctccagccctgtatttgcctctgttgcagcctccctgaaggagcaccctcggaccacacttctgtctgatggcagcagcccagctccttccaggaatgtcggcatgaccatctctcagaaagggggtctccagccaacaccgagcccagctggatctggggtgcgacttgggtaagctaggggggcagggggtacctttaccctggcaggtgcactcacagggggagagaaaagaaactcatttatgccccatggtaatgattattaacacatgctttctaagtcctggtgttgtttaaaatttatcattatcagagcggtcttaacagcctaggttggtctagtactcacagggtagtcaaagatgaccttaaacctgtttttctagattgcatttatttatttgtgtagatgtattggggcacatgtgccacagcagacatgggggtcagaggacgactctgaggagttggttctctcctgctgtttggaatccagggattgaacttaattatcagtcttgaaggcaagcacctttattagctgagctatctactggcccagtccatgcattttctttttggttttgatattttgttttgtttcagttttttgagacaaggtttctctgtatagccctggctgacctcaaactcagagatccacctgcctctgcctcccaaatgctgggattaacagtttatgccacctatcactggctatgttttctttttgtaaaaccagtgcatacctgattatgttcagccgggggtagaggcagtttgcgtagcatactggcttggcatccctggacagggcttactcctattcccaagacatgctcagtgtctatgcctctcttggcttcacagtacatcaagatggttcgaatacaggaccagaagcattgacttggagccacagcataacataatggttatgtgcactgatgagtagctggggaaaggggctgatattcttttccctttgtaaaaagtctctcctgttacccattgctgtgagactgtgtatcctgtaagtgatcactagtaaaggcaggggcaattgggtactcctgcacacagacttactgagtcatcttactacttcatcatagctgagcatgtgctctgccacacctccagctgctacaatatttttaaatttccagaaaatgtgagcaagtagcagagtctccaaactcctttcctagccttcccagcaacacacacagacacagttgcctctgttgttaagccagtaatgcacatctgttacagtcgcaccaccagctgctacatctgcacatctgttacagtcgcaccaccagctgctacatctgtatatctgttacagttgcaccaccagctgatgcatggaacagcctaaactaagtgaagctttagtcagtagtccaggcttttcccctaatgtggtctctctgaagactcacctagaattccaaattatgtttctcaacttctttcccttcttccctcttcttcttccacatttccttcccctcttcctctcactgaaggtggaatccaaggccttgagcatcctgagcaagcactcttaacactacgctgtatctgtaaccaaaagtttcctcattttttttaaaagatgacctgtgacaagttaaagagtactcctggaatccagaaagttctccaaacatctatctagaaggaggaacaacctcattcgccttacatattccaaggaaacatacatgcctatttaagccacttttgttgtttgtagactcggctctctccttccactccatgtgggtctcggggattgatctcaggtcaccaggcttagaagcatcttcacccacagagctgtctcactggccctgactaatttttgtgaaataaacatttcaatcatctccactcagaccaattgctggagacatggatgaagctgactccgtgtttttaaagttgaagcagacggcagacgactctctgtcactcacatcctcgaatgctgagtctgttttcatagaaggtatggtcaatgctctctgctctcctgggggatgccacatggttcctggctctactgggaaaagccagaggcttcagcatgtcctccataattgcaacagggagatatggcaagctctggacccttaaccaacaacattctgtccttcccccagacccttacattgcttcactgaggtgtgagatcgaatcagatgcacatgagtttgaggccgagtcctggagcctctctgtggatttagcatatgccaagaaacagaagaaggaggtggtaaagagacaggacgtcctatatggtaaggggtctaacgcctgtgccgccatgctggcgttctctttaattctttctttcctttcttttgtaaaaatcattttgtgtgtggtgcatgcctgtacgagtccagccttatctggaaacgcctttgtccactgaaccatcttgctggccctgttttggttttggttttttttcttgttttgttttttgagatagacagtcatagcctcaaaattaccatgtcacctcaaataactttaaatttcctcttcctcccaagtacttggaattacagacagacactgcccaacctgattatgcagtgctaggaatggaagccagagttttgtgcatgctaagcaaggtctctaccaaatgtgctaaatcccagcaccttctttttatttatttatttttttctttccctaattccacctaagagtctgaggtatgtagccagtctcttgggagaactggtcatttgcctcacttcctgctctcccaggacagccctacccgggaggtttttgttggcacaggtccctgcaaaccagcctgacaagtgcccaggctgattcatgctcacctagttagtgactgtctccttctgtttggtctgctgggacagaatgtcatcagcagggtggcatttagagactgaaacatccagaatttggtgaaaccagcttcctggtcttagacagcgcctccctgctgtgccttcagagtgcttaagaacaggcaggagcctcttttatttgtatgtgtgttagttccaaatccaaagcacatgatagccactggtttcatctctgatcttctcggattttgttgttgtaggtttgttgttttggggttttttgtttggttggttgatttttttgtttgtttgtttgtttttgttttttagttggaggatttcatacctgaatacagtgtttatatcatttttataccttttcatacacactcatgtgtgtggtgtgggtgtgggtgtgtgtgtgtgtgtgtgtgtgtgtgtgtgtgtgtgtgatgtgtgtcccacaggtagagaggtcagagtctttttctaccttttgtgagttccagagattgaacttgaagtcaccaagattatgcagcaagggcaagtatctttgttctctgagccagccagccagccagccagccagcccagaatcctattctataaacacgttttcccacctgtgaagattttacttacctcacctaataacttctcagaggctcgcctgttttctttgtttttgtttttaggcagggtctccttgtgtagcccaggctagcctcacagatgctttgtaacagggtgaccttgaacttctgatcctccctgccttcgctgccagagtttctgggatgacaggcctgnnnnnnnnnnnnnnnnnnnnnnnnnnnnnnnnnnnnnnnnnnnnnnnnnntaaatttgagcacatgagtggaccacagtacatggggttcagggtccactggagtctgtatctgataacatttattcagagacgtgcaagcttcactcccaccaaggctgtgttcctcagcacagccttcttgacctcaagggacagaggctcctgggacattgagcttccactgcacattcctaaattttttttttcaactgcttttgcttcagactcacatagcactgaggggaggaaaggcatctaattaagaaaggctaaaggccacgtgtgatgggaggcacctgttgttactgtggcaggaaggatgtttgagccagtcacatctctgctccccagtggtaccaaaaggaaggatcactggaactcctcaccttccagcctctgccttccgtacttgggcttcagtaatgcatgcgacacccaggtttttaaggtgctgaggacagaccgtggcctcgtgaacatccttacctacgtcaagactattccttcttttctgttgttcattttgttgtttatgaagtaactgagctagaacctagggcccggtgtatatgaggcttgtgctacctagctatgactcgggtcccaagaccctgtgtccaaaaaaaaagagaaaaaaaaaaaaggaagaaacaaaggctggaggtgtggcttagttggcaaaattcccgctgcacaagcacgagttcagatcccagcacccatatgaaaaactgggcatagcaacgcaggctaggtactgcagtgtgtgtgtggaggtcagaggacaacttgggcgagggaggcgtctctcctattacatgggtcctacggattgaactccaattgtcaggcttgggaattgtggcctgacatgtttccatgtgctgcttgctgatgacttattggacgcttaccaacataggcttgaaacgtttcttttcttttaatgtgtatgtgtgggtttcctccatgtgtgcctgggcaccgcttatgtgcctggtgtcccaagaatgcctgaagaggatatcagatgctctggaactgaagtttctagaactagagttacagatggttgtgagctgctgtgcaggtgctgggaatcaaacccgggtcctttggaagagcaaccaatggtcttagccactgagccatctctatagtcctattttctatttctaatgtaatttattaaaatatttattattttatatgacgtgagggggcttagtatctgtgtgtgtaccatgtatgtgcaggtaatagcagaggctaggagagaacaacagatgccctggaagtggagttacaggtagttgtgagcctgcacgtgggtgctggaaacgaaacccatttatatatatataaatgtatgaaagagagagtgtgtgcatgcacgtacatggtcccagccataggggcagggacatgggccgagagctgacagggtcaatccagctgcagcaggtctcaggatgcgcgtaccctgggaggtaaggtgaatcttcccacgcctctgtccctacagagctgatgcagacagaggctcatcacgtgcgcacactaaagatcatgctgaaagtatactccagagccctgcaggaagagctgcaattcagtggccaggcagtcagccgtctgtttccgtgcgctgatgacttactggacatgcacagccatttccttgcccgccttaaggagcgccggcaggagttcctagaggagggcagtgatcggaattacgtcatccaaaagatcggagacgtcctggttcagcaggtaggtaccgtgaccaggatgggccgcacccatctccaccctgccttgcttctctctgatggaacgatgatggctctggtacattacaagcccatcattcccggaaaccacacagcgccagctcccgtccagattgctcttatctcaggaacctgagccgggaatggcaaccgaacatgtgggaacactattcagaatcccattctcagctagctcttgcctggcatgcagaaagccttgagtgccaccccgagcacgacatgccaggcatgctggtttctgccacttgggaggatcaggagttcatcgtcatcatcatcaatgacatagtgggacatggggggctaagtgcatactgaggcctagagggcctatctcaaaagggcaaaaaaatttgtatgattttgttttgttggttggtatcttgttgggttatgtgggagacaggaggttcaggcagggcctcttatagctcacctcacttgaaccttgaaatggtcctcttgattccttcctgagagctgggactactggtgttcccgcatacctagtttatgcaatgctggggaccgtggccagggctttcagtatgctagacacagacagtttaatgagttatgtctcctccagcccctagctgccaggggtagtgtatgcatacagtgcgggtgcctactgaggccagaggttgatatcaggtgtcctccatcatttcatttgtaagccaggcagtgggggcgcatgcctttaatcctattactcaggaggcaggcagatccctgagttcgaggccagcctggtctacagagcatgttccatagcagccagagatacacagagaaagcctgccttgaaggagagagagagagagagaaggagagagagagcaagagagagagagagaataatcatttatgtgtgaccacgcatgtgccgtggtacctgaggaagtccgaggcggattttcaggaattggccccgcccgtctaccatataaatctccgggatcaactcaggccgtcaggcttgaaagcatgtgtctttactactgagccttcttgacagctccagtcctttctttgtttatttatttctttgtttctcctttctttcttttctattttttgttttgatttttgattgttttatttttatttgtttatctatgtaatccaggtgtccaggaacttgctgtgtcgaccagggtgacctagaagtcacagagaccgcccacctgcctctgctcttaagtactgggattaaaggctggggcagggtctttgaatgaacctagagctgactgttttggctggttagctgtccagggagcccctacaatcctcctgcctcagcctcccagcactgcagttacaggcacatgctgcctgaatcagttctttaggcaggcattgaagacctaactaagcccaggccactgagccatctccccaggggtcagagccatccattgcaggcttccttacttctgctgctccttctgatcctagcacaagatggacaaaagggagtgggatcaagagtttgaagccagcctcacaacctaagaaaacccttctctaagccagaaggaaaccattacacactcattgcaaaaaatggctatgaaagggaattttacttttaggactcagtccatagcagtagattaggccacctgactgtgtggaccagaagcgcctggagaatggggacagacagagcttaggacaatttttgttttttgttttttttttttgttttgttttgttttggtttttcaagacggggtttctctgtacagccctggctgtcctggaactcactttgtagaccaggctggcctcgaactcagaaatccacctgcctctgcctcccgagtgctgggattaaaggcatgcgctaccacacccgcctaggacagttcttagcatgaacagatgaaccagatggaagcagtcacaattcgtttcctgctaacttttctgtctcctgtccatattagttctcaggagaaaccggggagagaatgaaggagaaatacgctgtgttctgtagtggccacaatgatgcagtcggtcagtacaagctattgctgcagcaaagcaagaagtttcaaaacttaatcaaggtaaagaagaaacaaaaattaaaaacgttgtgtttgtgtgagtggggggatgtggatgtgctggacaggggctgggaggaggttgtgcagatacacacatgtaccataccacaggataacactggatgttggttcttctctgccttgtttgggatagtaattcctgttctccaccagactagctgaccttggggcttctgggagtctcacttttaaagtactttgattacagacacacaccattatacctggcgttatgggggtctcattagataccccagtatggcttaaaacttgcagatcctcctgcctcagcctcccaaggtctgtgcttacaggggtgtaccaccatgccagctcactcttgcattcattcatcggctgacaggctctcatggagtccatactgactataaacctctgtgtcgccaagggtgaccctgaagtcatgatcctactgcctctgccccaccaagtattgtggtgacaggagtgtatcaccacaaccagtttatgtgccagtggggatggaacccagggtttcaagcacagcgccagccctcacgtttgagatcagtatatagttctggttagccttgagctagaattccaggcttgtgccataacacccagccatgtgggtcctttgagtgaggcattgtcccactgaggaaccacccttcagagctattgctgtcttcgtagagttaaacctgccttctctggctggtccctgtgaccctaggggcttgtggcatgatgctgggatatctacacggctgatggtaaagatgcttggctgttaccaaacctaattttagtcctaagatggaaggagagaactgattctgaaagttctttgctaacctccctaaaggggcacacacaccaaactaagtaaatatgtatttgtttaaaaaaaccactaaaaacaaacaaaacaccactaacaaacaaaacaccactaacaaacaaaacaccactaaaaacaaacaaaacaggtgtaagtcatctcagtgctaagaaggtaaaagcaggaggtagaagttaaaggtcatcgtaagctacatagagtccagcctgggctatgcatgaccctagccttaaaagggagtttgaggggagccaggcagtggtagcgcactcctttaaccactcaggaggcaggggcaggtggatctcttaagtttgaagctagcctcgtctacagagcgggtgacagccaggaacacaaagaaactgtctcaaaaaaaaaaaaaaaaaaaaaagaagaagaagactgttcacctctcctgacacattcccgtctctcataaaagccgtggaaacagcccctgagaatgtgcagcatgctaggcagagtacaaggagcctgcccagcccccagcaggaagccagtttaagtgccactttggttcttagttaaagatacgtgttcaaggaaagactatctcacagggcatggtattacaaatttctgatcccagaattaatgggccagcctggtctgagatctcaaaaacaaaaacaaacaaaaaaacttaggtgaagagtggcagagaagaacccctattctgatgccctcttccggtctgtgatgaacacacactcatacagnnnnnnnnnnnnnnnnnnnnaacagtgcatgccaatagtcatcaaactgtgtctgcctgtctgtcgtcttgagataagcttagtaatgagtatttgttccgcatgcttgggactctgggttcaaacacaaatacaaggggttaaggatggtgaaggaaggaaggagaagagaaagacagaggagtgagggaagacaggagagccaggtgtagtggcacaaggctttaatcacagctcgggagccagaggctggcagaacagccggggtcacatggagagccctgtctcaaaaataccaaaaaaaaagaagaagaagaaaaaaaaattaaaataagctgtttgtttcccattccacagaaaattggcaacttttccattgtgcgaaggctgggagtgcaggagtgcatccttctggtcacacagcgcataaccaagtacccggtgcttgtggaacgcatcatccagaacacagaaggtgggaacacgctctgccatacccctgggtctgggtggattggtgcctcagcccaccagctctggagtttatcaatggactggccaagtcacctctttgtaatcccctacactgggtgccaggcacgtgacatgggaagagaagagctaggtgagcctctgcccttagcaagtgctgggcaaaggcagatcccaggtcagtatgtctaaactagatctgaaccagatggaaacaagatgattcctgggttattacatgatttctgggactggagatagcccatcattaagagaccagctgctcttgcagaggacccaggtttgagttcaagcactaacatggtggcaaccatacataacaccagttccaagggaatctgacaccctccataggtactatatgtatggtgcacagacatacatgcagacaaaaatacctataaatgtaaaataaaatttttaaaaatttaaatgtaaatgttaaaagaaaggaagaaaagaaagtaacaaaaaatgaaaagaaagaagaagaagaaaaggaaagaagaaaggtcttgtgttaaatggccagggcaagatctgagctggatgcagtgggcacagacgttctcttaggggtctagtgttgtgtgacattaataaatttcaacttagcttagataggatttgggaactgactatagaccaatataacctaccaccaaagtacaacttgatgagccaatgactttgttgaggatgtttaagagtatggatatggctgggcagtggtgacacatgcctttaatctcagcccttgggaggcagaggcaggagtaggggtgactcaaaggtagctgctttaccaaaaaccaccccagcatgggttaggactccagaaaactggatacccggagttctctgtagatcttgaagacagctaaatacgttggagaatctcctctctttggcaatccttattgcttaaataatcttagagagaccaactgtgtaattctggtgagtttcagggaatttcctgagacttgcgagtgttgtttactttctgagttttaatagcttccctccaggatagaatgtttcagctcagaggaaataggtagaaacatccacatattctacaccagcctgggctacaatatgtgatcttgaatcaaaactcaaacaaaagaaaagatgacatgctgatatccacagagaacacagtaaaaaggtcagaaagcattccaggtactcttgggggcccagtgtggtgaccaccccattccatatttctggtaggtttgggtcatgtgaaaataacaagtttccttactgcagagactggtatcagctcaagacaccccaagaccaagttccccacacaaggagatttatttgcctcagagggacaagggacagggataagagacagacaagagagagcacaaggcagaagggaaagagaacaagaagaaagggaaaaagataacttttctttgagggacaaagggctgcctgtagatagagaggaaatggatatagtccgcaggcaaatgggagtatataaaggtaaagggggaaacccatgtgttaggatgaggtatttcattttaatcgaacaggttaattagggcagccactaaggggtttgcgattgctgaacttcagtgctttgatagctgaccttggtagtcagcctcaggaggaggaagtggccagatacttggtcactagctttaggaatgttgttgaatggtttttagcaaggcagagggaatgagggagaagggcaagacctgccagagccatgtttgctgtgttctggctgggtagagtcccttcacctactgtgttcttcaggtgggaggggccttctctcggtccggaggtggaaggaatttttttatgaagagctaaaggacttgagaggaatctaattacaataatggtaggagcgtgtacattgtgctggatagcttatgccatttgagcaaaagctaaactctaagccaagcatgatggtgcatacctataatcccaacattcaggaggcagaggtaggaagatctaatgtaagtctgaggccagtctgattgacactgaagtctggctagccagggctacggaacaagacttgtctcaacaaaaaaagtaaaggccaggaatagtcccagcactcaagacagaggatctctgtgagttcacaacagcctgggcacgtagagaaaccctgtctcaaaaaaatacaaaaacaaaactagctcagtgtggtattgcaggcctgtaattctctgagcagtggcccaaggaagcacacctcatagatccagatgcagcagatcaccttctgtatgtctctgagtaatgggcacaaaacccaatgccacctctgcttacacgtaacagctggcactgaggactacaaggacctgagccaagccctgagcctcatcaaagacatcatctcacaagtggacgccaaagtcagtgagtatgagaaggaccagcgcctcaaggagattgcagccaagacggaccagaagtcgtctggcaaactcaaaaacgggctaaccttccgaaaggaggacatgctgcagcagcgccagctccaccttggaaggcgccctctgctggaagtccacctcagggcgcctgaaaggtgggtttcgggttctatccacatggcgctagcttggagttctggttgctatgttaaagtgataggcgccaccttagagctctatcttggattggcattccctcttgaattgtcaccaagctaagagatgggaataaaaccaaacttgcaacacttgaatgttttcaagtttgaaggagccatggactacaaagaactggacagaggaagtgtttaacttagacaaggtcctcagaaatggcccttcaggggtgggattgtaggtcagttgttaaatgctttcctgacattcatgaggccttggggtctatctctaaccccaagtaaacttgagtgtagtaacagtcagtcctagggaagtagaagcaagaagattggaaattcaaggttatcctcagctccatagcaagtttgaggcccagagtaagatccatgaaacccagtctcagaagagaagaagaaaagggctccctatgccactcatgagtgaaactctctgcaagagatgctcacaccttcatacagggactgggattcagagggcctgaggccagcactgccagcatctgtgtaggcaagatataacctggggcagaaggacaagtctatttcaacaaagaaaacaaacactagcctccgttgatccccatccaggcatggtggcacatgcctgtaaccttatgctggggtatggcagagctaactggccagacagcctaaccaaataaatgaccttccggttcagtgagagactgtgtctaaaaattcaggttgagggccgacaagatagctcactatccactggtatttgttgccaagcctaacaacctaaattagatgcctgtgaccacatgtggtgccatgtgccttccaccacatgtggtggaagcataaaattaataatacagaaaataaatcaatttttaaaaaataagtgatcagggaaggtaccccaaccccatatcaacccctagtgtgtgcacacacacagcttataaacactgcacatgccacccatatacacaaagtagtaatgtagcagatgaggaactggaaagatggcacagccattaagagcatctgctgttcttgtagaggaatctaaatttggtgtccagaacccacactgggcagcttacaactgcctattgctcaagttctaggaatccaacacctctagccactgagagcactcgcgcgcgcgcgcgcacacacacacacacacacacacacacacacacacacacacacacacacactgcatggcacactggagctctggcttgagttctgcatattctgagcaggagccactgaagggactgtctgaggagagcctctggcattcattgtctctgaatctcagaactcaggaactttggagaggggtgagttagaattggaacttctaggaacaagaagctaagcatcatggtgcctaagctgtccccagccccttggacatgtgagcactaagatactccctggtgtgctgttctctgcagatgtcctcgctgtcctgctgaccgatgtgcttttgctgctgcaagaaaaagatcagaaatatgtctttgcttctgtggtacgtgtctaagtcttcaagggtcctgcttgctaggacaataccgtggtgggcccaacaaaggcaggtgtctatgacaaaacccaaagaaggaacacggataggaagatacactgagagacaccatgtctcatcagggtccttccagaaggttcttgctccctggtatgacactgattctcactgaaaggtctcagctgggacacgagggtaaattgtcattgggtaagaagtttattaaaagaattagtaatgccataagcacacagactgaatggcaggatggaggaagctctaaacagagttcaggctcattcaggctcaagaggcaaaataggggccgtttttataggtataaaaggaaaggggagggttcacataagctgtctctgatttctgcgtggcagaccagaggagcagggttccaagagtgttccgcttgggggatgcgaggaggaagaatacatctagctcaggcatgtgagtttgtttgaggaagtgagagagaacgaatggcttgtcattcttctggaatggtccctgcggagactttactgactccaagacagatgtctgtctcctcccatggcggcagagatgccagaatctgctttgaggatggagatagtaggcggggctgcaggtaggcagaacttgagcaatgtctggtctggagtgcccaaggagccccttacagagccacagacatattctctgtctgtgggagaggaagtgggggagggcatgggggctgtcctcttaaccgtgagcctggggagaaagagaaaggctgctgcctgattatcccagaatggaaaacatcctcagtcttcccaggctcgccactgttctgtttcccctgctgcccagcatccctgggaactcacagactccaaggtcggctcaaaagagccttagcctggtgcacagatgttagacaccctagtgaggcaaatggtgaaaggcctctgctctggagctctgtagagaaggggctgggggtgaaggggacagggggaagaggggcgggcgggaggagaaggggatgggggtgaaggggacagggtagaagaggggcgggcgggaggagaaggggatgggggtgaaggggacagggggaagaggggcgggcgggaggagaagggattgggcaggggagctgaagagaaggagctaaactgagcttatgtggcacacttacaagaaccatttgggatttgcaccatttacattgacaaagaagtaaagacaccaagacctagaggttctgtgtctgagcaggcaactgtttagtccctgagtaagcctggtcagtggtcatgccctccatgaatgtgtgtcagagaaaggagggagatgggtgaagagagtgaggaaaggtgggccaaaggaaagagctgggtgggtgccccagcccctcttaggttgtcagcagaagcgatagaaagaggtgatatataaataaagacaatcctctaccaaagcaggttaccctttaatcaaagtgaaggatcgcagtctctgcaggagtggaggttgtgccaagacgggggacttagtgttttatagggcagaaaagggatcccttgcagcagaagaccccatctgctgatctgtcccctcaggctcagagtgtaagcactgccaggattggtatgttgatcttaaagcacttgagaattctcctgtcccttgtcacccagtcccacctctccacagactgggtcagattatcccatcacaaatgccatttagcccagcacacctctatgccaccatagtctcacagaaagcagaggtgcccactgtgagagctgtgcccccccccccatactgtcaggagacctcggggcagtaatagacttgaaccagttgagccctaagcttctgggaaacacacaaacaccaccatcttcccagaccctcttgtcttcctgcctccttttatgatcaccagatggaccactctgtatcccacatactgtgtcacaggcctgtcttagtccccagaaatgcaaccacggacacccgacattaatatgttccaggagttcttctttgaaaaagcatacacacaaaaagaaaattcatccaagctgggcatgatggcacacacttgtcatctcacggtttataaattcagggccttatatggcccaggttgacactggaactattatttagttgagactggccttggacttctgagcttcctacctccaaacctcaagtgttggggtggcaggcctgtgacaccacagctggcctaacgttacagtcctataaggataccagttatgatggattaaggccagtataaaaacaaacctttaatgtgattatatacttaaaggtcctgtctctacacaccatcatgctctgagatactttggcttaggacctcaatatatgaattataagagagtctggcatccaggcagtggtggcacatgcctttaatcccagcacttgggaggcaaagggaagtaaatctctgaatttgaggccagcctggtttacagagtgagttccaggacagccagggctgcacaggaagaaacactgtcttacaaaactgaggtggggagggggagtgtttgtgtgtgtgtctgggtgtgtggggcagtttgactcatagcactacttagagtgtgcctttggaggccagcaaatggttcagtgggtgaaggtgcttgctgacaagcttgctaacctgactgagttcagtacccagaacccacatggtggaaggcgaggaccaactcccacaagttgttctctgggaaaacatagtctccacaagtgcattgtgcatacatgtgcacatacacacaaaacgttaaaaaatattaataataaaagagagaccaggtatggtggcacacacctctaatcccagcacttggtaggcagaagtaggtagatatctgtgagtttgaggccttcctggtctacaaagtgagtccaggacagccagggcttggttacacagagaaaccttgtcttaaaaaataaataaaaaataaaaataaagcaaaggagagagctgcccttttctgggtgggtggtgaactcccagcacttaggaagctgaagcaggatcgctataaatttgaggccagcagggtttcacagtgagtttaaggccaaaagaacccattaaaaagaatactaggatatcagttgaaaagtctccagttagtaaaccattgctgctttgtgcttgaagttagtgcttgaagaccagaattcattccccagaatccatacaaaaaagtagggtgtggtgacatgcacttgtaacgacatcctattgccacctgcctagcagagtaccaagcacacttgtgacatcatctaggaaaccaaagtagatggcacctgaggaacggcagctaagatcactctctgccttccacacaaatgtgtatgcacactgggagtcagggcacagctcaccttgcagtccccctctataccggccttctctccagactccagcgtttggatatagcaagactagagttaagtttccatcaccttcctccatgcaggactcaaagccacccgtcatctctctgcaaaagctcatcgtgagagaggtagccaacgaggagaaggccatgttcctgatcagcgcctccatgcaggggccagagatgtatgagatgtacaccagctccaaagaggacaggaacatctggatggcccacatccgccgggccgtggagaggtgagacaagctcagggtctccctcctgcctggctcatgctcttgggtttgagaaaccactcacttgtggccttgatctcccagacagaccacttggttcattgtttggtatggtgggtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgattttgagaaacagtctcatgcagctcaggctttgctccaactcactttgtagccagtgatgaccctgattcctgcccccacctcccgggtacaaggctgaaaggaatgcaccaccacacccagtgtatgcagtgctggggatggaacctgagcttcacgagtgcttactgagcaccctagcacttgtcataactgaactgacagagtctagtccttctccttctagtaatagcaacctgtcaccatgctcacacggcctggatatctctgtatccagtgaatgagaggccaggcacttctaacttggacctttattgtgggccactcaactaaacagcttgaggccagccttgttagagcatgttataatgccctatctttgttttctgggctcctgctttacactcccgccatgcttagctctgagtggcccatggcctccagtgcctgacagtcatctggaaatagccacctccatgccacatgagaggctggagcgagagttcagtggctaacggtgcttactgcttttgcacaggacccaggttaagttccaggtacccacatagggtggcacacaactgcctgtaattctaattcaggggatctcatacctttttctggtacccacaggtacctgcacgtacatatgcacatacatataaattaaatacaataataaatagttactaagaaaggtatacaagaagctgagcttggtggtgcatgcctatactcctcatatcagcaacctgaggcagagggatcacaagtcatccctttgagaactgtcatgtgttgttggtgcccttgtcttcccttctcttcctccagtcgaagtcccccacaaaagcacaggcctggggctatgactgattattgatagagtgtttacccaatgtgcacaaagccctcactgcaaaccccagcaccatatagctcagtttgatggtgcgtgcctatattacagcacctgagtagtagaggcaggaggaccagacattcaacatcatccttgaccacagtagatcaatgctaccctgggatgacacatggtgcctgttgtctttaaaaagcaaaaccaaacaaacaaaaaaccaggcggtggtggcacacaccattctttaatcttcacggtcagagaggtagaatcaggaagatcttgagttgaaggctagcctgatctacagaaggagttctagtcaaggctacacagaaatccttacttgaaaaacaaaacaaacaaaacaaagcaaaaaaatcagcagtacagggtggggatgtcggtcagtggaggagcccttttatagctaatcctggccctgccccaggaatctttttcatagttacatgcctttatcagagcagtgagctatggcatgcatgtggaggttggaggataactttgggcagtcagttattctcttctatcatatagatcctgagggtagaactcaggcaccaaggccagaagaggatattggatgtcctctgtcattctctgcctttactgctgagacagtcccttctagatctagggctccattatcccccaagctatcttgacagcacaagagggttaggaagagattgctctgcagtactggtgtcgggacagctaagccacgagacactgatggcagccgtctgtcccctcctctccctgcagctgtcctgacgaggaggaggacgttttcagtgaggctgaggagaaaaagatagctgaagcccgcaccatgaaactccaggaatttcaaggtaagaggggtcagcaccttgggcaggttcctcttgcaacccgtgggcccacatcaagcttgtgtcacttcactgaggtttaatgctcttagcataaggttcgcccgttttgaagagttcagttcaggggctcagtagggttgactagcttcccctgggttccagcatcagtaccacacatacacaaggacatgcatgggtcaggagttcaggggcatcttcagttatgtggtgagcaaagcttgccagagctaaaggccaaacaaacaaataagcagaagagtaaaaattaaacagcacaataaaaaataagtacatggagctgggtgtgaggcagaggcaggcagatctctcgagtttgaagccagcctggtctacagagtaagttccaggatagccagggctacacagagaaactgtctcggaaagaaaaaaaaagtattatgtatgtgggcagtggacatacaaccaatgttcttaaccactgagccatttcaccagctccaggaggctgagctgggaagattagtgggaattcgaaggcagcctgtattaaagatagcttgccaccaagcctaacaatccatagcctggctgtaattgggtgaccaaggaatggggaagctccaccctatgggggggtggggggataaaatcctatcgcaacaaaacaaacagggactggagaaatggcttagcagttaagagtgcttgctgcatcaccatgtaggccagggttcagacccaacacctacataacgagccagatatcctatgcacacacgtagcgacaggtctgaaaagtgaaggcaggatttgctggctttcagcatagctgagaaagcaaagccccagtttgggaagagaccctaccgcacgtgaatacgcagaatgatggagaagcacacctgacaccctcttgtggtcttcaagcgtttgcacagatgtgcacacccaaacatattcatgcacgctcatatgcacaaataaataatttgggaggctttttgaaacagggtctctctatgtagtcctggctgtatttcgtggaccagagatgcctctgtcccccaagtgctgcaattaaaagcgtgtgccaccttgctcagcaagtaaatgtttaaaaaaaaaaaaacaacagcaacaacaacccagactggcaaggtggatcaatgtgtaaatccttgctgccaagcctgatgacccaggtttaatcctctggtcccaccctcacagcctgactccaaggccaggtccctaaggctgaccaccacctctgggttctcctgtagagcgactgagcctgaaagaccagctgattgcccagagccttctggagaaacagcagatctacctggagatggctcagctgagtgggctggaagagtcagcccagaaccgaggcctcttccgaggaggaggagacccctctgagaccctgcggggggagcagattctcagatcggccatgagtgagagtaagttagcctccccactgagctatgctatgatattccagggcgggttacctgggggaccaaagccaggctcagttctctattgctcacccaggaccaccgtcattttgcttttttttataatccagggaatggaatccagcatgtgcaatggctctacagctgagctctacccaaatcctttaagcacttactcaacaaatgctccctgggtgaccttatgttctggggtagggggaggaggggataaagcttgagcctaagagatggccagcaggtaagggtactagcacccacatacgacagcctgagctcagtcctagagatccacatggtaccaggagagaaccaacagtacaaatacaggttgtcctctgacctccacacgcgtgctgtgtcacatgtgtacactggaacacaaaccaattaatcagtgtaagctagattgttgttaggaaaacataggtccctaataatatcctcaggaaaatacatatgctcttttgagggacttctggagtacagaatgtaccctaaccttgggcaagaacattacctctagctctggcaggcttgcaggctaaacacccgtggtgtaaaccatggggtatatatcacctgccatcttcacacaattctagcttgaccatacagagacacctctgccaacctcaaagctagacctggtaagggcagcctttattgcaacaggaccacctagcagtaccagtgcagccaccagggctccatgatgtcgagcagggtaggaaaccagtgcttaatggctctcttccatcagcaagtcagatcactcaaccctttgccagcacagattagcaaaagacccagtgggtgtcttgctctctccagcaacacctgcaatgccctttcacctctgcctcctgggctattgttctttgcctccaataacactgacaaatgtggcacttggactgggactattttccctgcttcttcacctggctagagactttgaaatactagcaggccattgaacggtattagaccactcttaccctcatggatagccctcttatgtggctcttcatttaacatgtgtctcttactagacctaggtaaggactggtacatcacatccctaggcccagacagggaactgatgacagacccaagtaacattaacaccagtccaacttggtgaatcagtaagtttgtttgggtcatctacaggaaggagcagggatgaaggtttgcttacagcttaaaagcagctgtatcactgaaagctaccccagcctaacaaaagctaggaccttgaaactttcttcaagacttgcaggtgaatttggctggacaggttgaagagctcttctccccagcagtcctttctgtaggtaacctttagtaagtttcaggaacttcgtgagatttgtacattgttgagttcctgagtcttaacaagcttcccttcagaacttcctgaatcttaaggagcctatctccaatggctgcctgattgccttggcctctcccttagatgctgaggatgatgggggctctgttgttagagtgcttgactagcactggcttctaccttcaccactgcctaagctgaggtagtggtgtatacccttcatcttagcactcactgccacacttgctccttgctcatgtctggacttccccactacccgtagtataacctcatcacctgctgactcatgtcccccacctctccctcacagttgagggcatccagagcctgatctgccagcggcacctgggcagcaccagtagccaagtggaggagggaagtgtctctgcaggcctgcctcggcgggctgagaccttcgggggctatgacagtgtgggaagccctagcaagggtaagtgtgtcactttcctccgaggctgtgccttgggaagcccatgcgcagcagatccagtgttatgtacggtgtaatttcttgaaattttagttttgagccttagcctttaatggccaagttatctctccagacttgggagtgtaatttctgactgagaacattcctcggatttctgggtattgtgggctctgtactacaaacaaacaaataaaaaataaaataaagcaggcctccaggaatacactagcctgcatttattacatgggctggtctcagaagagggggatcccaagccttgtgggattcatagcatcctcttgttttctgcttggggtctccaggtggcagctttaaaaggaaggtatccaacagtgacctcaggccccaagactggcagggacctgctagcagcccagactccaggccctgtgacaacagcgcccccagtggctgctgtgaggaatcgccacaggctgtaagtggcttctgatcattttgatttgcatgggtaaagacagtccacgttgacataacgcgacagccttcaaaattactcctgcaaactcctgggaatggcaggtagtagcttgggaaggaggcagaggggaggatggacacaacatagttgcctcaacttcatcaggtccaaaatgccccacattgtttccacaagctatacagagtgtgtggtgacatctgccagggctcctgactggcccttccctttgacgcagcgcatccattgctgttgaggtttccagaggctaaggctacctgccctggctgtcttgaacttgaactggatgtgtatgtgtttattgcatgaacaataagcttcataagcaacaagcttcacttccaagcccaccctactgtagagcgtcagccacccacccatctcccagccatcccaaaaccttcgttttccagactctcagataggcatacatcagatggccatagtcacagcccagcactgagttctgtctcctcccgtagtgtgctgtggtggtttagatcccatttgatactgtcattcttgtcttaataggtggagatgcctagcacagagagcctgcccactgtcctggaattagaggtaccgcccctgctccatctcccacagggacagcatgcccatatgccctatgtaccatcatcaagtagaccaatttggctttctctctgcagctggtccaccgggtccagacactgtcgcagttgcttcttagtctccaggtacctgcagcattagggagggactggctgctcctgcccttcactgatgggctgggtctagccaagggcatgactctcatcagacccaccccgtccctgtccctgtccctgtccctgtccctgtccctgtccccaggcggtcatcgctcaacaggatagctatgtggagatgcaaagaacggccatccaggagcgcgagaagcagttccggctgcagtcaacacgtgggaacctgctgctggagcaagagcggcaacgcaactttgagaagcagcgtgaggagcgcgccggtgtggagaagctgcaaagccaacttcgccaggagcagcagcgatgggagcgggagcgggcacgccagcagcaggaactggagctggccggtgcgcgactgcaggagcgagagggcgaggcacgccagatgcgccagcggctggaccaggagcgcaccgagctagagcgacagcgccaggcctaccagcatgacctggagcgtctgcgtgaggcccagcgagcagtggaccgtgaacgtgagcgcctggagctgctgcgcaggttcaagaaacagaacactgtaccaggggcactgcccccggaggtgctggcagaggttagtgggcctgtatggccaaacccactaagctggaaatgtggctcagttttgtgcttgcctagtgtgcatgaagccccttgttccaaccccagcactgtatttaaaaaaaaaaaatacatcaaatgtggtggcatagccctgttattctagcactgaagagatagaggtaggacattagaacatcctttggttacatagcaactacaagaccatttgggctatgtaagacctagggcattggtgccgggcctaacatcacatacttttttacctttaatcccagcacttagaatacagagatggatctctgtgaattttaggccaacctggtctacacagagttccaggacagccagggctacatagagaggccctgtctccaaaaacaaaaaaacaaaaaaaaagtttatgagtagtcagatataagttgtgtggccacatttgagagagagaatatgaatatggctcagtgtgaccatgggtatacacatactgatgtgctccaagaactgtcaatcaccagaagcaactatagatggaagcagtgctctgcagagtgcagaatagaccttcctagctgcagactggatgcagagctgggtgggcaacacccattcatctctgagcatttaacagccatgtttgatcctccccgggccaaagccaccagaaggctaggaggcctggtgtgggttaatagccaccagcaggcttagcagcagtaggatgtgtcttccgttacttaccaggcccaacctgcaagccaccctcccagttcaatggcgatgggctggaggggcactcggccccagccaaagcaccaggaacccaagggagcgcgatgctacatggcacaggtacctgacaacgtagagcgacccgaggtggcccgctgggacagtgccccccctgagagccggccagccaagagcgatgtgcccatccagctactcagtgccaccaatcagattcagaggcagacagccgtgcaacagcagatccccaccaagctggccgcctccaccaagggtggcaaggagaagggcagcaagagcaggggttcccagcgttgggagagctcaggtgagctgcaccccacccccaccactcagagaagctgcacacccctcccagtggacctgtcccagcagcatatctggaatgcagacagggaggcagataggcaagcaccagtgtgcgcaagaagacagagaggttcacttttccagttgcatttctgttgtgataaaataccctgactcacagttccaggtttgagtccatcgtggtgaggagtcagagcagtgagagcttgaggcagcctctcatagccattcaggagcagagagaaatgaatgcatgtatgcttagtgtccggccagctttctctgaaccacggcccaaacctaagaaatggtggcgccccaggctgggacttccacaccagttaaggcaaataagacagatactcacagatcagcctgatgtagaaaatccttccctgaaacttttggcccaggttgtgttgacaaaactaaccatcatgctcatttacttagggcttaccagctgaggcacaggacaaacactagggctgtacccagcatctttgtcccctcaccatagagattccctatcccctgttgacacagaaggtattgtgggactactccgtaagcagaatccatgtcccagtgatcatggggaagggatgtctgcttggaagccacacacttctctcttgctgacactgagtgactccatgccacctttcaaagtacttatctggtgcccactcggaagtacgagtagggaagacccaccccaccagatggcatagagccgggtcctagcgccttccctcttccagcgtccttcgacctgaagcagcagctgctcctcagcaagttcataggcaaggatgagagtgcatcacggaaccgccgttcactgagtcccgtcctgcctgccgcccatgggtctgcacctgcctcaggtgagcccagccactggccattgtgagcccagccactgtttgtggtggcatctgacactcccgtaaccacccccaactctcttccagacccctgcttcccagccccaagcccggccccagctgccacaccccccgaggccttcaagttcggaggcacatcactaccacctgtctccccagcttcctcgctgccaaccacaccactcgccaccacagatgaagttagtaaggaagatgtcatcttcttctgaggggccatggccccaagggcagacccctttctgtcctgataccctttatgtctctggggatcctatgggtgactgtactgtctggccgtccccttcccctgcacaagcacagccaggcacttgttcccttgagattgcccaaatggtatgccttgagtctcacagctcgctatagatttagtggcaaaacatgggtagcccccttgaacacacatacatacatgcatatatatgtatatgtgtgtgtgtatatatatatatattatatatatatgtatgtgtatatatgctcaaagttcttttaagttgaaggtggaaccccccagaggtataaagcccaagacttgggagccagccaggagacagagcagggcaggcaggtctgagaagataccggctccaggggcagactccataacccccaggaatctctgaattaaactgagtcattttgcaccagaaggcactagaatcacccagagtccagcgaatctccacttccaaagcagcaactggcactggccacagccttgaccagaaaatggcctgggcaactccagaggatacagaaagactcaggcagccccgggcaatccatggagcaatggactggatctgcgggttcagaaatcaatctgatgaggggttaccaactgtcactccttgcagtaggctggggtcttcccaactctgcttctcagggggcacctgccatgtccgcccatccaccttacctgggatgcagaaccccagtttcagcagggcagcacagaccgtgtttgatcgctgtgaaatgagcagatttttcctggtcctgtcagtgttctcacagaaaagcagagctaacacattcagggacatgtggaggaatagcctagtgacattgccggtgagtagccacagatggccatcttggtaccacctcagcctgtgcaggagtcgggacagcagctggtcttctggtctggtcttgttcctagacctgggcaggtctgagttccaggtctaccacatttagacctggctgaggtccagaatcatcccttagccaggtttccctgctataccctaccctgaagtactaacaacaggcaggaccaagtcctacgcttatggttcttagtctccagagcccatcgtcctaagaaaccactacaaagaccctgccctgtgatacttaggtagacagtaccttagatggtctgcagactgccaggccatccccacctctgtggaacagggaagtgtcagaggctgctggcatgagcaagagccctccagagccaagacctaagcactcatgagctcagggagcgactgtgggcgtagttaccaagaatccaaccgcgagctagtaagacaacagggtgctgaaagtggtggtctctgacgacttccgggtgccaggaatggagcagggtcccccttgtcctcatccctaggcctatggaccccagcacccgaatagctcttactcttgtccttctgtttctatcttgtgtccggagtgtgtctatatcttccagacctcattgtgccatgttgctaatcagtgttttgtggtttgttttgttggtttgggttttgttgttgttgttgttttgtttctgtttttgtactgagatgtatctgagcactttagaaaagctgacttttaagttcccactctgtgaagagaacattccagtacctaacaagagctgggtgggctcaccaccagacaccatgactttttggatttagaagttcaaatggtttccacttggccctgggaaggattcagtgtatcccccaccaggtggccaggtggttctcagctgtgtactgtaaacagtaggacagtgtcatcagttacctgtcaccagcagccatgggtcccttcctggcagatctcatttgtgaagatggtgagccagcagcattcaatctcccttgtcaatcgtgtccatgatcttcgcctacccctgattattttcacagcgatagcagagcatcctggcaacagggtattctggaaccacgctagaacttgtgaccagattctagcaataaaattatccagagcatctcaggctgaaacagaccttctttggggattgggaatgcagagcgtggagctgtgccctgccaaggtttttgttgataaggaacacaaatgtcgaaggtgagccagtgcagagtagatccgaggatgtggttcagtcagaagagcctcgctgagcatgcatgaggccccacatcctatttccagtttggcatggtggggcacagttgccatctcagcactcaggaggcagaggcaaaggatccgaggtgtaaggtggggctggggagatggctcagttcgtaaagtgcttgccatgcaagtgtgagggcctgagccaggttaaaagccagactgagcagcatacatctgtaatcccaacactcatacaagatgggaagcagagacaagagactggccagctagcataccgtacacaacagtaagcattgaagagaccctgtctcaagcacccaagtttgtcctctgaccttcacacacacacacacacacacacacacacactttagttatttacttttttattttatgtttaaggtctgggggctggagatgtggtggttcagtgttgaagagcactgggtactctttgacatggcctgggtttgtctcccatggtggctccaaatcatgttaactccagttctaggggacccaacctccataggcaccaggcatgcgtgaggtacatacacaagtaagtctttttctgaaaaataaaagtttagttgggtatggcggcacacacctttaatgccaccactcaggaggcagaggcagacagacctctatgagtttgaggccagccgaggctacatagggagtacatagggagaccatgtctcaaaaagaagtttcacgcgtccttgactacatagtaaattcaaggcaacctaaccaaataagaccttgtctcaaacacagaaaaataagctgtaatggggactggagctcaactgatggaggacttggctggtacacatgagatcttagaaccactgcacagctcgggtgggctgccttttctagaagtatctgtcctttggttccatgtctgcaccatacactgttcatgtcaaagtcttcctgtgcaaggcttggacctcaagctcagcctgtcttcctggcaccctgactaggtaaggcactcatctgagagcctcatgggctcagtctttaggtggggaacagataccaggactcctacctgatggtcttaagagttcgagcaggtgggaccaccagagataggagctgatcctggcctactcatgagctctgcacaggtgcccataagcaaaagggtggaatgctttgctggggtcctctaaccctccaccccagtgggtccagcatcccggtggcccacaaacacctatcttccacatttaaaaaaaaaaaaaaaaagtttcttggactttggccaacaccagaaggggagagggccagagggcattgtatcttgacagtagagcacacaagtcatccatccctagtagggagggggagaaagggaaagaaaagacattgctgtacttaggaaggagccttgcctgtgcagcaggactgtctcaagacaaacacaaaaggttggatcatataaagttcaagggccactgtctcctaggctgggctcagagtctcgcagacatgcttagctttcagatcaaaaacgatgcatgtgaacaggtgaaggccccatgagtactggcgcctgcagccaagcctaacaaaccaagctcaatctctaggacgtggatggtgagagccgtgacacacacgtgcacacacacacacacaaatgtaataaacactcaaactgcttaagaagaaaaggcacaatctaccatggtctctttgatagaggacacaaatccatctacacatcttcagagaggccgacaaccatggcctggccccagcttaaatgggaacactgcagcccttgaggtccctcatttaagggtggccttcctggaggcagtgaccaacagtttccctctgagaaccacaggaagtgcagagcgtgatcctagtcctgggctcagtgggcagaggtcagtcagattctgaggccagtaggctggggggtagaacagagatgagtggtttcccactcgtgttcagtgcacttgtgagagcaaaccttgtgacataggcccagaggagggaaggccagagtgagactgctctaatcacctcatgcacacactggcaccataccaagagattttaatagacattcctatattccagctttgccgaagcccgacctgaggcatgtgtctctcccactcacctttaggcaagccagcaggtaggaggctctagcagtgtcctcctgggactttgcaaaccttgcccttggctctgagagtcctgaagttctcatgtgcccccctcttcccaagaaagcagcttcccctgaaaccctggctggggcctgagaagatctcatttcagcccctttcccaccctgcccaggggccagcaccggagtacacacttatggatgcaccagtggccagtgattcccactctgggaatctgagtcctgttgagcaccacagtgtcctccacctgccacttcagggcctcatcaagggctgtctgcctcggcctgtctgccagccctgacagcttggcatgtgctgaggatggaggagatggtgcccatgagacccaccagccaaggagggaagcggccagcccacaggacacctcggggcaaccagtgcacagcatttgccaggtcagccaggttgctgagtagagttaaaacctctgagcatatccttgcctccatggccctccgcttgctcctgggcagctggctgtgggagagaaggagaaggaggagagccactcttgttgcctgcatttccatatcccccagaagaaaaaaaaaaaaaaaaaggcaagcacagaatggctcatggcctcaattccacaccttctcagaatccttgggcatggggcatagaaagtgtgactgttgtctaaacttcacatcacccacactactacattgtgatccagccacgatggctcagcctatctatagtccttattctaacacacctgtttccctgctggggaaaagcaagacttcccacccagaagctaaagcaatgctctgtgaaaacatacacacattatacacatcacacagagatactgcatgcatcacatacacatgctctcaagtactcctttagtagtgctctctccctgaacctaacagccatcagggctgctgactgctgacattccctcatatatggagaggtgaggaaggtcactggaccttcatcagacattttagctgcttccttctgacctcccagccctgctctatgcaatgctaccctgactgcatggaggtactgcgaagctatgagtaagttgtcacccacgctggagtgagactttccaatgataacagctgtttggaggtcacctacactcaggctctgtttggttccacaagttggaatttgattaagccatactttagtttgtcattggtgccttatgaggcatggcagacgtatctttccaactctccaggaagaaaaagttcctacatcagccctgcaagactcagcaggggtatggatcagagaggtgaccactctatacacctctcagggaaggttaggacaaggtaccttgcagaggtgcctgtggggctccgcagcttctgtctaagcttcagcattgtccacagggccctgcaacacaggagacagggatgctctgtcagagcagcgtgacaagctgggagagaggggccggtggacgggcggggtcagctccccacagcagttaaggcagccagagcctctatcaggggactctgagactggccactgtccgtatgtggtcagccgtggccctgcttgcagcctcctgcgtagtgaccagctgtgcctgggaagagagacttgtccctgtagggcaaaggctggggttttttctagttgactttaattgtcaaactgactgagcctagaatcattggagaggaaggccttgactaaggatcagattagcctgtgggcatatagggtgtgggggtcatgtcattttactagaaagcaaaggaagtctgagtgagcagagtcctgggtgaatatgtgtggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatgtcagggattccagtgacaaagcttcccaaaaggatgaggctcaagagagatggcaaaggtttcccagggggtctgagtaaaatgattgaccagtgtatgcagaaactggtgactgcagcttcctcctcccagatatttagtctgaagctgcttcctcctaagactagctgacaccccctctctctcctcccccgcccccccatactgcacacaataaactgaggttcctgggtacagcggcaatgggtgccacaccattacaatgcgcacaccctgcctgacctcagcttttctttccttttggaaagaaacagtcagtcagttggatggttttgttttcgagacaggatctcactatgtaaccttggcttcctatacagaccagagtccccacttctctgtacatgtacccaagtctctgtcacttgatgtcacaatcctttcctcattttcttcccctccctggtcagggttccagatccaagctatgcaggggatggtaccgataagtgagccatcaggcagggtttctctgtggttctctgccttgagttcctgccctgactccccttgcctcttcctgatcctctgttctgagttctgggatggcaggcatgtacaaccacatttggcttatgcaatttctgagggtggaaaccagggcctcatgcatgcggaaccacattcctatcccaggagagacccatcgcttaatctacatcccaatcccaccagcaagggttggtgtggacctgcctagtaatagacaggaggccataagcagaggcccagggtacattaaaagctcagcccaagtctccactctcaagtctctgagtgctgagagaccgtcaccagtgtgcacagggatgcagacagcaagcttcaggggaccctggaggtcagctgtggtcagcaagaaaaccacactcatgaaagcacatcagaatattggctaagcatgtcaaagaagcatacatccaaaggctggaaataaactggtagagccaggcatggtggcacagacctgttgtcccctcttcttgggagtctgaagcaggaggatctaaattcaaggcctgcctgggatacttcatgaagttccagctcaaaataataagtaaaatgaagagctgtcaagggggctcagagggtgaaggcattcgcggccaagcctggaaccctaagtttgatccactggatccacatggggaaaggaaagaaccagcacccacaaactgtctgacctctacatatgcaccatgcatgttacatgtgaacacacacagaagtaaataaatgaagtaaataaagggttttttaaaaataaaaaggctggggatataacccttaacagagagatcagtactgagggcaatcaacttagctaggttggtggtgaggcccagaccagtgagaaaagaaaaataaaaaataaagtcgggctgatggcgcacggctttaatcccagcactcgggaggcagaggcaggtggatttctgagttcgaggccagcctggtctacagagtgagttccaggacagccagggctacacagagaaaccctgtctcgaaaaaccaaaataaataaataaataaataaatacatagatagatagatagatagatagatagaggtggaaggccagcaagatggctcaactccagtaagctgtcctctgaaccccacttgtccactacggtacacacatgccccacatgccccacatgccacatgccacatgccccacatgcctcacatgcaaatgtttaaaagacattttaatcaaataataaaaaaaattaaacttagaggacaatgactgaggaatgccatctcaggttgacctctggcctccacatgctcatgtatgccctcacatgcatgcaggggtaagaaaagtgatggggagccagggagatggccccatggttaagaccattgcttacagcaattgggactttagttctgaccccaatgcacaatggcaggctgggcatggtcttgtacagtaatccaagtgctgagggttgaggagtggggacagaagggccactgaggcttgctggctgccaaactagccgaaaacacaaagtctgggttcaggccaagacatgccctcaacagaaaggtaacaagagttccacatcctcctctgccctgccctcaaaaggtgagggcacacacacatacacacacatacacacacacaccaccaccacatacacacacaaacacaatctataaactcatgtttaatgggactgaaggagggactcggtggctaggaccaagtgtactgctcttgcaggggtggattgggttcccagcatttatgttgggcagctcaccactgcgggtaaccaaccccacagatgccagcatcctcctttggcacaggcacacgcactcatatgcactaaaccatcaacacaataagaaatcaattctttctttaaaagctttcaaaaataaatgcatccattaagagagagtgatgacagagagagaggagtaaagaagctggagatcagaagcagagacacattcgaagacactgaggtgtcagctttggaggaggagcggggcacaagcagaaatgtgggctggctagatgaagacacacatggacacactgtggagcctgcagaaggtcctggccttgccccacctggactttacaccatggagctaatttcaagcttctggcctccagtactgtgaactaaatgacctgttgtttagatgatcccatttgtagccaacttttacagcagttaccttaccagaaacaaaacagagggataaacattgggggggggggctgcagagatggctcagcagctgagagcactggctgctcttgcagagtacctgattttggttcccagcacccacacagcagctcacaactgtaactccagttccagggatatgacatcctcttctggcttctcatggggcactgcacacacagggtgcacagacatacatgcagacaaaacattcaaacacagagttaaaaataataaatataaggaaagagattctaatacgtgaagggtggccaacttttgggcctctgctgaggtaacagccattggggacttcaggtggcccctctggcagatatcacttacttgacagctccaagaagtagagagagagtccagagggctgtgttcagtgtccaccaccaagcagagtccacccggaggaccttggcatcggcagcccaggcgatatgctcacaaggatagtacagttggtcagtcacattactcaggacagacagccatcggatgaagatgtcctcctcctataaaatcaaggggtggggacaggcctgcaagtcagacctccccactacccatctaggatggtcccattctgaccccacaagcctcccccatgaccacagtctgtgttctggtgcctgggcagtacagcctactgctaacagctgtgcaagaaaagagctaggcctggcttcctctcctcatgctcactggacagctcactggccctcaacttaagcaacggaatctcctcaagagctgtcaaaaccctaagtcacaaacattgcaggaggacagggctagacaccaaagtttgttgttgctgttacttaatttttacttacttctttgtgcctgtagcacacatataaacacgcccatatgtacgc

SEQ ID NO: 146 - DNA, 3064 bp, Mus musculus
ggagactgcgagagcgacccgggagccagcagggcggagagcggcctgtgagggaccccgcggagcctccctgaaggagcaccctcggaccacacttctgtctgatggcagcagcccagctccttccaggaatgtcggcatgaccatctctcagaaagggggtctccagccaacaccgagcccagctggatctggggtgcgacttggaccaattgctggagacatggatgaagctgactccgtgtttttaaagttgaagcagacggcagacgactctctgtcactcacatcctcgaatgctgagtctgttttcatagaagacccttacattgcttcactgaggtgtgagatcgaatcagatgcacatgagtttgaggccgagtcctggagcctctctgtggatttagcatatgccaagaaacagaagaaggaggtggtaaagagacaggacgtcctatatgagctgatgcagacagaggctcatcacgtgcgcacactaaagatcatgctgaaagtatactccagagccctgcaggaagagctgcaattcagtggccaggcagtcagccgtctgtttccgtgcgctgatgacttactggacatgcacagccatttccttgcccgccttaaggagcgccggcaggagttcctagaggagggcagtgatcggaattacgtcatccaaaagatcggagacgtcctggttcagcagttctcaggagaaaccggggagagaatgaaggagaaatacgctgtgttctgtagtggccacaatgatgcagtcggtcagtacaagctattgctgcagcaaagcaagaagtttcaaaacttaatcaagaaaattggcaacttttccattgtgcgaaggctgggagtgcaggagtgcatccttctggtcacacagcgcataaccaagtacccggtgcttgtggaacgcatcatccagaacacagaagctggcactgaggactacaaggacctgagccaagccctgagcctcatcaaagacatcatctcacaagtggacgccaaagtcagtgagtatgagaaggaccagcgcctcaaggagattgcagccaagacggaccagaagtcgtctggcaaactcaaaaacgggctaaccttccgaaaggaggacatgctgcagcagcgccagctccaccttggaaggcgccctctgctggaagtccacctcagggcgcctgaaagctgtccccagccccttggacatgtgagcactaagatactccctggtgtgctgttctctgcagatgtcctcgctgtcctgctgaccgatgtgcttttgctgctgcaagaaaaagatcagaaatatgtctttgcttctgtggactcaaagccacccgtcatctctctgcaaaagctcatcgtgagagaggtagccaacgaggagaaggccatgttcctgatcagcgcctccatgcaggggccagagatgtatgagatgtacaccagctccaaagaggacaggaacatctggatggcccacatccgccgggccgtggagagctgtcctgacgaggaggaggacgttttcagtgaggctgaggagaaaaagatagctgaagcccgcaccatgaaactccaggaatttcaagagcgactgagcctgaaagaccagctgattgcccagagccttctggagaaacagcagatctacctggagatggctcagctgagtgggctggaagagtcagcccagaaccgaggcctcttccgaggaggaggagacccctctgagaccctgcggggggagcagattctcagatcggccatgagtgagattgagggcatccagagcctgatctgccagcggcacctgggcagcaccagtagccaagtggaggagggaagtgtctctgcaggcctgcctcggcgggctgagaccttcgggggctatgacagtgtgggaagccctagcaagggtggcagctttaaaaggaaggtatccaacagtgacctcaggccccaagactggcagggacctgctagcagcccagactccaggccctgtgacaacagcgcccccagtggctgctgtgaggaatcgccacaggctgcggtcatcgctcaacaggatagctatgtggagatgcaaagaacggccatccaggagcgcgagaagcagttccggctgcagtcaacacgtgggaacctgctgctggagcaagagcggcaacgcaactttgagaagcagcgtgaggagcgcgccggtgtggagaagctgcaaagccaacttcgccaggagcagcagcgatgggagcgggagcgggcacgccagcagcaggaactggagctggccggtgcgcgactgcaggagcgagagggcgaggcacgccagatgcgccagcggctggaccaggagcgcaccgagctagagcgacagcgccaggcctaccagcatgacctggagcgtctgcgtgaggcccagcgagcagtggaccgtgaacgtgagcgcctggagctgctgcgcaggttcaagaaacagaacactgtaccaggggcactgcccccggaggtgctggcagaggtacctgacaacgtagagcgacccgaggtggcccgctgggacagtgccccccctgagagccggccagccaagagcgatgtgcccatccagctactcagtgccaccaatcagattcagaggcagacagccgtgcaacagcagatccccaccaagctggccgcctccaccaagggtggcaaggagaagggcagcaagagcaggggttcccagcgttgggagagctcagcgtccttcgacctgaagcagcagctgctcctcagcaagttcataggcaaggatgagagtgcatcacggaaccgccgttcactgagtcccgtcctgcctgccgcccatgggtctgcacctgcctcagacccctgcttcccagccccaagcccggccccagctgccacaccccccgaggccttcaagttcggaggcacatcactaccacctgtctccccagcttcctcgctgccaaccacaccactcgccaccacagatgaagttagtaaggaagatgtcatcttcttctga

SEQ ID NO: 147 - protein, 1020 aa, Mus musculus
ETARATREPAGRRAACEGPRGASLKEHPRTTLLSDGSSPAPSRNVGMTISQKGGLQPTPSPAGSGVRLGPIAGDMDEADSVFLKLKQTADDSLSLTSSNAESVFIEDPYIASLRCEIESDAHEFEAESWSLSVDLAYAKKQKKEVVKRQDVLYELMQTEAHHVRTLKIMLKVYSRALQEELQFSGQAVSRLFPCADDLLDMHSHFLARLKERRQEFLEEGSDRNYVIQKIGDVLVQQFSGETGERMKEKYAVFCSGHNDAVGQYKLLLQQSKKFQNLIKKIGNFSIVRRLGVQECILLVTQRITKYPVLVERIIQNTEAGTEDYKDLSQALSLIKDIISQVDAKVSEYEKDQRLKEIAAKTDQKSSGKLKNGLTFRKEDMLQQRQLHLGRRPLLEVHLRAPESCPQPLGHVSTKILPGVLFSADVLAVLLTDVLLLLQEKDQKYVFASVDSKPPVISLQKLIVREVANEEKAMFLISASMQGPEMYEMYTSSKEDRNIWMAHIRRAVESCPDEEEDVFSEAEEKKIAEARTMKLQEFQERLSLKDQLIAQSLLEKQQIYLEMAQLSGLEESAQNRGLFRGGGDPSETLRGEQILRSAMSEIEGIQSLICQRHLGSTSSQVEEGSVSAGLPRRAETFGGYDSVGSPSKGGSFKRKVSNSDLRPQDWQGPASSPDSRPCDNSAPSGCCEESPQAAVIAQQDSYVEMQRTAIQEREKQFRLQSTRGNLLLEQERQRNFEKQREERAGVEKLQSQLRQEQQRWERERARQQQELELAGARLQEREGEARQMRQRLDQERTELERQRQAYQHDLERLREAQRAVDRERERLELLRRFKKQNTVPGALPPEVLAEVPDNVERPEVARWDSAPPESRPAKSDVPIQLLSATNQIQRQTAVQQQIPTKLAASTKGGKEKGSKSRGSQRWESSASFDLKQQLLLSKFIGKDESASRNRRSLSPVLPAAHGSAPASDPCFPAPSPAPAATPPEAFKFGGTSLPPVSPASSLPTTPLATTDEVSKEDVIFF

SEQ ID NO: 148 - DNA, 174448 bp, Homo sapiens
  misc_feature (1)...(174448): n = A,T,C or G
cctgacctcaagtgatctgcccgcctgggcctcctgaagtgctgggattacaggcgtgagccaccgtgtccggccttggttttttttagaaatagtgtctcactctgtcacccaggctggagtgcagtggtgcagtcatagctcactgcagcctcaacctcttgggctcaagcaattctcctgcctaagcctcctgagtagccgggagcacagacgcgcctcaccacgcctggctatgttttgtatttttagtagaggtagggttttgccagttgcccaggctggtcttgaactcccggactcaagcagtccacccgcctatgcctcccaatatgttgggattacaggcatgaccactgcacccggccaacatctctgcagttctttgttttagtactttgtcctttagctctggtggtagcttatcacagttatttaggtgcgtctttcctttacttgctgtaagagtgcaaccttatttgtcttgagagtccccctgggcctggcacaatgtctggcccaccgagatgcccagcaaacgtttgctgagtgaatacaggaatgatttccatgtagctgacttgccgggtccagaacctgcatttgatccagacgcctccattccttctcgcagaggtagatttgaaagctattcttgcaggcaggtggagaatcttaaggatctctgacaccccagtgtgtccaagctctaatttctggaggtaataaatctgggaatggattccatctggctcagatgggagacagaacaggtatacacagccagagaccccagttctcatctcttctttgtaggtttcattatgctgttgtcatcatttaaaggaaactgaggccaggcacggtggctcacacctgtaatcccagcactttgggaggtctagacgggtggatcacctgaggtcacgagtttgagactagcctggccaacttggcaaaaccctgtctctactaaaaatacaaaaattagctgtgcgtggtggcgggcgcctgtaatctcagctactcaaaaggctgaggcaggagaatcgcttgaacccgggagatggaggttgcagtgattcgagatcacgctactgcactccagcctgggagacagagtgagactccgtctcaaaaataaaaataaataaatgaataaataaataaaaaggaaactaaggcgtgcagaggggttgaagatgttgtccaggatcacacagttgacaggtggcagagctgggttgggaagccagattcgttagatttctagtgtgccccaaaactggtataggtggtggcctgacaccagaacccaagacttgttgaggcaggacctcctgaatttaagaggaagcagtttgaggactggaaagaatgtggaaagggacgtgtgggccccagaataggtcagcagggagcattttaagaatgctgttactggccgggcttgatggctcacacccatactcccagcacactgggaggccgacgcaggactgcttgagcccaggatattgagaccagcctgggcaacatggtgaaaccccatctctacaaaaaatacaaaaattagccaggcatggtggtacgcagctgtagtcccagctacttgggaggctgaggcaggaggatcacttgagcccaggaatttgaggctgcagtgagctatgattgcaccactgcactccagcctgggcaacatagcaagactctgtctcaaaaaaaaaatcctgtaactgaagaacaaggacctttatgattgaaaacaggaagtagaaaactcttagcattgtaaaggatttcagaatcttctagaaagttctttctctgccctgctcccaacccatctcccctgctgttttcatgatggagagaaaatcagggaagaaaggaacacttcctaagatggctctcatgtccgccttctctccttctggaaaattctcagattcaggaccagcacggtccaatacagctctgctttgatggaaatactctgtatctgctctgtccaatatggcagccaccatccacgggtggctcttgagccctggaagttgtggctggtaagactgaattctttttttttttttttgagatggagtctcgctctgtcatccaggctggagtgtaatggcacaatctcggctcactgcaacctctgcctcccaggttcaagcgattctcctgcctcagcctccctagtagctgggattacaggcatgcgccactcccccaccccgctaagttttgtattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaatgcaggggaaggaaaagattatatggagtataggcacacggccagacatttgacagactgtaatatcagattcctactcatacgttttggcaaattatattcacagagaattcagatttagaagcttttcaaaaagaatctggaggccaggtgtggtggctcacgcttgtaatcccagcactttgggaggccgaggtgggtggatcacctgaggtcaggggttcgagaccagcctggccaacatggtgaaaccctgtctctactaaaaatacaaaaattagccaagcgtggtggcacgcgcctgtaatcccagcactttgggaggccaaggcaggtggatcacctgaggtcaggagttcgagaccagcctggccaacatggtgaaaccttgtctctactaaaaatacaaaattatctggatgtggtagtgcatgcctgtaataccaactactcgggaggctgaggcaggagaatcacttgaacccaggcggcagaggttgcagtgagccgagatcatgtcattgcattccagcctgggcaacagagtgaaactccctctctgaccaaaaaaaaaaaaagtgctgtctaacaccaccagctcaccctcgaattctttcctgggtgaagccaaaaaccctcccggggtaaggctcaattttggggcttgcctcttctacatcaaacctacattttcgatgatactctttataaaatctacatagacaaatcaattttttttttttttttttgagacacagtctcactctgttgcccaggctggagtgcagtggcctgatcttggctcactgcaagctccgcctcctgggttcacgccattctcctgcctcagcctcccgagtgtagctgggactacaggcacctgccaccatgcccagctattttttttttgtatttttagtagagacggggtttcacatggttagccaggatggtcttgatctcctgacctcgtgatccacccgactcggcctcccaaagtgctgggattacaggcgtgagccaccacgcctgggcgacaaatcaattatttttaaagaaaaatgagcctccgtttcgagatgggctgccagggtaaagcacacaccacatctcgtaggcgtcatgggaaaaaaatcctgcagaccagggatccccaacccttaggccacagaccagtagcagtccatgtcctgttaggagctgggctgcacagtagaggtgagcagagggcaggtgagcattgccgcctgagctccgcctcgtgtcagaacaatggcagcattagattctgataggagctcgaatcctgtcgtgaactgtgcatacaagggatctaggttgcctgctccttatgagaatctaactgatgcctgaggatctgaggtggaacagtttcattctaaaaccatcaccacccatcccgtgttcgtggaaaaattgtcttctaccattggtccctggtgccaaaaaggttggggaccactgctgtggactatctcattaatcattttttttttaggattgattatatgtgggaattatttatttatttatttattttgagatggagtctcgctttgttacttaggctggagtgcgacgggatgatctcagttcactgcaacttccatctcctgggttcaagcgattctcctgcctcagcctcctgagtagctgggattacaggtgtgagccatggtacctggcccattcggcatattttagtacggagatggtggtcaggcacggtggctcacgcctgtaatcccagcactttgggaggccgaggtgggcggatcacctgaggtcagagttcgagaccagcctggccaacatgatgaaatcccatctctactaaaaatacaaaattagccaggtgtggtggcacacgcctgtaatcccagctactcgggaggctgaggcaggagaattgcttgaaccccagaagtggagtttgcagcaagccaagatcatgccactgcactccagcctgggcaacagagtaagactcaagtctcaattaaagaaaaaaaaaaaaagaaaaaagaaaatattagctgtcacttagcaccttcttcctcattgcctttttctacctgtacaaagagtggccattaaccaggtacccattatgaagaacttgaagcatccttcacgcccactcagagatgttaaaagccagcagaagtcctcgtgtctatttctgccttcatttctaacatcctctgggtattttctgtcccagtggtaaactgctctattgtctttcactaatagggacacatacggctttaatgaattaagagttagattcataggatatttaaaaagaaaagcaattcttgattgttccctacaattatagctgtttaatctttactcataacaactttagtgagacagaattcacatgacatacaattcacccattttaagtgtgcagttaggtggttttgaggacatttacagttgtgcaactgtgaccacagtcagttttagaatatttgcatcatcttcaaagaaaccctgtaccctctagctactactttccatcccccatttccctagctcttggcagccacgaatctattttctgtctctatggatttgcctctttcggatttttttgtatgaatggagtcagacaacatgtggccttctctgtttgacttcttttatggagaaggttcatacctgtaatcccagcactttgggaggccaagactggaggatcgcttgagttcaggagtttgagagcatcctgggcaacatagagagaccactatctctacaaaacaaatttaaattagctgggcatggtggtgcatgtctgtggttccagctatactggaggcataattttgttttgtttttgtttgtttgtttgtttttgtttttgtttcgtggggtttttttggttttgttttttgttttttgagatggagttttgctctgtcacccaggctggagtgcaaaggcacgatctcagctcactgcaacgtccgcctcctaggttcaagccattctcctgcctcagcctccgtagcagctgggattacaggcatgcgccaccccgcccagctaatttttgtatttttagtagagacagggtttcaccacgttggccaagctggtctccaactcccgacctcaggtgatccacctgcctcagcctcccaaagcgctgggattaaaggagtgagccactgtggctggccttttatttacatttatttatttatttatttagagacggagtctcactctttcatcaggctggagtgcagtggtgcaatcttggctcactgaaacctccaactctctggttcaagtgactcttctgccttagcttcccaagtagctgggactacaggcactcgccaccatgcccagctaattttttttgtatgtttagtagagatggggtttcaccatgttggccaggatggtctcaatctcctgacctcgtgatccgcccacctcggcctcccgcagtgctgggattacaggcgtgagccactgcggccagcctgtatttacttttgagacaagatattgctctgttgcccaggctggagtgcaggggtacaaacacagatcactgcagtcctgacctcctaggctcaagcgatcctcctgcctcagtctcccgtgtagctgggaccagagacacacaccagcattcctagctaatgttttaaatttttatagagatggagactcgctatgttgcccaggttggtcttgaactcttgggtttaagcaatccttccgtctctacctcccaaagtgctgggattacaggcgtgagccactgcactcagcctcagctattatgaataatgctgctatagacatttgtgtacacgtctttgtgtggacgtatagtatcatttctcttaggtagttacctaggagtggaattgccaggtcatatggcaattcttggtttaatattttgaggaactaccagagtgttttccacagtggctgcactgttttacatccccatcaggaatgcaaaaggataccagtttctctacattttattttttctttgagatggagtctcgctctgtcgcccaggctggagtgcagtgatcttggctcactgcaacctccacctcccaggttcaagtgattctcctgcctcagactcccaagtgtctggaactacatgcgcctgccaccacgcccagctagttgttttttgtatttttagtagagacggggtttctccgtgttggccaggctggtcttgaactcctgacctcaggtgatctgcctatcttggcttcccaaagaactgggattacaagtgtgagccacggtgcccggcccatttctttacattctttgcacttgtaattgtcactctttttggttttagctatcctagtggggataaagtggtatctcactgtggtttgaatttgtatttctctaatgtccaacagccagttaatctttcctttttttctgttttttttttgagacagagtcttgctccatcgcccaggctggagtgcagtggtgtgatctcggctcactgcaagctccgcctcccgggttcatgccattctcctgcctcggcctcccaaatagttgccactacgggtgcccgccaccacgcctggctaatttttttgtattttttagtagagacggagtttcaccgtgttaaccaggatggttttgatctcctgacctcgtgatcagcccatcttggcctcccaaagtgctgggattacagccatgagctggccaccacgcccagccgttgtgtttttttaatcgagacgaggtctcactctgttgcccaagctggagtgcagtggtgtgatcacagctcactgtaacctcctattcctggacccaagtgatcctcctgtctcagcctcccaagtagctggaattacaaccacatgccaccatgcctggatatttaattattattattattttttagagttggggtcttgctatgttgcccaggctgactttaaactcctggcttcaatcgatcctctcactgtggcctcccaaactgctgggattacaggcatgagccactgtgcccagccctagttaacctttgaatgcatattcatgtctgattttggttctgccatagcctggggaggatggcggccaagtgttctttctacctgcagtgtgtgtgtgtgtgtgtgtgtgtgtgtgtgtgtgtgagagagagagagagagagagagagaaatgaaatatagtgtgggactcagggttgagaagcccagggctatggccaaatctaagattaggatgccggccaggcatggtggtttatgcccgtaatcccagcaatttgggaggctgaggcgggtggatcacgaggtcaggagatcaggatcatcctggtcaacatggtgaaatcccgtctctactaaaaatacaaaaattagctgggcgtggtgttggacacttcttgggaggctgaagcaggaaaatcacttgaacccaggaggtggaggttgcagtgagccaagatcacggcactgcacttcagcctgggcaacagaacgagactccacatcaaaacaacaacaacaaaaaccccacaagaatttcatagaaacaatgagtaattttttttagggtaagttatgtcccaaacattacatgggatatacttatcctcaaaaaggtattattgcttatctgaaattcaaattcaactaggcattctgcatttttctttgctaagtctggcaaccctgccagtcactggtgagttgtgtgtccttgagtgatggtctttgcctcttggagcttcagttttctcatctatgggatggggacagaacttgctgggaggcaccaatggcacgcggggttctttgacatctctggatgtggaagctgttgatgtgactgactgggagcctcagactggggttgggtccctgactaggaggggtgggggggctgggactggcatccttgtcctcttgaagctgcctcccagcctgagcttggtccctgcagggttcctgcttggttcagaccccaggcagccagtgttgaggggagggtggagattaatccatagttgtgtactggggctttcctccaacttcctagcaagcaagtgtgtgtgtgtgtgtgtgtgtgtgtgtgtgtgtgtgtgttttctcgacttagcctaatccatttgctgcatggaatgtgatccaggatcactgctactttttttttcccatttgtttgcttttgctgtgttttgtcgttgttattgttttttctaatttgtgcttcttttgtgggtaattctcagggtggattttttttttttttagaggatttactattcttctttagaacaatctgttttcctcaaagatattggtggaaggtttagtgttttggaacaaaataagcaggggttgtatactgagccttatattctaggtgctgaggactgtggtgtgtgtgttggggaggcggtgtgtgtgtgtgtgtgtgtgtgggtgtgtgggtgtgttggcagagagaagccatctaaagacttcaattttgaaaaacgttaactcaggtgtaagggacacaaggaggagaaacacgcaaataggtgtgccaaggaaaggaaatcagggacggctgcctggaggaggaggcagcatttgaactggatatcttgaagcatgatgggctggatttagaaatagggagctaaggtacaaagcacttcgccagccaaaagatagactagcctagagatgactgttatatgtttgggggaataaacaacagcaagaagaacaacaacaacaaacaacaaaatagctgacattagtgcagcacttactatgtctcaggcactgtttgagtgcttgccctgagttgtttcacttcttcttccatataagccatgttacagaggaggataggagtcttggagttgtgcaagagttgtgggcaggcctgtttagtggtgtgcaggggatgtaggggcagaatcttgagggaagtgcaggatgatggggagccatggtgggcgttggggcctgggagggaccgccttcaggagaatgagaactcagggcatttgggcaatggagatcgggctccctgggaagccctcaccacacccaggtaaaaggtaattaggtcttgattgcaggtcaggagagcagtccgggaaggaaagtcagccagcgaggtgggaggattgacaaaacaaatacatttagctttccttgccccatttctgaccgcgggcacctttatccccgtaaattatctcctgaagatcttctatgttgacgcactggagacagttcccctttctccttctgcacctgccgcgttactcaatcccctgtaatcccattgtcccgactgcatcatttcagaggtggtgattttaaggattttaacagggcttgccaaaagaattattttcttggcgttttgaaagtaattacttaggcatgggtactttacagagaaagctactcatcccggctggctgcagagtttacagggcccgggatgaaaacacagggcccaggtttcctgtccatgaagccggctctgcccctgatccttctgatgcatccaccgtgcgtctgctcacctgtcttgctttctgttcattttctcttgtagtgtgtcccggcatggatatccggaacaacctcactaggttgcatgagctggagaattgctctgtcatcgaaggacacttgcagatactcttgatgttcaaaacgaggcccgaagatttccgagacctcagtttccccaaactcatcatgatcactgattacttgctgctcttccgggtctatgggctcgagagcctgaaggacctgttccccaacctcacggtcatccggggatcacgactgttctttaactacgcgctggtcatcttcgagatggttcacctcaaggaactcggcctctacaacctgatgaacatcacccggggttctgtccgcatcgagaagaacaatgagctctgttacttggccactatcgactggtcccgtatcctggattccgtggaggataattacatcgtgttgaacaaagatgacaacgaggagtgtggagacatctgtccgggtaccgcgaagggcaagaccaactgccccgccaccgtcatcaacgggcagtttgtcgaacgatgttggactcatagtcactgccagaaaggtacgccggggatacagggttctaagcagtgtctcgtgccttgttctagaaagcttaaaatgttttatggcttaaaaatgttaaatggtcattaggtaggggccggggaatagtgggtggtggcattcactagcccagggagtggcagacattttctgtaaagactcagatagtagatacttcagattttgcaggccatatggtctctgatgcaacgactcaattctgccactgtattggacaagcagccacaggcatgcataaatgtatgactgtggctgtgtttcaataaaactttatttacaaaaacaagtcgtgggccggattttgctcgagggcagcagtttgccaccgcctgtgctagtcagtgaatgttcttcttgcttgggagaggaaaaggagtggaaaactgtagattcggtttttttaaaaaaatagtttagttcttatctgattatagaagtgatattgcttataatagacatttggaaaaagacacttgtaaacgaaaaaaaagcaaaacattcatcttattccacaacgcatgtcgccgagagtagtttattgggggttgttccttctagtgatcttcaggaatctgtcgtgtctactgaaggtttccttaaccattcctgttattgggcattaagatgatttccaggccgggcacggtggctcaggcctgtaatcccagcacttggggaggctgaggcgggtggaccacttgaggtcaggagttcgagaccaacctgaccaacacggtgaaaccccatctctactaaaaatacaaaattagccgggcgtggcggtgcacgcctgtagtcccagctacttgggaggctgaggcaggagaatcacttgaacccgggaggcggaggttgcagtgagccgagattgtgccattgcactccaccctgggcaaccagagggaaactccttctcaaaaaaaaaaaaaaaaaaagataatttctagttttcacaaagagagtgatgaacattttagagtcaaagctttatctagcagttgtttctttaggcttgctttccagaagtgcaatttctgggtcagaggctcttggtgcagattgacaaatggtgttccggaaatgttgtgccaacggccactcctcctagctttggaggagagggaacaccttggccagctttgagtgttatttgaaaaatctttcataatttactgcgggagggaggagctgacgtgttgtcattgtttctatttgcatttctttgattgctatcggggttgaaccttttaaaacatgtttatttatcatttgagttttctcttcctgttcatatcctttgcccatttgtcttttagtacctcagtagcttttgcaaaattaatctgtatgtggttttcatcagtgaaggctactaaccctttgccaattgcattttgttgtttttgttgttcagtggtttaaatgctctgggaagtgttttgctggagaagcttaaaatgtttatggagttcagagctggatttcagtgtgccacttctgtactttacacttagaaagtcttcttctacccatgaaaggttttttttctctacattttatattttaattttttttttttttttgagatggagtttcactcttgttgttaagactggagtgcgatggtgcaatctcggctcactgcaacctctgcctcccgggttcaagcggttctcctgccccagcctcccaagtagctgggattacaggcacccaccaccaagcccagctaatttttgtattgttagtagagacgagatttcactacgttgaccaggctggtctcgaactctcaggtgatccacccacctcggcctcccaaagtgttgggattacaggcgtgagccaccgcgcccagcctatattttaattattattatctaaaaaaattcatcctcactacttgagatctgtttgtgtgtgtgactcaacgggcgtttcgtttctctcccaaatagctaactgggggcctcagacagctgttgattatagaaatctacctctttgccattgctttggggtctgtttctggtgtgtccatagatctgcctctccatgccacagagcggtgactgttctgatcatggtagtgactgttctgatcatggtagttttatcatgttttcatgctcaaggaggcaattccacattcacacattacttgtttgttgtttcatggacttcttttcacatttccctgggaagaactagggaacatgcgatggaggtgggaagaagttaagtgggtggcttgagggttgtatcacaaaagatagaagggaggggagaaaggaggatcttcttatctgagcccaacgctctggggaagccacccagagtgagtgagtccttaaatagacctaaatagaatccttggaattgtctgtgaggactcccttggagcccccagcatgagtccttccatgggacatgttggatggttggaaatcgggagtgggatagttgaaaaaggaagatgggttagtgaagggtggtgggagaggggaccgttattattgcactgtggaaaaatcctgagaatattgtaggtcaggggcaaggagaagctaaactatgaccagagaggttacttaacttgcccagagccacacagctaataaaagacagaactggggtttgtgccaaatttatgcaagacatacaccagaataaaagctatgattttttggaggagtgggaaggatgtcctctctgtttagaaacaagtgagctgcttctagctgggacaccaggggaaacagtgaacattcttttattctattactgagttttccaaatgtagtgcttgtttgaaaagctctaggcctacctatcttgagatataatttaagacattcctctatgaatttatttttgtatctgttttagacaaaatatccagaatggtgttatctgcaattgagtctcctgctccctgctgggtgttcagttgttgttgctgttgtttgtttgtttgtttgtttttgagacagagtctcgttctgtcacccaggctggagtacagtggcacaatctcggctcactgcaacctccacctcctaggttcaagcaattttcctgcctcagcctcccaagtagctgggattacaggtgtcaccacatccggctacttttttttttttttttttgagatggagtttcgcttttgttgcccaggctggagtgcaatggcatgatcttggctcaccgcaatttctgcctcctggcttcaagcgattctcctgcctcagcctcccgagtagctaggattacaggcatgcgccaccacacccagctaattttgtatttttagtagagatgggatttctccatgttggccaggctggtctcgaactcccgacctcaggtgatctgcccgccttggcctcccaaagtgctgggattacaggggtgagccaccgtgcctggccaacacctagctaagttttgtgtatgttgtagagacagggtttggccatgttggtcaggctggtctcaaatttctgagctcaagcacctcggcttcccaaagtgctgggattacatgcatcggccactgtgcctggctgtgcctggctgtgcctgatgttttgagtgaattaaaaattgctttgctattaagaaccaggcttttgtgtccaggaggtcgaagctgcactgagccctgttcatgccactgagctccagcctgggtgacaaactgagactctatctcaaaaacaaaagaaaacaaaaacaaaaatgaacacaaaacaaaacaataaaaagaaccgggcttgtttttccagtactgggggttttgttacccggagaaggtgcgactaacacttcccggggtaccgggttcctggcatgtggtatatatctcagccatccattagtagcagtatccccagggggccaaaaaatgattgttttttgaactgttgcccctgtctttgagagcaactcagcttcagctttctttcccctcttcaatttcttgtattgtgataaaatacacatagaataaatttttcatcttaactttttttttttttgagatggagtcttgctctgccacctaggctggggggcagtggtgtgatctcagctcactgcaacctccgcctcctggattcaaatgattctcctgcctcagccttccgagtgactgggacttataggcaccagccaccatgcccggctaagttttgtattttcaggacagagggggctttgccatgttggccaggatggtctcaaacccctggcctcgagcaatacacccacctcagcctcgcaaagtgctgggattacaggtgagtgccaccgcgcctggccccatcttaaccattttaagtccacagttttcagtggcattaagcacgttcacgtggttttgcaaccatcaccaccaccatctcccaaactttctcatcctcccaaactgaaactctgtccccatgaaacactcactccaccatctccctctcccagccccctggcacctaccatcctattttctgtctctatgaatgtgatgactgtagggacctcctgtgagtggaatcagacgggatttatccttttgtgcctggcttatttcactgagcgtgttgtcctcaaggttcatccacgtggtagcctgtgtcggaaattctttcctttttaaggctgaatcatgttccattgtatggagggagcacattttgcctgtgtattcatccatctacgggcacttggtcgctttcacatttctgccattgtgaatcagggccactgctgttgacgcatctagcttttcaatgcctgcattaaccttgttgctgaggctttaggaaacttatttatttatttattttttgagacggagttttgctctcgtcgcccaggctggattgcaatggtgcgatctcagctcactgcaacctctgcctcccgggttcaagcgattctcctgcctcagcctcccgcgtggctcggattacgggcacctgccaccacgcccagttaatgttttggatttttagtagagatggggtttcaccatgttggccaggctggtcttgaactcctgacctcagataatccactggcctcggcctcccaaagtgctgggattacaggcgtgagctaccgcgcccagccttaggaggcttatttgatgtctgatgggatttttgaatacagaatagattgagccttcagaggatactcccctgtcttaggtgacagaaatgggctggagaaaactatccatcaacccctcttttcccccagagtcttttcagatacttctgtgaacatccgtagttgctatttttgtcttccacacttggcagcttctggaagcatcaggggaatgcatcaacatttaggatgaaggtgctggtttgtcctttggacctagtttaagcaattccgagcaacatccaccccttcttctacctgtcccttaagcactttttacagggagaccaaaaaaaggctttcaatggttaagggggccgggtgtggaggccccacacctgtaatcccagcactttgggaggccgaggtaggtggatcgcttgaggtcaggagttcgagaccagcctggctaacatagcaaaacgctgtctctactaaaaatatgaaaattagccaggcgtggtggtgggcgcctgtaatcccagctacttaggaggctgaggcaggagaatcactcgaacccgagaggcagaggttgcagtgagctgagatcgtgccattgcaccccagcctggccgacagagtgaaactccattttttaaaaaaagaaaaaaaaatggttaggggaattaaaagaaaaacaaaaaaacatggcatgtgctaatgatccatagcctggacaccctctctccattatcctgcaatggatttggggcaaagataccaggagaggtccaatgcacgaagccttacatgggaagagtggagacggggtctatgcagttcgtttattgactgcctactaggtgtcatgttctggggcgctcagggcataggaagggagccagcctttgcctcctcagagcggccagtctagtggcaaatgcagatgttcacgatcaaaccaagtacactcagaagagggggagagttagagggagatctacattagttcagccagctggacgcggtggctcatgcttgtaatgccagcactttgggaggccgaggagggcagactgcttgagctcaggagttcgagaccagcctgggcaacatggagaaaccccgtctcgacaaaaaatacaaaaattagccaggcatggtggcaggtgcctgtaaccccagctacttggaaggctgaggtgggaggatcgcatgggccccgggggcggaggtcgcagtgagctgagatcacaccactgcactccagcctgggcgacagagtgagactcggtgagactctgtctttaaaaaaaaaaaaaagaagttctttgaggcaagcagcaccggcttccagtctcgttttaccattgactggtcacaagctggttcaagcctcagtttctccatctgaaaaatgggggtcattatgggacctgcttcttagggtggtggtgtgggggttgaatgagatggtgcagggggaggcacttaacctagcctcaggtgctccgtgagtgtcctggaagcttccagtaagtaagcaccatgggcccaccctatctgggcagactagcttccaggtgaatatctaccagggctcagcctcatttctgactttggttttgaggcaggcagaggaacatgtatcttgcgacctgctgatgagggatgggtgccacacctccagccccagagggaagaccaccctgatttttgggtgccaacagcatgggatgctctggaaattctcagctctgggcattttgaggggaccagaagccacagggcttgcctgaccagctgctttagccaaacccactggcattttctttctgggaggtcaccccagctgctcactgccggccagaggggtgggtgaggccgggacatgctgggtgccaggggaaaccaacccgagatgccacatatggacgtcggcaccaaagcaggagggggaggctgaaagcagcaaatccctcctccctgggtctgagattacagctccgagtcaaagtctctcaaagtgtggtattgtgcctaccacattaaatatcacgtatttaaatgcacgagtttaaatgcatgctcttggagggtttgatttttggcagaatttttagctgcctatggaaactctctgcttctttttcttcttccatttaaaaagtttgccttgatattttatttttttacatttttatttagtttttaatatttttttaaattgagatgggagtcttgctatgtggctcaggtcggtctcaaactcctggactctaaggaatccccccacctcagcctctcaaagtgctgagatttcacatgtgagccaccacgctggacttgacttgattttgttttctttttcttttttttttttttgagacagagtctcgctctgttgtccaggctggagtgcagtggcatgatctgagctcactgcaacctccgcctcctgggttcaagcgattcttctgcctcaacctcctgagtagctgggattacaggcacgtgccaccatgcctggctaatgtttgtatttttagtagagatggggtttcgccatgttgcctaggctggtcttgaactcctggcctcaagtgatccgcctgccttggcctaccaaagtgctgggattacaggtgtgaaccactactctgggcttgccttggtattttaacaatcggaattgtctttgtggcaaatgctgatttcatgccagccgtggttctgggtgctttgattaggatattgcatcccatcttcccaacaatcttatttattgttgagaccactaaggcttcgagaggttaagcaacttctacttccaacactgccccgcccaccccttccaccgcgcaccccccacacatgggtagtaagtagtggagatgggatttgaagctggggattctggctgccacctcagtcagcctcctcagtagctggaaccacaggcaggcaccaccacgcccagctaatttctttttatttttttagtagagatggggtcttgctatgttgcccaggctggtctcaaacaattgggttcaagcaatcctcctttcttggcctcccaaagtgctgggactataggcgtgagccactgtgcttgcctggcttaagaatgctttttcacatttttggccgggcatggtggctcatgcctgtaatcccagcaccttgggaggccgaagcgggcagatcactcgaggccaggagttcaagaccaccctggccaacatggagaaaccccatctctactaaaaaatgtacaaacattagctgagcctggtggcgggcacctgtaatcccagctactcaggaggctgaggcaggagaatcacttgaacctgggaggcggaagttgcaatgagtggagattgcgccactgcactccagcctgggtgacagggtgagactctgtctatatatgagctggacattcagcattcagggatagaggctgtttcagtgggacttgggagcaccacggcctgaggccatacagcccagctgccctttgctggtacttccttccttccttccctctttccttcctttctttccttttctttcttccctccttcctttcttccttccttccttactttttgagactctgtctcaaaaaagaaaaaaagaaaaaaaaatgtggggtagagcactgtactgaaaaaaattccacagtagttgtaattcatttttcactcagatgattagcattttttttttttttttttggagctctctgtttgggtggaggagggcagtatatgtacaaggcaaggcccccactccaccctcctccctcctcccaccccgcctttccccttcgagtgagtcatcgaacccgtgcttctagacgtgtttggagcagagcacctggaaatcatgatgttctctagataacagggaatattgataaattcccttgtggcgatgtcactgtcgtccatacagaagacaggaaagtgtaacgcctgcacacggggatccaacaaaaagaaaaagataaggtgggggaggccgggcacggtggctcaggcctgtaatcccagcactttgggaagccaaggtgggtggatcaactgaggtcaggagttcgagaccaccctgggccaacatagtgaaaccccgtctctactaaaaatacaaaaattagctgggtatggtggtgggcacctgtaatcccagctgcttgggagactgagacaggagaatcgcttgaacccaggaggcggaggttgcagtgagccgagattgtgccactgcactccagcctgggtgtcacagcgagactccatctcaaaaaaagaaaaaaaaaaaaaaaaaaaaaggtagggtagagcatgtaacgtgaatgatggcccacttgaatctctcattcgtctttcttcccttttatgttgtcaaagatctttaaaaaaaaaatctaggagagaaacaaacaaaaaaaactgtactgaaaaaaattccacagtagttgtaattcatttttcactcagatgattggcatttttttttcttgttttttctttttgagacaagggtctcaactctgttgtccaggctggggtgcagtggcgcaatcttggcttacttccgcctcctgagtagctggaattccaggcacgcaccaccatgctggctaatttttgtattttttgtagacatggggtttcaccacgttacccaggctggtcttgaactgctgggcccaagcaatccacctgcttcaacctcccaaactgttgcattatattataggtgtgagccactgtgccagccaggattggaattatttatttatttatttagtgagatggagtcttgctctgttgcccaggctgaagtgcagtggcgcaatctcggctcactgcaacccctgcctcccgggttcaagtgattctcctgcctcagcctcccaagtagctgggactacaggcgcccaccaccacacccggctaattgttgtgttttttttgtatttttagtagagacagggtttcactatgttggccagggtggtctcgaactcctgacctcaggtgatcctcccactttggcctcccaaagcgctgggattacaggcgtgagccgccatgcccagcccttatttattcatttttattttattttaaaataaaataaattttaaaaatttgattgaaattttttaaacaaacttttcactttggagatgattggattttgtagagcaggaaagaacaagtaccctagagagtatgtttctgggctcccggctcctcttccgggggttgaagatgaattgccgttggcctttgtaaaagaggagagattgttccagattggagtggcagagatgtgctttggtttgggtggcaaggatcacaaagaaagaagatgaggttgggtgtggtgggtcatacctgtaaacccagcactttgggaggccgaggcaggaggatcacttgaacctagaattcgagctcagcctgggcaacatagcaagaccccatctctacaaaaaattttaaaaaattagccaagcatggtgctgtgtgcctatagtcccagctactcaggagtctgaggtgggaggatcgcttgagcctgggactttgaggctgcaatgagctatgattacaccactgtaccccagcctgggtaacagagtgagaccctgtctcaaaaacaaacaaacaaaaacagaaggaaggaaggaaggaaagaaagaaagaaagaaagagaaaagacaagacaagaaaaaaaaaaaaaaagaaaagacagggtgagagggaagggtattcgggtggatgaaatggcaaagagaaggccaagaggcgttttgtgggcaagagtgaagagggtgcctcatgccgggaagggaggcttggaccagtgcagggtccttatgggctccaatgccgtcatgaaggtcacacaggggctgtgtttaggaggggctgtttccaccaatactgagtggacagccttgctgagccaggctttttgttgcgtccccgaagtccttgctgagtcagggaggaagtcaaagtaactatcaggttagataagctgatgggtgggcagaaagtgttttggtgggttcaaggctgcgctgaaagatggtagaccagttgaccgtgtggtcacttggctgccccagagatgatgctgtctaaatcttgagtggtgaagataacgaatttacaattcccaccattgcctggcttcctggagcgggtgggtgcggggaccggggaggggggccgggggaggctgagggctatcagttgaaactgaccttttggcccaatccttttgggaagaaggcgggtagagttaaaatccatcgtaatggaaaggcggctttccctttggctgtctgctaacttggtgactggcctgacaagtttttcttttccttcctcctacctgatactcactgaccggttacttcccatgtcacccgaccctttgtcagaattaaaatctgttctttgtgactgaacacctgaaatgccccggggaggacccaaggaagtcagcgagcgcctgtgcgtcaggctggcagcccaggtccttcagtgatctgtttctctcaatgcgcctgtgtcagatagaaccgtgcatttcccagtaaaaggaggtgatgtgtgtgctggagtttcaagattgtaccccttatcctatctcccctttcctctgtcttccctctctacttttttattttgttgtttgtttgtttgtttttgagatggggtcttgctctgtcacccaggctgcagtgcagtggtgcgatcatagctcactgcagcctcagccttttgggctcaagcaatcctccagcctcagcctggccagtagctggaactatgggtgcatgccaccacgcccagctaattttatttatttatttacttatttattaaagagatggagtcttgctatgtttcccaggcagctcacaaattcctgtcctcaagtgaccctctcgcttcagcctcccccattagctaagactacaggtgcgcaccaccatccctggctaatttattttttaaatttttctttttgtagagatggggattttgctatgttgcccaggctggtcttgaactcttagactcaagcaatcctcccactttgggaagcccaaagtgttaggattacaggtgtcagccaccaggccgacctgtttgctcatttttccttttccttttttcttttcttttcttttttctttttttttttgagatggagtttcgctctgtcacccaggctggagcacagtgacacaatctcggctcactgcaacctctgcctcccaggttcaagcgattctcctacctcagcctcctgagtgctgggattacaggggcatgccaccacgcccggctgatttttgtattttttagtgaagacggggtttcaccaggttggccaggctagtctcaaactcctggcctcaaatgatccaccagcctcagcctcccaaagtgttgggatgacaggcgtgagccaccacactcggcccgtttgctcatttttaaacataaatgatgtcaagagtgggaagcaaacaagaaagtgttgaaagcattgctctcctctgctccctggttacctatcatcctggggcccgaggagtggctgcagattgggccaccttcctccaatcacaggtttgggaagtggaccaaagtctttcaacacactggacttagcatgatcatcaaatttgcactggaggggccaggcacacgcctgtaatcccagcactcggggaggctgaggcgggcagatcacttgaggtcaggagttcgagaccagcctggccaacgtggtgaaaccccgtctctactaaaaatacaaaaataagccgggctggtggttggaacctgtaatcccagctactcggggggctgaggcaggaggattgcttgaacccgggaggtggaggttgcagtgagtcgagatcacgtcactgcactccagcctgggtgacaaaagcaaaacctcgtatcaaataattaaataaataaataaacaaataaataaataaaaaattacactgtagggcatgtggtaggtgaagcccaccattgtcaagtacctacctagagggtttggggtagagggtcctgtggcttcttctattttttttttttggcggagtctcactctgtcaccaggctggagtgctgtggcacgatcttggctcgctgcaacctccgcctcccgggttcaagggattcccccgcctcagcctcctgagtagctgggactacaggcgcccgccaccacgcccggctaatttttttgtattttagtagagacagggtttcaccatgttggccaggatggtctcaatctcttgaccttgtgatctgcccgccttggcctcccagggtgctgggattacaggcgtgagccaccgcgcctggctgtggcttctttatcctagaagtttctttgcctctcgttttgtcccaggcgaggagggtcttggatctttaatgactccatggcttattaagtgtagcccagaaagaatggttgtttaataggctttattaccgagtgtttccaagggcttacctggggaaggaaaacatttttactcggaggtctgataaggatgggctttaaagcgctggcagctagtcatgtccacacgcggtgtgcgaagcacggcgttgtttactgaccacctgcaaagcccgtcggctggtgaacaaggctcttgtcccaggctgcctcattggtggtgatgatgttaagagtttcctcatttgcaaataaattgactaacctagcagacgggtttgatccaaagtggtcaagattccttttctttaaatttgttttttttttgagatggagtcttgctctgtcacccaggctggagtgcagtggcgtgatctcagctcactgcaacctcctggattcaagcgattctcctgcctcagcctcctgagtaactgggattataggtgaacaccaccacgcctggctactttttttgtatttttagtagagatggggtttcgtcatgttggccagaatggtcttgaactcctgacctcaagtgatccacccacctcgacctcccaaagtgctgggattacaggcgtgcgccactacgcactggcaaatttttgtattttcagtagagacagggtttcgccatgttggccaggctggtcttgaactccggacctcaggtgatccacccacctcagccacccaaagtgctacaattacaggcgtgagccaccgcacctgggctattttcacttctttcgaagttatacctaggagtggaatcgctgggtcagttggtaattctatatttaattaatggaatcaagatttctttttcttttctttttttggttttactttaaaaaattctatcttattacataaaaaaaccacaggttcagaaaagccacaccaaacaaatgaatagcctaatggttcactctaacgtcaacactcatataatccctaactctggttgagaaatagtactttgccagaacaccccctccaaaagccatgccacggaccacatcctagtcacaggcctcttcccccagagtagtcactgtcctgtcttttgtagacatcacttccttctttctgtatagttttatcacccaagtgtgaatctgtagacaaatatttagctttgcccattaaaaaaaaaaattgatggccgggcatggtggctcatgcctgtaatctcagcactttgggaggctgaggcgggaggatcacttgaagccaagagttggagaccagcctggacaacatagtgagaccccatctctactaaaaataaaataaaaaattagccgagcatggtggtgcatgcctgtagtcccagctactcgggaggctgaggtgggaggatcgcttgagcacagaaggttgaggctgtaatgagccgagattgcatattgcactccagcctgcgtgacagagcaagaccctggctcaaaaattaacacaataaaataaattgatgtgtttgtttgggtctctagcagtggttttgaactgagggtgattttttttgtctcccaggggacatttggcaatgtctggagatattttttggttgtcacaactccagggaatgtgtgtgtactgctttcattgagcagatggaggccagggatgctgttcaacgtcctgcaatgcagagacagcccagccacaaagaatgatccagccccaaatgtcaatagtgctgaggggcagaaagcctggtccacaggttctccctccatccctttccttttaccttctctctgttgaagagctgggctttctggcttggggtgcagtccccagtctgagtgttgctgatcgtacgttcctgggacagttctgcttgcccctctgagctccagactcagagctagggtcacactcaggttctacctcttggactgactttatttaacaagtaccatttcagcactctctgcagtcagctgttttcaaaggcgaccatgcttgatgctgttcgtttgcacatggctctgagtggtggtgtgttctttgattttttttctttttcttttgttttaaagaaaaacacaccgttttttaaacacggttgcccgaactctcatcttcttcctccctgccctccctccctccctcctttccttccttccttccctccctccttccttcctttttctttatttcctcccttccttccttctctccctccctctcccttcctccctttatccttctctctttccttccttccttctctttcttttcttttcttctttcttccttgctttctttttatttcttacctcccttcctctctcccttcctctctccctcctccttcctctttccctttctccctcctctttctttttctctctcttcctttcatttttctcccctcccctccccttcttctcctcccctccttcccctctcctccttcccatcccctctcttcccttttcttcctttccttcttttccctccctctctctttcttttctcctttcctttcctttccctctcttttctttctttcttttctttcgacagggtcttgctctgtcacccaggctggagtgcagtagcatgatcatagctaacagcagtctggaactcctggtctcaagccatcctcccacctcagcctccagagtagttgggactacaggcccctgtcaccatgcccagttattttattttatttttttttgagacagagtctggctctgttgcccaggttggagtgcagtggtgcgatctcagctgtctgtaacctccacctcttgggctcaagtgattctcctgcctcagcctcctgagtagctgggactacaggcacctgccaccacgcccgactaattttttgtatttttagtagagacggggtttcaccctgttagccaggatggtctcgatctcctgacctcgtgatccgccctccttggcctcccaaagtgctgggattacaggcgtgagccaccgcgcccagccgctaatttttttttaatttattttttgtacagatggagtctcactatattgcccaggctggtcttgaactccagggctcaagcagttccggcacactagcctcccccaattcaatgggattacaagtgtacccattttttaaaaatgggccagactaaatatttgtctagagatccatacttgagtgataaagctatatggggttccatctgggaattcggttctgcggtaaaacggtgccgacgggcctccctttttttagtgtctgacaaacagggcacagaccgaacttcataacaaaactttgtgttcttgacgaaggcaagttttgctaagaaaattatttttataagcgagaaaggtatgaaggttatttgcaaaggaattttactggggtgagaaaaaaagcaagaggtttaccttaggattcctggtggtaaagaagatggaatgggcagaagatgtcatcacagatgtcacggggagagcgatagctgaacctctgaaaggaaagaggttcccagggaaggatgaatttgatgcaggaaaaaagttagaggatggtcttaaatttgtcaatgtagttcagaggaaagtgtaattcttcacagacttttagttttgaaaggatggcttcaaaagatactgggggacatgggcgcagtaactcacgcctgtaatcccagcattttgggaggccgaggtgggcggatcatctgaggtggggagttcgagaccagcctgatcaacatggagaaaccctgtctctactaaaagtacttaattagctgggcgtggtggcgcatgcctgtagtcccagctacgtgggaggctgaggcaggagaccatcgcttgaacctgggaggcagagtttgcagtgagccaagatcacgccactgcactccagcctgggcaacagagtgagactccgtctcaaaaaaaaaaaaaaaaaaaaaaaaaattctggccaaccgggaatagtccaggataatccattcttcagaacttgttcttgctaactcagttaagtgtcgaatggcgtgggttgtctactgtattttagaggacattagaatatttatgaagggctttcccaggtttactcataacttcattttcctcatgctatttgtcccttaaagtctttctgaaatctttcagttgccacttcttctgggtgggtgggtatgtatgttgagggtcatgcttttttttttttttttttttttttgagatggggtctccctctgtcgcccaggctggagtgcagtgatgtaatcacacctcactgaagcctcaacctctcaggcttaagtgatcctcccacctcagcctcccaagtagctggcactacaggcatgaaccaccgtgcctgactaatttttaaaaaatatttttgcaaaattagccaggtgcggtggtgcacgcctgtagtcccagctacctgggggactgaggtgggaggattgcttgagcctgggaggttgaggctgcagtgagccaagatcatgccactgcactctagcctgggtgacagagcgagaccctgtctccaaaaataaaaaaataaaaaataaaaaataaaagatggagtcttgctgtgttgcccaggttggtcttgaactcctgggctcaagtgatcctcctgccttggcttcccaaagttctggaattataggcatgagccactgcacctgtctgggtcctgcttttggtagtgatatagaaccaacttagtgaaattctagaatgacgctgtccactaaggtagctctgccagccacagccacatgtggcaatttaagtagaaattcattaaaattagatatttgtccctcagttgtactcaccatatttagacaatgcagacagacaatgttgctatcactgcaaaaacttgtattgggtacctctgccttagaacttttcattccatgatgaaagattgttctggagtcagacaggcctgcatttgaagcctatatctgttttgtgaccttgggcaaattgtctagcttttctgaatgtctgttttttcttctatcatgaggacatgataagggaaccagtctccaaggttttcctcagctttgaactggtatatcccctctttcgataaaaataaaaatccagttcctcttccctacttggagtttgttcttttttcctctaaatataaaatataccgttgaatgttttttcaacctctccaccccttgagagtccctggaatagagaggaaggagtggcttgggaaagttgatcacaacaaagaggctattataggtacatctaatcgagaagaggaacaaggaaggagtaggtgtgttgaccggggctcagagtgtcttgtctgtgggtcaccaagaatgaggaatgtgtcagctccttcctggcttctcctctctgggaacagagaacagtgcattgcagcttaagtggagtaaaatgggtgtgggtttggaggaagtggattaaggatggggaaggggccgtgggagagaaccccagcctgagtttgtcttcctggctcagcactgagtgtctcagtcaacacatgaatgccagtaatgggaatctatttggattcacttaagccatgaggtgggggcagtgtgttaactggggcaacacagggctctcagcttgaatcagctagcttttgctgtgtagcaaaccactctgaaacacagaccttggaatttatattcaagtttaatcatggagcttgtatcagctagcttttcctgtgtagcaaaccactctgaaacatagaactaggaacttgtatccaagttcattcatggagcttgtatcagctagcttttgctgtgtaacaaaccaccctgaaacatacaacttggaacttgttgtatccaagttcagtcatggagtttgtatcagctaatttttgctgtgtaacaaaccaccctgaaacatagaacttagaacttgttgtatccaagttcaatcatggagcttgtatcagctagttttgctgtgtaacaaaccaccctgaaacataaaactgggaacttgttgtatccacgttcaatcatggaacttttatcagctaacttttgctgtgtaacaaactactctgaaacgtaatggcttaatcaacaatcatgtacttagctcatgattctttgggtcgctgggcaagttttcttgtttagacccaccagctgaccacaaacacaggctcttttctctctcatgtctgggatcaaccagtgggttgtctggtagctggatggtctagcatggcctcactcacatgtctggtggttggtgctggctgtcagctgggaggccttggttttcttccctgtagctgctcatcctccagttggctagtttgggcttagattacatgatagtctcagcgttccaagagtggcaagagatcaatttccagtacaaaagtgccttttgagtttctgtttgcatcttgtgtgctaacatcccattggctaaggtgagctgggagggaaagggagaatatagtctttacctgttgatggaagaggaagaatttgtggccctgtttgccatctgccaaagaaccctggagtgggaaacagtggggctcataaaacatttttttaaaaacctcttattttaggttcatgagtacaataacattttaatcagaatttggagctcaattggacatcaggactgtgtatggtgtgactgaggacattaaatgatttttttttgagtaggaatttaactttatgaattccacttgttgaataaccaattccttccccagtaattcttgatgttttcttcatcaggtattaaattcaaccaaaaccatgaatttgcttttgggatatcaattctatttcaagtcctctgtgtcttaatcttatcccagtaccatactgtttatagatttagaatatgtgtttttttagttttgtttttgttgtcgttttgtttttaaagaagtggggctcggctgggcgtggtggctcatgcctgcaatcccagcattttgggaggccgaggtggctggatcacttgaagtcaggagttcgagaccagcctggccaacacagtgaaaccccgctactataaatacaaaaattagccgggcatggtggcacatgcctgtagtcccagctacttgggaacctgagacaggagagttgcttgaacttgggaggtggaggttcaatgagccgagattgtgccactgcacttgagtctgggtgacagagcgagattctgtcttcaaaaaaagaatgggggctcactgtgttgcctaggctggactcaaactcctgggtgcaagtgatcctccttagcctccaagttgctgggactacaagctcatgcctggtaagaacatgctttataaagtggcaaatctagttttttccctattacaccttttagaagagtgtttccttttctggttgaactaaatatttccctcctctcactctcatataaaacccattgagggctgggcgcggtggctcacgcctgtaatcccagcacttggggaggccgaggcaggtggatcacgaggtcaggagatcgagaccatcctggctaacacggtaaaaccctgtctctactaaaaatacaaaaaaattagccgggcatggtggtgggcacctgtagtcccagctactcgggaggctgaggcaggagaatggcgtgaacttgggaggcggagcttgcagtgagccgagatcatgccactgcactccagcctgggcgacagagcgagactccatcttgaaaaaaaaaaaaaaaaaaaaagcaaaaacaaaaacaaaaaaacccattgagatattgatttaaaaatttaattaaaaacataacccatttcccagaggaaaaaaagtgcagctcgctgccagcactcctttaattttacataaacatgttctttgaggctgaagcaaatctgactgattttcaatatgagaaaatataaaacggttcttggagttatttctaaacagaacttgtctctaatcttaatgtaacagaaatgtctataatgttacgttaggattagagaatagattattcttgggacaaatggaaaaatgggttaaaatccataaattaagaaatcaatactttcgtatttttcctttccgggcaggtatgggatctccttttccatttgctcaaatctttttttttctttttgagacagagtctcgccctgtcacccaggctggagagtagtggcacgatctcggctcactgcaacctctgcctcccaagttcaaacaattcttgtgcctcagcctcctgagtagctgggattataggcacacaccaccatgcccggctaatttttgtatttttagtagagacggggtttcaccatgttggccaggctggtctcgaattcctggcctcaagtcatctgcccacttcggcctcccaaagtgctgggatgacaggcatgagccactgcgcccagccaatttgttcaaatcttttatattgtcctttcttcatctttatcctgtattatttttgtgacgatggttcctgatttctgtatcacagagttttgttgtgttagttatggctactatgaatagcatatttaccctgaatccagatactttagtgaaattgattggtaggtttttaaattgttttattcattgtgtgcaatttcgtcctctacaaattatggtcatttaaaaaaattatgtctgctcagttctggaagcatgaaaaaaattatgtctaaaatcatacctcttgtttcggttttaaatcttattctattgaccagggcttctagactaacattaaatatttaacaatggtattatccgacatctatgtttaatagatttcctaatataaaatcatccttgctttcctgtggtaaaacctacttggttgtgatgaattattctttcagcataacgttgaattcgatttgctaggtttgctttgtttcgttttctgaattcttgccatctgtgttcatgagtgaaattgggctatgtttttggttggttttattttgcaatgtcttcatcagtttggattatttattgtgttctagccacataaaatgaaatagcaggtaactgagtattcattgacaaattttatggtgccataacttttggggggaagcaattctttgataacttaagaaaaaatttaggccaggtgcggtggctcatgcctgtaatcccagcactttgggaggctgaggcaggtagatcactggaggtcaggggttcgagaccagcctggccaacatggtgaaaccccgtctctactaaaaatacaaaaattagccaggtgtggtggcgcacgcctgtaatcccagctactcgggaagctgaggcaggagaatcacttgaacccaggaagcggaggttgcagtgagccgagatcgcaccactgcactccagcctgggcagtagagctagattgcatctcaaaaaaaaaaaaaaaaaaaaaaccaaaacagtgtgtgactggctgtgacgtaaggcagtcagacctctccttcgaaatgggccgtgattcatctttatttttgtagggctgtgtcacgttagaaccactacagcaaaagttttcattggaaatctaataatgtttttttagtctgccatctggagtctgtgctccttgtatgtctttattgttcaagactaagagtggtgtgtgtgtctgtgttggggggatggggtttggtaattttgctaacatggctctaagaatctgtcccgcttcccaaaacctcatttttctctgctttagcagtagcccaacactgaaaacagggtactgcttttttagaggagttctgatttggattccttttctttctttttttttaggccaaaattttcatttataaatagcttctgtggtacacaacatgcaaatatttttggtttcatgatattacaccagagttgcagagttgtagctgtttttttttttttttttttgaggcagtctcgctgtgtcacccaggctggagagcagtggtgcgatcttggctcactgtaacctccacctcccgggttcaagcaattctcttgtctcagcctcctgagtagctgggattacaggcgcccacaccacacctggctaatttttgtgtttttagtagagacggggtttcaccatgttggccaggctggtctcgaactcctgacctcaagtgatctgccctcctcctcagcctttcaaatgctgggaatacaggcatgagccaccacacccggctgaacttttattattttaaaaacatttttatttatagtaaaagtcacacataaaatgaaatttgctgtttttagaaagaatgtttaaaaagatgtgtaccatgttgcccagtacagtggctattcagaaacagccatagtacaccacagcctcaaactcctgggctaaagggatcctcaagcttcagcctcccaagtagctggggctacaggaacacaccaccacatctggcttgcctccttctccttctctttctccttttccttctccttctcctcctccttcttctttttttttttttgagacaagagtctcactctgtcacccaggctagagtgcagtggcatgatcttggctcactgcaatttctgcctcctgagttcaaagcaattctcctgcctaagcctcctaagcagctgggattacaggtgcataccaccatacctggctaatttttgtacttttagtagagacggggtttcaccatgttggccagtcccgaactcctgacgtccagtgatcctcctactgcggccttccagagtgcacaggcatgagccactgtgcctggcttgttttcttcttttttaaatttaatgagtttaggcagggtttctcagcctcaacagtgttagcattctgggctgaacccctctccgtggtggggactgccctgtacattacaggaagcttagtagcatccctggcctccactcaataccagtagcaaccccaagtcatgacaaccaaaaatgtctccggatactgccaagtgctgggatcacaggcatgtgccaccatgcccagctgatttatttttattttattatttttgagacagtctcgctctgtcgcccaggctggagtgcactggcacgatctcagctcactgcaacctctgcctcccgggttcaagtgattctcctgcctcagcctcccaagtagctgggattataggtgcacgccactatgcctggcaaagttttgtatttttgtagagacggggtttcaccatgttggcaggctggtctcgaactcctgacctccagtgatccacccgcctgggcaatatagcaagaccccatctctaccaaaaatttaaaaaaatttagccgggggtggcggcatgttcttgtagttctggctactcacgaggctaaagtgggaggatcatttgagcccaggagttggaggctgcagtgagctacgatcacaccactgcactccagcctggacaacagggcaaggcctcatctcttaaaaaaaaaaaaacaaaataaaataaaaagtgaataagtgaaagtaataaaatgtaagatacagttggagttctctttgtcatcttcccttgctatattctcctcccttcttcccagaggtaacaactctcttaggtttggtacataaacttccagccctgcatgtattttgacacataaccttgtacacacgtcaatgccagatacaggttcagtatcccttattcaaaatgcttgggaccagaagtgtttcccacttgggattttagaatatgtgcgtatatgtaatgagatactgtggggctgagaacgaggtctaaacgttaaattcatttatgtttcatgtacatcttatacacatagcctggaggtaattctatacaatattttcagtaatattgtgcgggaaacaaggttttcaccgcactgactgtgacctgtcacaagaggtcaggaatggaattttcttccactgctatcatgtcggcgctcaaaaagttgaattttggagcatttaggattttggattttcgggccaggaaattttggagcatttaagattttggattttgggttatcttcagttgttctttaaatctatttatttatttatttgtatttgacaacgagtttcactcttgtcaccctggctggagtgcaatggcgcaatcttggcttactgcaacctccgccttgcctcaagcgattctgctctctagtggctcagattacaggtgtgcaccaccacgcctggctaatttatgtatttttgtagagatggggtttcaccatgttggccaggctggtctcaaactcccgacttcaggtaatccacctgcctcagcctcccaaagtgctgggattacaggcatgagccaccacgcctggcataaatctttctttaaatctttcgctgctgtaataaaatatacatcataaaatttgccatcttatttatttttcagtatacagttcactggtgttaaacactgccatttatattgtaatacacttttgagtattctaaatatctgcatatattgggaagctaagtagtactatcccttaggaagccattgtgtattttgcacgtaaagcacatttcagttctgactggccacacgtggctggtcctgctgtaatggatctagtctttaaaaatactccgcgagagcttgcagtgagctgagatggcgccactgcactccagcctgggcgacagagtgagactccgtctcaaaaaaaaccaaaaaacaaaaaactctgcgatcttcctcaccatgcacacatatgatatttttgtgattgtgattccaattgctacacctgctgcatgagttcttaagccaaatgcttttttttttctctcagccactatgttctttaagtttatgcctcttgattcagtattgctagttcattcttttaagtgctacatagtatcttgtatgaataagccacatgctactcaccagctcccctagtgggaggcattgagattgtttccggtttgtttcttttataaacaatgctgcaatgaacatcttggtgtccatctcctcctacccatttgtgaatggttttctaggattgatgttcagaattgaagtcacagggaatggagtatgtgcatttttagatctagtatatactccccgaatggtctccaaggtggctgtgacagtttcaccagtgatgcattaaggtatatgtcaaatgtgggcaaggctgcaggaaaattatgttaattccagtgcatggaaattggtatcctatggtattcttttgcatctccctgattcctggtaagactgggaatctctctgtatgcttcttagccatgtcttcctacctcttcctcctctttccctgggagctgttttggggtggggggggctgggcctttttcttcagggactctgcattggcaacgtcacaaagaggtgcacaagggattgaagtgtcggaaatgctttgctgctgtcattgcatttctttacccagcatttcaattgtgctttgctttgcttttctcacttgaaattgtggccagatagaaacccagttagactaataagcatccatctttttaaatctctttgagatgctgatgtttggatatcttcagttgctcttctttaaatctgtaattttttttttgtagtaataataggacatgcatcataaaattgaccatcttaacctttttttttttttttttttttttttttgagaattcatctgttgatggacatttgggttgtttccgccttctggccattgtaactaacgctgggaaaaacacgggtctacaaatatctgtttgtggctgcccaagttttggggacacatagtggaagcccaccccttcctgattgaagcatggggcccattgagagacttagcccataggagcctctttccagtgaggaatatggagggaatggagggcagtacaaaagttctccggcctggacccttgtgattctttgaaggctgagacgagagatgagactcatggctgggttcactttttggttcactttccctttcctttttttttttttttttttttttgagatggagcactctgttgcccaggctggagtgcaatggcgtgatctcagctcattgcaacctctacctcctgggttcaagtgattctcctgcctcagcctctcgggtagctggaattacaggtgcatgccaccacgcccggctaatttttgtattttttagtagagatggggtttcaccatgttggccaggctggtcttgaactcatgacctcaagtgatctacgcacctcagcctctcaaagtactgggattacaggcgtgagccactgagcctggcctctttttccattttctgttgcatcaatggaaagtccatctcctgcccgtggacgttttctatgttgatgtggaatgtggcatttgtccaggaacttggtgctttttttttccctctattatttcatttgcttttggattttgagagatggagaacttccttagtgtgggagggaaacagttatggatttactttatgattctacattcaatcctggtctcttcaaatgatttcagggcttgtttggccaggtcaagtctgttctaggaggattttctttccatccttcctctgggaaatgaatgagtataaaaacatgcccaagatggagggaaacctccccttcccttttttgcctttttcttcctggttttgtacataactgaacattttgattttgggatgagaggatattagttcattctcacattgctataaagaactatctgagactgggtattttttaaatttttaaaaatttaatttaatttaatttaattttattttatttatttatttttttgagatggagtctcgctctgtcacccaggctggagtccagtggcgccatcttcgctcactgtaagctccacctcccaggtttacgccattctcctgcctcagcctcccgagttgctgggactacaggcacccgccaccatgcctggctaattttttgtatttttaaatagagacgggatttcaccatgctagccaggatggtctcgatctcctgacctcatgatccacccgcctcggccttccaaagtgctgggattacaggcgtgagccaccacgcccagcctatttatttatttttttgagacagagtctccctgtgttgcccaggttggagtgcagtggcatggtctctgctcactgcaacctccacctccccggttcaagcgattcttctgcctcagcctcctgagtagctgggattacaggtgcctgccaccacgcccggctaatttttatagttttagtagagacggggtttcaccatattggccaggctggtctggaactcctgacctcgtgatccacctgccttggcctcctaatgtgctgggattacaggcgtgagccaccgcgtctggcctgtttttttgtttatttccataggttttgggggaacaggtggtatttggttatatgagtaaattatttcgtggtgatttgtaagttttggtggatccatcacccgagcagtatacactgaacccaatttgtagtcttttatccctcactcacttcctatcctttccccctgagtccccaaagtctattgtatctttttttttttttttttgagacagagtctcacgctgtcacccaggctggagtgcagtggcgcgatctcggctcactgcaagctctgtctcctgggttcatgccattctccttcctcagcctcccgagtagctgggactacaggcgcctgccaccatgcctggctaatttttttgtatttttagtagagacagggtttcaccgtgttagccaggatggtctcgatctcctgacctcatgatccgcccgcctcggcctcccaaagtgttgagattacaggcatgagccaccgtgccgggccttgtatcattcttaagactttgcatcctcataggttagctcccacttatgagtgaaaacatagatgtttggttttccattcctgatttacttcacttaggataagagtgagactaagtaatttataaagcgctgggattagaggcgtgagccatggtgcctggccaatgtctggcatcttttctttggtgtaatgttttgagattcatccatggttttgcatttatcaatagcgtatttcttttgtgttgttcagtagcattccattgtgtggagagacaacatttagtttcaccattttagctgttgagagacatttgggttgttttcaacttttggctattattcataaacctgcatgaacctgttatacacaattgtgtaggagtcttttatgtggaccaatgccttcatatctcttgaggttatatcctggagcagaatggatgagttgtgtagtagaagtgtgtataaggagtgggcaggccaggtgcggtggctcatgcttgtaatcctagcactttgggaggctgaggcgggtggatcacttgaggtcagcagttcaagaccagcctggccaacgtggtgaaaccccgtctctactcaaaatacaaaaattagccgggtgtggtggtgggcacctataatccaagctatggtgggagaattgcttgaatccagcaggtggaggttgcagtgagctgagatcgcaccactgcactccagcctgggtaacaaagcaagactctgtctttaaaaaaaaaaaaaaaaaaaaggaaaggccagattgttttcctaagtggttggagtctgttatatttccaccagcaatgtatgagagttctaattgctccacatccttagcagcacttaatatttattgtcaatctttattattattattgttattattatttttagagataggatcttactctgttgcccaggctggagttcactgcagccctgaactcctgggctcaagtaatcctcccacctcggcctcctgagtagcttggattacaagcacacatcactacacccagctaattttatttttgtaaagatgaggtctcactaccttgcccaggctggtcttgaacccctgggatctcaagcaatctccctcctcatccttccaaagtgttgggattacaggcgagagctgcagcgcctggcccctttcactttcttaacagtatctttgaaaagcagctgatttttcacagggtgttgtaattaatttaattagctccacactgtggctttgaaaatcttccgtaagctctagcgccagacacatggatatttgcagaatcttattttctagagtcctggaaattttctttcctgtgagagagttgagagcgataattttagggtggttattcatcttcagacacaaggagtaagaatgtagggagttcgtgactgtgtttggagaggggagagcatagcagtggtctaatgatcttctcagggttctcaaagggtggacgagctgcaggttgaaacttgccttgcttttagactgttgactgagtttgtagttaagcagataagtgccaaaggagaagtcagggctgactgattgcaagtgatgattgaatactggccctcacaaccatctgtgaaaagtctatttccagaaattttttttattttgttattattattattattattttttgagacggagtctttctctgtcgcccagtctggagtgcagtgatgcaatttcagctcactgcaagctccgcctcccgggttcacgccattctcctgcctcagcctcccaagtagctgggactacaggtgccctccaccacacctggctaattttttgtatttttcgtagagatggggtttcatcatgttagtcaggatggtgtcgatctcctgacctcgtgtccacccgcctcggcctcccaaagtgttgggattacaggcatgagccactgcgccgggcccagaaatatttttaagaagagatttttgaaaaacccttgttttcatgatgggaggatatgaaaagcagtgttttgaaatctcctccttagatcctgatactcggaactgtcgattctcccattttcattttctcctggatagattgtacacttgtgccttggtatcctcaatgattccaaaacccccctggggatccagtccctgacataaaatggcgtagtgtttgtacataacctacatacatcctcctgtatactttaaatcatcttggtctggcagtgtggctcacacttgtaatcccagcacgttgggaagcagaggtgggaggattacttgagcccaggagttcaagaccagcctgggcaacatggcgagacccccatctctacaaaaaatttaaaaattaattgggtgtagtggcatgtgcctgtagtcccagctactcaggaggctgagacgggaagattgcttgagccagggagttccaggctgcagtgagttatgatcgcaccactacactccagcctgggcaacaaagaaagaccccatttccatttaaaataataggggccagatgcagtgactcatgcctgtaatcccagccctttgggagcctgaggtgggcggatcatcacttgaggtcaggagtttgagaccagcctgcccaacatagtgaaaccccatctctactaaaaataaaaaaaattagctggacaccatagcgcgcctgtggtcccagctactagggaggctgaggcaggagaatcacttgaacctgggaggtggaggttgcagtgagccgagattgcgccactgcaccactccagcctgtgtgacagaatgtgacagaatgcgggcacatcacgagatcaggagatcgagaccatcctggcgaacatggtgaaaccctgtctctactaaaaatacaaaaaaattagccgggtgtggtggcgggcgcctgtagtcccagctgctcaggaggctgaggcaggagaatggcgtgaacccagggggcggagcttgcagtgagcggagatcgtgccactgcactccagcctgggcaacacagcgagactgcgtctcaaaaaaaaaaaaaaaaaaaaaaaagacagaaaaagaaaaaacaaaagacgtttagctttcctgggtgacccagtgttgcagggattggccatccttggtgtaaggcataggatgtgcagggtagcaggacagcagagtgggcagtgtgtggggtttctttcattgatagggtggttcccagcactcggggtcagggcttgcttgtagaagtttctgaaaagttgcagtcatgtttcatttctttctccccctacctagcacatgccaggccacacagcatagtacgatggtttggaaccaggcttaacctgttagtagccgtggggctctgggcaagtccactggagttctccgggatctgtttcctcttttgtaaaatgggaaccaaaaggtatcacaggctgggcatggtggctcacgcctgtaatcccagcactttgggaggccgaggtgggtggatcacctgaggtcaggagtccaagaccagcctggccaacatggtgaaaccccatctctattaaaaatacaaaaattagccaggtgtggtggctggtgcctgtaatcccagctactcaggaggctgaggcaggagaatcacttgaacccaggaagcggaggttgcagtgagccgagatggcgaggtggcgccactgcactttagcctgggtgacagagggagactgtctcaaaaaatcaacaccaaaaccaaacccaacatgtatcacaagctcgttgtgaggatcagagaagaggatacgggaatgataaacatggtagttacattgttgctagcattgtagttatattgcagctgtacattgtgacctattgtagctactgttatttctttgattaagtttagcaactgaaattttttttttttgagacggagtcttgcactgttgcccaggctggagtgcagtggcgggatctcggctcactgcaagctccgcctcccgggttcacgccattctcctgcctcagcctcccaagtagctgggactacaggtgcctgccaccacgcctggctgattttttgtagtttaagtagagacagggtttcatcttgttagccaggatggtctcgatctcctgacctcgtgatccaccctcagcctcccaaagtgctgagattacaggtgcgagccactgggcccggccaacaactgaaatatttaacatacaataaaatgcacatggccggggtgcagtggctcacgcctgtcatcccaacactttgacaggctgaggcaggcagatcacttgaggtcgggaatttgaaaccagcctggccaactactaaaaatacaaaaattagccagacgtgatggtgcgttcctgtaatcccagctactcaggaggctgaggcaggagaatcgcttaaacccaggaggcggaggttgcagtgatccaagatcaggccattgtactccagccggggtgacagaaggagactctgtctcaaaataaaataaaataaaataaaatgcacagatctgaagcattgagttcaatgaattttgacaaaaaatatatgcacctgtgtaaccaccactgaaaacaaaatggaggacattgcctcatcccagccctttccagtgaattcccagtacccccgggaatgaggtgttacaatgattactatcaccattgttgattattattgtttagtttggttttattgaagaagcgggtagagaaagaaatagttagcctcatgcaaaaagtagggcatatgagagcctgagatatggcttaagaagagtattgtttgagaagtttggctgagtgtggtggcttatgcctgtaatcccagcacttcgggaggctgaggtgggagaattgcttgagctcaggagttcaagaatagcctgggcaacatagtgagactctgtctctataattaaaaaaaaaaaaagagacagaaaagtttaaggtatgttggcaggtagtcctagatggggtttactgccaggagcagttaggattcaaagagcaaaaatttgagggtaaaaggatgtatggtaggttgttggtggtggatatatagccccaacatccagtcactttaaactcttatcaagacaacacagggccgggtgccgtggctcatgtctgtaatcccagcacaatgggaggccaaggtgggcagataactggtggtcagcagttcgagaccagcctgaccaacatggtgaaaccctgtctctactaaaaatacaaaaattagcagggcgtggtgttggggacctgtaatcccagctactcaggaggctgaggcaggacaatcacttgaacctgggagatggaggttgcagagagcagagatcacaccaccgcactagagcctgggcgaaagagagagactccatctcaaaaaaaaaaaaaaaacaaaaacaaaaaacaccaccaaaaacaagacaacacaaagcgtttgaacgaaaacagcatttgcagatgcaaattcaggatccgaaattaattcttcccccctctttgctgagctgccagaatgttccaaggagatccctcctttccagtttcctccgtggcgcacaggctgtgccgagtaagtgggcaattgtgagtttctggaaatcagcgagctggtgtggctcctggctcctggctctggccaagggagttggcttccctgtgtccatgccaggaggggaggctggaggcttctaaaggccgcagctccgctgtagacacgcgcctccttggcactggctttgttgaaatctgtccctagatagtctctcttctgcacagacctctgaggtttttccatactgcaaagggccttgctgcaggaggaacagtctgacctaatctctcctagaggaggccttgagctaatattttttttttttttttttttttgagatggagtctcactgtcacccaggctggagtgcagtggtgcaatctcagtccactgcaatctccgcctctcggattcaagcgattctccctgcctcagcctcccaagtagctgggattgcagatgcccgccaccacacccggctaatttttgtatttttagtcgagatggggtttcaccatgttggccaggctggtctcgaactcctgacctcaggtgatccacctgccttggcctcccaaagtgctgggatgacaggcatgaagcacctcacccagccaaggtaatatttctgaaaggtggagtaccatgctatgagctagacacttggtgtggtttatcctgtcatcgcctcagtgacctcaccaggtggacacggttaggattcctaatttgcagagggagaagttgaggctgacagaaaggtcagcactgtgctcaaagtgatccagctgctaccaagatgaactgcaggctttgctctgagctcacagcctgacctcagtctagagctgggaatctttctctccctcattgctacacctgatcaattactgagtcccatccctttaactgcttacatggccttcaaatccatcttccctacctaagctgcccattcattgacctgtgccttctgtccatctgctgagagccaggtgctgtgcgagcctctgagaatgtggccgagaacaatatggataaaagttctgagccgggtacgctgactcatgtctgtaaacccagtgttttgggaggttgaggcagaagacttccttgaagccaggagtttgaggccggcctggacaacatagcaagaccccatctttacaaaaacaaaaacaaacaaacaaaaaaaagaaaaagaaaaattagctgagcatggtggcactgacttgtggtctcagctacttgggaggctgaggtgggagcatcacttgactccaggagttcgaggctgcagtgagccatgactgtgccactgcactccagcctgggcaatagagcaagaccctgtctcaaaaaaaaaaaaaaaaaaaaaagactgtaaatgtatcctccagagtaattcttctttttcatttttcaaaagcatccttgctttgtttatgcttccaaaagtttaaaaactgtagccaagttccaagaaagaaaaagggaagcaaaggaaaaggaaaacacagacccagaggccctttatggggttgattgtatgtgaagtccatcaattgatggagagaaggagcaccttggcagtatttacttgtactctcctatgtcatggatttcctctccattttcccaagggttctttcctgttcttagaaatgttttgtgattttgcttcagacacagtttgtctacttcttgtaagcattgttcttagattgctggctttatatctatcactcccttgctcatctgcccatccatctatccatccatccatccatccatccatccatccatccatccatccatcatccctccatccacttgctcatctgcccatccatccatctatccattcatccagtccattcaccacccaccatctattatccatccatccatccatccattcatccactcacccattcatccatcatccatccactcacccatccattcattcagtcacccttcatccattcactcacccatccatccatccactcatccaatcacccatccatccatacatccactcatccattcatccatccatacatccactcatccattcatccatccatccacccacccagacgtccgtccatccatccatccatccatccatccttctatctactctgccaacaatccacacacctgtccctccatcccttccaaccactcacccagcaatcttctcatccatctatccacccatgcatacatccacttattcattcatccatccctccacccacccattcatccacccatccatgtgtccattcatctctccatctatccgtgtgtctatcatctaatataagggagatgttttgaagtattaaaagtgattattttgtagcataggggacagggattgtgttttctttacttactgctaccttattaaatgcttactagttctaaaagccctgcaattgattcccttcaattttccaactctataattgcagcatctgcagataatgatgacttcttgccttttgccaataattagaccagttattgctgttaaccttgttatggcaggaacttccagaacagtgttcagtgacgcagctgaatatggtcagcccagtctcatttctgatttgagtggaatgcctcaattgttttactgcagaggataattatataattgttaatactcttgaccttcctgtctttagcctcactgagtaaatggggtgtgatcatgaaatcttgattgtctcatagatgcaagagacataaacgacatttgtctgtgtataatgacagcagatttattttgctaagctgttaagctgttaaaataagcctttaagcccccgcctcaattttccagcagagtggaatgttattttgttgcttctggccaagtgtcgatattcattttagggcaggtcttcatggaaagtctgctggactataggtctggatacttgccggaccctgtgtcatcactaaagttagggtgcgtttcagaaccaccctgtaccacagtgaagagggacaaatggccttagggagcaggacccatgggggccctctggggctgtttcttgtgccctgagagaggccctagatttgggacagtctgatttacctcccctcccttttttttttctgggtgatgctaccctggtttctgtgttgaaatatgaccctagtgtgaaggtcgcggtctcagaccatcttgtttctggtatgttaagaaacagaaaaacaccttttaggacaccatgttaaccattgaggatacatatcagtgttctggaaaaacaaaaacaaaaacaaaacaatctgtaccgcgactgtggttttcatcagggtgggctgcctttccgatccataaccctgtgtggcttgatggagaacatgttttgtaacttgcaagggcatctgcaatagccgggtcctcttggtgaaaggggaggacccacattaggtctaagctggctggagtcgatgcaaaactctcacatgctttggaaaaagcacgtgatctttcgacgagaatgcaaatgttgaccgggtgcagtggctcatgcctgtatttgcagcatttggggagactgaggcaagcggatcgcttgagtccagaagtttgagaccagcctgggcaacttggtgaaaccccatctctacaaaaaatacaaaaattaaccaggtgtggtagtgcatgcctgtagtcccagctacttgagaggctgagttgagaggattgcttgagctcaggaggttgaggctgcggtgagctgtgatcacgccactgcactccagcctgggcaacagagccagaccctgtctttaaaaaaaaaaaagaatgcaaatgtttgcttgattattcagctggtatttgacacacagttctttgttccagagggactgtccagcaacaaatagtgaattcgttaatttttcacaccaaacctattgaaaataaccagaaaaggtatatgctggaaaactcagtgttctagaaacattcatgtttgccatcccaagagcaaaagtcatggaatgcctgatgcttagtgttaagaggaaggaattccacacagcctgtggctagcttttcttatttcattggtgtccaagacaagatttgaactgtttactaaaggaaattagcatcataagtctcctctggcatatatttccagcatccaagtggagctgctgagatcttgctcaagagtagcaaaattggcaggaggaggagggcattagtttttacatcagcttaaagaattttttttatcagccatttttgcaatttggaaacctgtttggagtaggggtatatggagatgaaattgggctgtttctaggattcacctcctccttcaggcatttttttttttttttttttttggaaacagggtctggctctgttgcccaggctggtgtgcagtggcgtgatcatggcttactgtagccttgacctcttgggctcaagcaatcctcccacttcagcttcccgagtagctgggaccacaggtgtacaccatcgcacctggctaatttttatatattttttgtagagatggggtctcactatgttgccagggatggtcttgacctctcaggctcaagcaactctcctgcctcggcctcccaagttgctgggattacaggcaggagccactgcagttggtacttacagttgttttttttttttttttttcccttgagacggagtctcactctgttgccaggctggagtgcagtggtgcgatcttggctcactgcaacctccacctcctaggttcaaaccattctcctgcctcagcctcctgagtagctgggactacaggcacacgccaccatgcccagctaatttttttttgtatttttagtagagatgtggtttcaccatgttggccaggatggtctcgatctcttgacctcgtgatcctcctgcctcggcctcccaaagtgctgggattacaggcgtgaggcaccacgctaggccgatcctcagacatttttaattttccttttttagtgttacagccagccatttgaaaaatgagacttccccctaaccttgtgtcaaactcagagacgttgtcatcttggctttgatgtggtggaggagaggggcttctcattccgggacggggtttctccacctggggcctgcggatactggggctggattgttctctggggtggggccgtcctgggcactgagggtgctagcagcatccctggcttccacccattccatgccaggagcgccgcccccgaggcatggcaaacacaaatgtctccagacactgccaggtgtctcctggtgggcagaatcgcctccatttgaggacccctggaccagggtgctggaatgggggtgaggggcactctgcaattattctctgctctttttttgagggggggggaaatggaaaccaagagcccatcatcagcctcgtggctctgtggtttgacactgccatgctaccgacaaaaaccacgtccctagacttgggggaccaaggaatctggaggaatatgatgatagtcatttaatgaaggtgggtttatgtattactcaagtgctgggctggggagtcaggacatagccacagggaagaaaacagaaaggtccttccctcttggaagcccctcttgaaacacctaattggtgacatggtacactggagaatcagagagtgtcactcaagcattttggcttggtggtggggcgggggtggcgggtcaggcactcaagcacccctaagctgatctggagaaagtgtcggggaaggggaacattagcgtttctccctgaggaatcatcttacacctataacggcaactggcccacagtaacattgatggagcaagtgtcttcttgtggctcggccgctcaatagctgtgtgaccatgggcaggttactgaacctctctgtgcctcagtcttctcctctgtaaaatgggaacatctaggattgttgggggaaataaatggttaataattggaatagtgctgggtgcataggaaactctaagtgttacacagcatgtggccacaacctcccctctcccctcctctctcctctttgctgctgccctgctgccttaatgggatactcccctctctgtctctgtctgtctgtctgtctgtctgtctctctctcatccccttttctttcctctgttcccccacccccacctctgatgcagtttggaccaagttttcttcagccagctaatttagagacaagaacctggatatttattgggcgtttgggggacttccttacagccctaggtctctgtgaaaagggccctggattatctctgcaaaagcccacctgctattggttagccaggactgtctccactttcagacaccagcttcatccaaacactctttgctgtatttataaccacggtgcatttcctcgggacgcacatcttacggcttcttggccccttcgcccagggtgcactgcctggaccatcgccctccggcagagacagtgtctttctttgtatgttctccttcctctggtcgagatgtggcttggtcacctggagtggggccgtcggcaagtcgcctgggcttcgtggaggctcgctgcccccatggcggaaagctcggccacacaccctgatgtctcgacacctttgagttgcccatgaatgggttttcagagcttcccgtgtttactttgctgcacgcctctgtttgtgctctggggaaattcttggcagaggaaaagccaattggaaaacagccctgcttggtgtcagggcttgaggttgagggagaaagactgaaacggagatttgcatgagctggtttgagcatgtcacaagactttgtctttaaaaaaaaaaaaaaaaaaaattggcctggtgtggtagctcactcctgtaatcccagcactttgggaggctgaggcaggcggatcacgaggtcaagagatcgagaccatcctggccaacgtggtgaaaccccgtctctactaaaaatacaaaaattagctgggtgtggtggtgtacgcctgtagtcccagctactggaggctgaggtgggagaacggcttgaacccaagagggagaggttgcagtgagccgagatcatgccactgcactccagcctgggtggcagagcgagactggtctcaaaaaaaaaaaaaatttttttttgttccagtctattctggtggcttagaggagggaagatgggaaattttgggtttaatagagtaatatccatcaggttgagggctttgaagcacctgggaatatccataagtcactactgagcaccagctgtatacagttattgagcatgtattgtctcccaggcacatggtcctcacaacaatcttttcacagagctaggatttgaacccacagtctctctggcttcagaaccctagcttttcttgctatactctgccttacagaggaagggaacttttgtactgggttttgaagggtgaataggagttcaatgaagaagcagcacattctgtgctaaatttggcttcctgatcctcctagaattggccagaagccaatatctggaggccaaaattgggtcactagggtgaccaactcatcacagggccctggattatctctgcaaaagcccacctgctactggttagccaggaccatcacagtgtgcccaggtaaccctgcgtttcaccccaaagcagaattttacaccagagcctggacaccagttgaattttctttaactcatttctgtcaatggttacctccaaaaatgctcccttgtgtctttatgctgggcttctttctctagatacttccatttcttggtttgggtgaaaatcaaatgaggtaattaatgcttgtgacatgtaaagtgtagtgagtggcacatggtaacctctttagttttagccagttggttttttttgtttgtttgtctttgagacagagtctcactctgtcacccacgctggagtgcagtggcgcagtctcagctcactgcaacctctgcctcccaggttcaagcaattctcctgcctcagcctcccgagtagctgggattacaggtgcacgccaccacactgggctaatttttgtattgttagtagagatggtgttttgccatgctggccaggctggtctcaaactcctgacctcaggtgatccgccctccttagtctcccaaagtgctggcattacaggcatgagccacagtgcccagacagttttagccagtttttcactggcctccctctttgccttttttgcaagggagctggcctccctgtccctggagtaagcaaacttccttatacctatagcttcctctaaggaagcgtagttacctacagcctggccctccccaaggacacagctgtttcctccaccaagagcaaggagtggacataatcactgccaaatagggaagccaggctggacaccgtggctcatgcctgtaatcccagcactttgggaggccgaggtgggaggatcacttgaggccagggattcaagaccaacctgggcaatgtagcaagaccctgtctctaaacaaataaaaaaattagccagctgtggtggcccatggctgtagtcccagctactccagaggctgaagcaggaggattgcttgaccgcaggagtttgatgctgcagtgagctacggtcacaccactgaacaccagccaggacaacagagcaagaccctgtctcttaaaaaaacaaaaaaataaggaagccagatgggtgctgggtgtacgggacacatgtcaaaagtcagacctctatctgagtaaggaaacaggttcagagtcaggattaaagaccaagacagcttgaggtcatcagaggccaggaatttccatacaggctgcggtccaaagtgccaagctgggctagatagatgttggggaagagtctctgtcgccctctttccttccccgttaatgctatcagctgagcatgggtcactcctgatttttttttttttttttttaccgaggacataggctcagagtgtcttctagctttcaacccaccccagactctgacttagcctttcccaaatggtgctgtgcagaaaaatgaaaaaattgctaggaggatcatgtgcctggtggatagtacatgcttgatagctgtaaacagttggtgctcaatatatcgtggcttgtggatcttcccagctgcttcagaaccccaagcctgctgtataattgtacttgatcccgacaacagccctgccagatgggtgttactctgattcctgtgtcctggtaagtggacggggggcctggagtagctgaattgcctagagaaggggacatagctagaaaggaaaagttgaaacccagtgtgatgccagagtccatgcaaactttatcctgaaaggagggatctctttttttttttttctgagatggaatctcactctgtagcccaggctggagtgcagtggtgtgatctcggctcactgcaacctccgcctctcaggttcaagcgattctcctgcctcagcgtcccaagtagctgggattacagacgtgtgccaccacaaccggctcatttttgtgtttttagtagggacggggtttcgccgtgctggccaggctggtctcgaactcctgacctcaggtgatccgcccgcctcggcctcccaaagtgctgggattacaggcgtggccactgcgcccagccttcttcttcttcttcttctttcctcctcctcctcctcctcctccttttttttgacagagtctcactctattgcccaggctcgagtgcagtggcacaatctcagctcactgcaacctctgcctcctgggttcaagagattctcccacttcagcctcccgagtagctgggattacaggtgcgcaacaccacagccggttaatttttgtgtttttggtagaaacggggtctcgccacgttggccaggttagtctcaaactcctcacctcaagtgatccgcccgcctcagcctcccaaagtgctgggattacaggcgtgagccactgcgctcggcctggtgaagaccttcttgccggtggggactctgcagagtcctgacagggagcagggcatcacatggcgagggagctgagagtgtcagctcaggtctctcttcctcttcttataaaaccaccagtcccactcctatgataaaccattaatccatgaatggattaatccacttatgaggacacagcccttttaatcacctctgaaaggccccacctctcaatgctgccacatgaggaattacatttcaacatgagttttggaggggacaaatattcaaatcatactattatgttaccagtaaaatttaaaatataggaataataattgccgatgtgtggcagacttaccaaatactagaccctgtgctaagtgttttatatctattattttatttaattttcttggtcactgcatgacatatgctctgttagtcccagtttttcgaatgggcataacaagaccgaacctacctagagttggcacaagttgtaaaaataggatccgtggccgggcacagtggctcacacttgtaattccagcactttaggaggccaaggcgggaggatcacctgaggtcaggagttcgagaccagcctggccaacatggcgaaaccccgtctctacttaaaatacaaaaattagccaggcgtggtggcgcgcctgtagccccagctcctcgggaaactgaggtaggagactcgtttgaacccgggaggcggaggttgcagtgagccaagatcgcaccactgcactccaggctgggcgacagagcgagactccatctcaaaaataaaataaaacaaaaaaataggattcacttttgccaccaacttgaaaaggaggcaaacacaagattactcatctctggagaggaggcattcagatttgcctactcagcattcctggagatagaaccagattttgcatgggttagaatcatattttgcttgggaagccactcagacctcattgtgtggactctattcccagagccagcttcctttattccttcagactcttatgattggctcaggggaaggcacatgactcagactgggccaatcagctttcttaattcctccagcctccatgattggttcaggggtgggcatgtgaccccagaaggttccataagattcagttctgggactttagtgggagtgatagaaagagagatttttccttgctaaatcttccttgctgtgaagctataatccaggtgccaccatgtagagaccacgtgtctcagacttctgacaccatagaaggaagcaggactgcgaaaaggaaagggagagagatggggtccccatgacatcatttgacacctggatctagctgtacctgaaagtgtccttgtcctatgacttgttagttaaatgagccagcaatcgttcttttcttttttttcattttctttctttcccttccttccctccttccctccttcctttcctttcttttcctttccctccctccttccctccctcccttccttccttctctctctcttccctcccttccttccttccttctctctcccccttccctccctccctcccttccttccttccttctttccttcgttccctccctccctccttccttccctccctccctcccttttctctctctctctctcttctttctctctgtataactgagctttctattctcacaaactgaaagaggtcttgctaatccaaggcatgacaatcagagcaacatgtgaagcccaaagagctgcagagctcccctccatggcttccagccccgggggtggtcagtgaaagtaactggagcccggagcttcagaggccagtgtggaggttggaaaggttgtggtcaggagagagtaatatatctggtccctgcaacagacacccctgcagttttatcctgaatcctgggtaatttccccaggtcctgggaagcctaataaagcccctactcagatgttggattgcaagtcctttttgtttgtttgttttttaaatccactttaaatatgtctgaaaaccacacacagagtgactgctgcacagaagagcgaatggttcatgccttcttctttgctgccaccaacaagtcagttacctacttctctgacatgggacccttggctggagctcactggctgccttcctgccacctgtaagcctcggcacttgctgttccctctacctacatgcttttccctgtgatccttcctcatacgatttcctcagattatctttgctcaaacaacaggcaagggctgggccttaatctcacacctgtaatctcagcactttgggaggccaaggcaggtggatcacctggggtcaggagttggagaccagcctggccaacatggcgaaaccccatctgtacaaaaaatatacaaaaaattaaccagatgtggcagcgggtgcctctgatcccagggacttgggtggctgaggcaggagaatcacttaaacccaggaggcagaggttgcagtgagccgagatcatgccactgcactccagcctgggcaacagagcgagactccgtttcataaaaacaaagaaacaaacaaacagaaaaaaccaacaaaacaaacaaacagaaaaaaccaacaaaacaaaaaacaagaggcaagaagttcagtgtgcagaatctctgagaaaaacccatggttgttaaccccaggtctgccccttttgagcagggtgacattaggcaactgatttgatttctcttatatgaaatttcctcactccctgcctattcaaccacagtactgaggacatttggagctggattatctctctggtggcagctgtcctgggcattttagggtgtttactagcatccctggcctccccccactagataccagtagcactcccaccccacactggttgcaacaaccagaaatgtctccaagacacttccacgtgacccccggggggtcagaatttctccccttccccctgtgttttcctatggaggtggaacgtgtttatttctttgctcaccgttttgcaatctctcttcccccgccacaaggcagggactcttctatctccgtcaccatcccatcctcccacagtggagacagctctagggactctcctgagcagcagattcttgggtgccacattctgttccattcctggggaatttatctctttactgagtgatgggtacatgagaactttctgtgtcacccttgcatcttttctgttttgtttttacaaaagaaaaaaaagaaggctgggtgcggtggctcacgcctgtaatcccagcactttgggaggccaaggcgggtggatcacgaggtcaggagatcgagaccatcctggctaacacggtgaaaccccgtctctactaaaaatacaaaaaattagccaggtgtggtggcgggcgcctgtagtcccacctacttgggaggctgaggcaggagaatggcgtgaacctgggaggcggagcttgcggtgagccaagatcgtgcccactgcactccagcctggcagacagagcgagactccgtctcaaaaaagaaaaaaagaaaaaagatatcactcgatgactgctaccgaaacattctgtggctgggagaggaaaataccagaaagggtgaatgtggtcggttgaatgatgcctctcccttcccccagagatgcccacatcgtaatccctgtcacctgtgaatttggtacctcacttggcacaaggctctttgcagatgtgattaagttgaggatcttgagacggggggatgatcctagattatctggtgcaccaaatgccatcgcagggatccttttcaaggaaagagggaggcaagagattgaaatgctacggccaagaaaaaggagctgccttaaaagctggattctctctggagcctccagaaggaaccaacctttgtaacatcttgattttagccctgtaagactcattttgggcttttcaccaccaaaactgtaagaaaataggcaggccatgatggttcatgcctgtaatgccagtactttgggaggccaaggtgggacgatttcttgaggctaggagtttgagaccagtctgggcaacatagcaagaccccatctctacaaaaaaaaaaaaaaagaagaagaagaagaaaaattagctgggcttggtggcacacatctatattcccagctacttgggaggttgaggtgggaggattgcttgagcccaggagtttgaggctgcagtgagccatgattgcaccattgcactccagcctaggcaacagagtaagatcccgatgcaggagaaaataataaatgtatgtcgttttacatttgtgggcgtttgtgacagcagcaatgggaaatggaaacggtgagaaacccagcacctgggcctggaaaccccctctgggcgggtctctagccaggggccaacaggagtcagagcagggccttggtgagaggtggatacggggccccagcatcctgatggccttgctgtggcttctggggacacctgcagtggctccattacaccgtggcaatttgttccttcccagaccccctggatacaaggggcctgcattttcgaacccagagcccggggacatcccccgtggttccctgttaccctctggatgtctgtcctgctactatgcacctctccccaactcctggtacacagtgggagttcaggggccgtctcatttgtaccgcataacatcacggaggtccaagacgccatgtaatattctgtttaggatttcagaggcacagtcagttacatccatcttctttttgtctttgagacagagtcttgctctcttgcccaggctggagtgcaatggcacgatctcagctcactgcaacctctgcctcctgggtttaagcaattctcttgactcagcctcccaagtagctgggattacaggtgcatgccaccacacctggctaattttttgtacttttagtagagacggggtttcaccatgttggtcaggctgatctagaactcctgacctcaggtgatccactcaccttggcctcccaaagtgctgggattataggcgtgagccaccgtgcccagcctgcttccatcttcttagccacttttccctcaggtgagaccatgagattaggaacctgtttcaattcccgtcggaatttcccaacagagctggggctttgtgattcgaatatgttcagagaaggaagcagaaggaagcagaaatgaaggatgttatcagaaaaggagactcagggttgggtgtggtggctcacgcctgtaatcccagcactttgggaggccaaggtgagtggatcacctgaggtcaggagtttgagaccagccaggccaacatggtaaaaccctgtctctactaaaaattacaaaaattagctaggcgtggtggcatgcgcctgtaattcaagctactcgggagactgaggcaggagaatcacttgaacccgggaggcgaaggttgcagtgagccaagatcatgccactgcactccagcctgggtgacagagcaagactccatctcaaaaaaataaataaataaataaataaataaatacaggaaaaggaagctcggtagttttcaggggctgctggcgtttccaagctttaggcattttgctttgagtctttttctgtctttcgagtcatcctgaagtggaaccgagagaggactgagtgggtggagggggtggtggtggggacggctgtctgctctgctggaattgagagtctgggagatcattgtggtgtttttggagtgattcttaaccccagatatagacagtgacacaaggggcataaatacgaggaacagtgaccttccctggtgtccttgtttgaagcatttgaccatctgggcaaggcctgggagtgtctgaactggctggtgcttccatgaacaagcacagactcagagcccatggtcctgggttcgaatcctagttcttccacttctttgctgtatgacctttgtctacaaaaaataaaaatttagccaggcacagtggcgtgtgcctgtagccccagctactcgggaggctgaggcaggaagatccattgagcccaggggtcgaggctgtagtgagctatgattgcaccactgcactccagcctgggcaacagaagcagaccctgaagaaagaaagaagctgggaagacagggaagaaggaaggaagaaaggagggagggagaggggaaggaaggaaggaaaaaaaagggagggaacaaggaaggaaggaaggaggtggggacggagggaagaaggaaggaaggagggagggaaggaaggaaagggagggaggggagggaggagggagggagggaagaaaaaaagggaagggaaggaactttggaactactgaacatctctgtttcctcatctataaaaagagggataagttatcatcatatcttcctctatggtcattgagtggatgaaataagacagcatttgcaaatcccctaatgcatacctggcccctgattttgttccttgggctgcagcgatgatagaggtttaaaacctccaaacgctgtgttgaaatctctcacgtggacaaccagcccaccagcagagaatgtcatttttccatcctgggtaaacagggtagagaagaatgaggacctcaggccaggttagagagacctcgcttggtgaccttgggaaggcttttaacttttaactttaatgctaacatctggttccctccagttaggcagtcggcggcctagccgtcttgtcttgaagtttctcttgccttccatcatgggtttatttgttcagcaaatgtttatggagggccagcacaggggggaataagaactagagttctgggaggacatgtgaagaaacaagttccgagccccagggaggaaagaggtcattgcctccctctggggaaaatgtctcttctcatacctggttcacttcttaaatggaatttcccccttcagatgagtaaggcgtttaatcacaaagagaaaacaccttcatcacatagccatccttaaaaggcatttattgtgaagctggttcatagacttctcgcccaggttgctaacagccaacctgtctgggttttgggaagttaaagtgtctgtatcccatttcctttttttttttgagacaaagtcttgccctgtcacctagcctggagtgcaatggcacaatctctgctcactgaaacctctgcctcccgggttcaagcgattctcctgcctcagccctcccgcgtagctgagattgcaggcgtgcaccaccacgcctggctaattttttgtatctttactagagatggggtttcaccatgttggtcaggctggtctcgaactcctgacttcgtgactcaccagcctcagcctcccaaagggctgggatgacaggcgtgagccactgtgcccagccagttctgactttttaacttgtgatttgacttttcctgtctgaagtctttctctgctggacgtgagttgttgaaggtgttgcttttctttgtagacaattagaggcgctcatgcactgggctatggacaataatactttgaagatgtgcaaatgatttgcaacctttgttgcataaattatccctctgagatgctgtttggcttgataaataaaggacctgcaagagagaatttatcttgagcattccttgggggagagaagcaaaggggaagtgaatgctgcataataattctttgcatactttatggagggtgggttcctgcagtgccctgtagggttttttgtttgttttttttttttttttttttgagatggagtcgctctgtagcccaggctggagtgcaatggtgcgatcttggctcactgcaacctccgcctcccgggttcaagcgattctcctgcctcagcctgccaagtagctgggactacagacgtgctccaccacgcccagctaatttttgtatttttagtagagacagggtttcaccgtgttagccaggatggtctcgatctcctgacctcgtgatccgcccacttcggcctcccaaagtgctgggattacaggcgtgagccaccgcgcccggccccctgtagtggtttaaagcatcttcactgttattctaagcctcacattttaaacagagctgaaaaaggactctaattgctggcctgggatccttgtgtgctgtaggaattcactgagggggcggggctggagagggctgctagagggtggtacagaagcagatggaactttctctctggctggacacagtagctcacacctgtaatcccagcactttgggaggctgaggttggtggatcacctgaggtcaggagttcgagaccagcctggccaacatggtgaagccccgtctttactaaaaatacaaaaaattagcaggacgtgggggtgggtgcctgtagtcccaactacttgggaggctgaggcaggagaatcgcttgaacccgggaggtagagcttgcagtgagccgagatcatgccattgcactccagcctgggcaacaagagtgaaactccatctcaaaaaaacccaaaaataaatttaaagaaaaattttctctctgattctgcctgcctgcctgctagactggaagcaccatgaggtcaaggtccacgatgtcttgtcgctattgaagcgcctccaaaacatggcagaccctcagcaaatcttggacagatgaatgggcattcgattcaacatgtgtctgctaggtgggagctgagcgggaatcgcagggcttgggtcccggggatgatggggaatggcagtgtgactgtggggaagccaggggaatggggtgctggagcccccaaagctataaatcagggcctgatgaacagacagacagatggaccaacttaaccatttcagccccatcggctttgatgatttccctctggctctggcaagagtctcgctcaccaagtggttctcaccctagggtgggtctggatatttctggggacatctgtggttgtcacacgtcggggtggggggagatgctcctgacatggagtgggtggaggccagggatactgctcagcaccctgcaatgtacaagacggcccctccccagatgaagatccgactctgaataccaccagtcctgaggctgagaaaccctactttaagataacagtgatgggggaattatccaccccagagtctgagtctgtgacttgggaaacggccccggcattaccaggtgttgaattcgtgagaatacaaggagaaggcgtgtagcccgtgacccagtcctgccccagacaaaccgatattccctccaaagctctatttggcagaagaagtgttttcgttccctcttgcctgtggtatctcccctgataagcgttgtggattgttccagaccgtgttgacggggacagcttccttctccgcggctgccggccctgaccctgcagctttcagtctgtgggagtagagtcagctgttgagcagtttactctgtccctgtgtcaatgggattgtgcatgttttggttcctgaggggtcattgatggtgcacttttcttttgttgttagtcaatttaatttgttactaataataaaatctggaacttacctgaccccaaaggcccaggtcgttaagaatgcttggtggaatgcacgtccttttcaaataccggctcctttggaaaacacagaggatggagtgaaatccttacctggattgtactggcagtgggatgacagcgtcacctcctgaaaatggaatgtagcttattgctaaataagacagcgcagtgcctccctcgcacctgtcatcttggtgcttagagaggccaaggtgggaggaattctcgaggccaggagttcaaaaccagcctgggcaatacagaaagagcctatttctactacaaatataaaaattagctgggcatggtgacatgcacctgtagtcgcagctacatgggaggctgaggtgggagaatcgcttaagcccaggaagtcgaggctgcagtgagctgtgacttgctactgcactccagcccatgcagctgagcgagatcctctttcaaacaaaccagccaactaacaagcaggccccaaggggacaatttttctggaattacctgattgtatcaagaacagtttgatcaacacctgtaatcccagtactttgggaggacggatcacttgaggtcaggagttagagaccagcctcgccaacatggtgaaaccctgtctctactaaaaatataataattagctgggcatggtggtgggtggctgtaatcccagctacttgggaggcagaggcaggagaattgcttgaaaccgcgaggcagaggctgcagtgagctgagactgtaccactgcactccagcctgggccacagagtaagactctgtctctctctgtctctctgtctctgtctctctctctccatatatacatatatatttatatatataacttatcttgaagacggttttggcacgccttaacttttatgccagaggccagtgccttgcttgtgtcaccctggttccaagaatctgcatagtttttcccagcccattctacagacagggaaactgaggaccaggcacactaggttcccctccaggagtcgcacagcgaggagaaagtggagccatgacttgatgccaaacactgagactccagaacccatattttctcagctcttaggtttttgtcaatttcctaaatttgtgtgtgttttagtggggctgagtttctcctgttaatttgtttatggagaggagacactcttgtttacttttttttttttttttttgagacagagtctctgttgaccaggctgcagtgcaatggctcaatctcggctcactgcaacctccacctcctgggttcaagcgattctcctgcctcagcctcccgagcaactgggattacagtcacacaccaccacacctgactaatttttgtatttttagtagagatggggttttcccatgttgatcaggctggtctcaaactcctgacctcaggtgatccacccgcctcggcctcctaaagtgctgagattacgggtgtgagccactgcgcctggctcttggcgttctcccttagtaatacttcttgggggtcattttgaatctctgtttcttctgtggtcacgttcatttggaatttacttattcaacccacaaccaatagacatttccagccctttgttagtataaacagaacttctctttgactttcacagcgtttttgttctggaggtgctatccttgattgctaagacacccacgacattgctcttggaattggagtagggtggatgaaatagtattcaaagatgggggtggtgcaaatgttctgtatttcaacctgtacattagtcaagtgttatttttaccctcatgtacatctattatggaataaaatacatgactttggccaggcgtcatggctcacacctgtaatcccagcactttgggaggctgagacgggaggatcgcttgaatccaggagttcgagaccagcctgggcagcatagcaagaccccttctctaaaaaaaaaaattagctgggcatggtggtgtgtgcctataatcccagttactcgagaggctgaggcaggaggatcagttaagcctgggaagtcgaggctgcagagagctgtgataggcagcctgggtgacagagaaagaccctgtctcaaaacaaaaaacaaaacaaaacatgacttttatggagttgagctcaacgtttgcatacacatgaggagcagaagctggaggtttcaaataaatatctggcttctgcaggctgcctggagagaggtgagagcgatgcattggtcacccagcctggagtgcagtggtgtgatcacagctcactgcagccttgaccttctgggcacaagcaatcctcctgcttcagcttcctgagtagctgggaccacaggtgtatgccactatgcccagctaattttatttatttatttagagatggaatcttgctctgtcgcccaggctggaatgcagtggcacaatcttggctcactgcaacctctgcctcctgggttcaagcagttcccatgcctcagcctcctgagtagctgggatcacaggcatgtgccactatgcccagctaatttttttttttaatggagtcttgctctgttgccaggctggaatgcagtggcgccatcttggctcactgcaacttccaactcccctgttcaagcgattctcctgcttctgcctctcgagtagctgggattacaggcacgcgccaccatgcccagctaatttttgtatttttagtagagagggggtttcaccatgttggccaggatggtctcgatttcctgacctcgtgatccgcccacttcggcctcccaaagtgctgggattacaggcgtgagccactgcgcccagcctaatttttgtacccctagccgagacagggttttgccatgttatctaagctggtctcgagctcctgggctgaagcgatccacccgcctgggcctcccaaagtgctgggattacaggtgtgagccactgcgcccggccacagctgttgttttctcactggcttgagaattgttctcttaagctggtcaaggttatgactgtttgtgtggcttgtgcacgtgtgtgtggtcaaatcccatttttctaaagcaaagtttctatttgggtatctgctgtttaatttttcagggattttttttttccggttgctaaggaaagtacattaaattttatctttgcatcctgtagaactctttgtgaataatacacggccagagggaagataggctgaggaaacagataggaaggaagttcaagggggggatttctatgtgagaaccaagaaacacctttgatctttagatttcaaagtgggaagttcaaggtgaggtgggcgtggaattaggagtaaacccaagaagagcgagtgggcggttcctcctggcagccacagaatagttacgtggcatgaggtcagtagcatctcagagggtgttgttgtctttgacttagatgagttccaagaagcagaagttcgtgagccaaacacgaggtggttttctggggggtacaagggctggaagaggggccagctcttaaccacaaatccctttccatgcccaaggccaagctccttgtaactcttttctttctttgcctccctccctccctccctccctccttcccttccttccttccttccttccttccttccttccttccttccttcctttccttccttccttctcaaacaaggtctcactctatcacccaggctagagtgcaatggcacagtcatagctcactgcagcctcaaacccctgtgctcaagtgatcctcctgcctcagtccctcaagtagtttttaaacttgtttgtagagatgggtcttgctatattgcccaggcttgtctcaaaattctggtcttaagcgatcctcctgcctcagcctcccaaagtgctgggattacaggtgtgagccactgccccggcccattctcctttctttagccaggctagggagacataagtggggaaactcatgttgttttttgagatggttgctttattctcgtgatattttccctctttccaacttccttgagccctccccagcctcctcttagtgtctgtgtgtgggtgagggggctttggtataccttctgctttgagtctcattcattttaattttttattttgttttgttttgttttgttttgagatggagtctcactctgttgcccaggctggagtgcagtggcaccatcttggctcactgcaacctctgcctcccgggttcaagcgattctcctgcctcagcctcccgagcagctggggattacaggtgcctgccaccatgcctggctaatttttctatttttagcagagacaaggtttcaccatgttggccaggctggtctcgaactcccgacctcaggtgatctgcttgcctcagcctcccaaagtgctggggttacaggcgtgaaccaccgtgcctggccacgggtctcattcattttagttggagcccaaattcactggtggttcaagttcccaatcattctcggcattctataatcacaggcctcagagagtaatgctcccaatggccctcaaattatggtttccttaggaggctattaaatcttgatttctgagaggaaaattggggattttgtgttttcccttttagacttgagtgttctgttactgtggatgagctcttctagaaacttccaagcagtttcaaaggggatttagatgtcatcaggaagtgtggttgacaacgtgatatttgggctttagaaaaacagcgtgtcacccgttttatttattccttgatgactctttttttgcttgtttttgttgtggtcgttgttgttgagacagggtctcactctgccacccaggctggactgcactggtgcaatctctgttcactgaaacctcctcctcctgggttcttgcaaatagacagtcccatttggtggtgacgggagacagtgacagatcatcaagcattagattctcataaagagcgtgcaacccagatccctcgcatgcacagttcacaatagggttcacgctcctaggagaatctaatgctgctgctgatctgacaggaggcgcagctcagatggtcatgcaagcaatgaggagtgactgtaaatacagatgaagcttccatcgctcgcccgcccctcgtccactgctgtgcagcctggttcctaactggctggtttgaaactagactgggcaacatggccaaaccccgtctgctcaaaaaataccaaaattagctgagtgtggatcacaagtgtgtgcctgtagtcccagctacttgggaggctgaggtgggaagattgagtgagcccaagaggtagaagctgcagtgagctatgatcacacccactgcactccagcctgggttacagaatgagattctgtctctcaactccctgaggggtgggggacccctggtttaatccatccaaccctctcttcccatgaaataaaggaagttgtgagtgctattttgtgcgtcatcccctccagtattcaagtcagcccaaggtacttcgatggttcccgtctgcacatggggaaaccgaggcacagaaagcagactcatgtgaccaggaagtagctgtgtctgctcgaaactcaggtcgacctgataccataagtccttgcactccacgtgctggcgattgaagctgtggctcgcaggtctgatgggagagcctcagacagtgtctcactctgtcacccaggctggagtgctgtcatgcagtcataacccactgcagctttgacctcctgggctaattgatcctcccacctcagcctcccgaatagctgggactacaggtgtgcaccacaatgcccacctaatttttgtattatctgtagagatgggcgtggggggtgtgaggggtcttgccatgttgcccaggctggtcttgaactcctgacctcaggtgatcctccagcttcagcctcccaaagtatcgggattacaggcatgagagagccactgcaggaagccaagagagcagatttggacaatgtagaatttctccacgctcctcctactgtccccatcttaggcctggctactgcgggactgacaggcatggctggctgtccatccgttccttagtttgattgcatggcagacatgaggaaggaaggtgagaactgagctagaaagttggcatttggcgctctggtttctcaatgcaagaaagtaacactttggcttttatagaataaccttctgaggaaattaacaacccgggcgtttcagccccctgtgaacttgattggagcatggtcacaatttgtaacgaaatgtgcttgcatgcccagtgctaaagatttctctctgtctaccctctaggctgtggaaaggtctgttctaaccattagcttgtatctggagctcagatggtgccggacactccgtaggagctcagatctgttgatagaagccactagagaatgggacaagcaacaggaggtgttttgctgcctagtaaactttttttgagatgaagtttcacttttgttgcccaagctggagtgcagtggtgccttctcggctcaccgcaacctctgcctcctggcttcaagcgattctcctgcctcagcctcccaagcagctgggatgacaggcacccgccaccatgcccggctaattttttttgtatatttagtagaaatgaggttttgccatgttggccaggctggtctcgagttcctgacctcaagtgctctgcccgcctcggcctcccaaagtgctgggattacaggcgtgagccactgcgcccggctctacccatctttcttacatgatgatgttcagcagccagcctgataggggagcattgtttgtcctttttttccttattgcattttccccgcataggtgccagggctcagtagcataaatccaggtagaactgggaagttccaggtatctgggctgtttgctctggtggacaaagagcagctgcaaggtgggtcttgattagccagtgaagtctgaggatccagagggaaacttattcctttcttttgttgaaatcaacatgagcaggaaatggatctttcccccaatcagagaacttcacatgtttttctaatagaatagcagtgtctgaggtatatacacggggagtggccccccgggaaaacgaggccatgaggctcctggcatggagatgacacacgaagactctcgtaacttctagaggggaaaataaagcagtcattccaggctgggcatggtggctcacgtctgtaatcccagcactttgggaggccgaggcaggtggatcacctgaggtcaggagttcgagaccagcctggccaacatggtgaaaccccaactctactaaaaataaaaaattaaaaaaaaaaaattagttgggcatggtgctgggcacctgtaatcccagctactcaggaggctgaggcaggagaattgcttgaacccgggaggcagagattgcagtgagccgggagcctgtaatcccagctactcaggaggctgaggcaggagaattgcttgaacccgggaggcagagattgcagtgagccgggagcctgtaatcccagctactcaggaggctgaggcaggagaattccttgaacctgggaggcagagattgcagtgagccaagatcacaccactgcactccagcctgggtgacaagagtgaaactccatctgaaataaaataaaatataaaagttaaagcagtcatcctggcttttaggaacccgcagaatcaggaggtaagctaaaagtcgtctcccttttgtcacgatggaatgtgaaataggtgcattttccttctgacttatgattctgtttcacggtgcctctgcagaaattcagtacgtccccatgggcacctgtgtccttcaggagttgaggaaattttctccattccttgtccctgtccctagactctgccagctcgtgcatgtagaagctcccgggaaaactgtcaacctgtgcacattcaagaccgccatatacttgttattgaaaagccatcagtcatgtgagcagaacttttttatggttgagattgtccccagggaaacccgccttgcaattcagaccttccacggagatcgattccaaactctcatcccgttcccacttcctcgttcccatggaggctgcggttctctctctctgtgccgcttacagattgtcatacctatttccaaaaatgacacagaaaacttcaacgtgtggctaaatttgaacagagaaaaataagcaaagaattcaaggcgcgaggcgttttcagggagagagggagagcttttgcatggtttgaagggatgatctttaatgagttgagggtcacctagaatagaattaaactgtagagagcaaattgttggaaatgcaaggagaaacttcggagaagactccaacacagcctggatctgggagatgagactcaggtaacaaaaagtttgaataacatggttaataagattgtggtaacagataggactgaactttgcactctgcaaacaatatacattttaaagtgctcttggaatagttagaaaaatcaatcatctgttaaatctgaaaaaaaaaacaaaaaaacaaaaaaacaaaaaaaaacccaccccaaaccaatacattccaaaaaagcagacattgtacgggttctaatctctggctgcaagtaagcataactggaattaatttttaaaagcttaactgaacaagcatgtaagagagactcctaccacttgataattaaaaagaaaatgaaaaccaaaaaaacaaaaacaaaaaaaccgaaaagggctgggcaccatggctcacgcctgtaatcccagcactttgggaggccgaggtgagcggatcacctgaggtcaggagttcgagaccagcctggccaacatggtgaaaccccgtctctactaaaagtacaaaaattagctgagggtggtggcgcatacctgtaatcctagctacttgggaggctgaggcaggagaaccgcttgaaccccgggggcagaggttgcagtgagccgagatggtgccattggactcttctagcctgggcaacaagagctaacctccatctcaaaaaaacaaaaaacacaaaacaaaacaaaaaaacaaccaacccctaagtcttaagttggaggatcgaaacactgcaaggatagactatttgaagatgacaatgatgtgaacatggagacaaaggcagaggtttaaatgattatagaggaaatttgcttgataatttattatatgaatatagagagaaatcacaaaaatgagatgatgaatattggaaataataagcacagacgaactgattagaaaacaaatagaactgacaaaatcaaaaagctggatcttttagagagatgctgctcagtaaggtggccacaacccacgtgaaaattaaattaaaaattcattttctcagtcgcacgagccaagtttccactgcttaggggccatgtatggttagtgactactgaaatggatagaacagatacagaacttttccatagctgctgaacgtttgttggacagtgctgttttagagggaggaatcaataaaacagaaaaactaagacaaaggagggggagagaacaaatattgtagataaaattaagaatgaaggcctagcgcggtggctcacgcctgtaatcccaacactttgggaggccgaggcgggtggatcacgaggtcaggagatcgaaaccatcctggttaacacggtgaaaccccgtctctactaaaaatacaaaaaattagctaggcgtggtggccgcgcctgtagtcccagctacttgggaggctgaggcaggggaatggcgtgaacccgggagggggagcttgccgtgagccgagatcgcgccactgcactccagcctgggcgacagagtgagactccaactcaaaaaaaaaaaaagaatgaaaatagatgtaatttatttattattgattgattgattgagacagagtctcacttggtcgcccaggctggagtgcagtggtacaatctcagctcactgtaacctctgcctccagggttcaagcgattctcctgcctcagcctcccgagtagctgggattacaggcgcccgccaccgcacccagctaatttttgtatttttagtagagaagtgatttcaccctgttggccaggctggtcttgaactcctgacttcaggtgatacacccgcctcggcctcccaaagtgctgggattaaaaacagatgtcatttaaatccataaaaaattgtaaagacagctctactaacaattttggaaatattaaaaataacttcatttactgattcaagtgttacttttatttagcttaattgtttctctttaccagaaattgaggctctgaatttgccccagagaatgggtatgccattctctctcataagctgtactctcttattatcagtaatttctaaatagcctgtaaaatttatatggactcaaaatgcaggaaacatcgataggttgaaactcaacaacttgtaaaaagttactcctgtacttaattgcataaaatgtgtattgcctacatgaatgagaataaaaacttccaaaatgcccccaacaaacaggggtttttgcaccttaccatgagtagctttctggagcaagccggagtggttagagctgtgactcggcaaccacaaacacaaccatttttgtgtggaagtgtggctcttcagtcttttttttttttttttttttttgagataaggtctcactctgttacccaggctggagtgcagtggcgtgatcctagctcactgcagcctcaacttcctggactcgagcaatccttctgcctcagcttcccaagtagctggaactacaatcatgtgtcatcatgcccagctaagttttattttttttaatctttaatttttttaagaaatagagatgaggtcttgctatgttgcccaggctggtcttgaactcctaggctcaagcaatcctcctgcctcagcctccccattagctggaactacacttgtgtatcatcatgcccagctaatttttaactttttatttattatttttttaaagagataaggtcttgctctgttgcccaggctggtcttgaactcctaggctccagcaatcctcccacctcagcctccaaagtgcagcctctatatcttgaactccacacctcaaacccagattgtccacatgtgagcacctgtctttttggtttgctgtttctctcgtgagttgtatccagttgcccaaggtggaaagttgggcgtcatccagcaggtaagtcctgacacctccacctccccgatggcttcagaagccagcctcttcttttctgtttcctctgcctctcaacttcctcatccatctaccataagccagaaaaatgacccccaaatgtgaatccgatggtgttctttctgcctgacatctttctttggcttctgctgtggggtaaagtccaagccccttggttccctgtctttcctctctggtctaatcttctattcctctcatcctgtactttgcccttcatcaactctgaactgtttatagttctctgaacatagcccgagtgattcacacatttgcatgtactgttcctctcctgctgtgataaagcgacagtcacctaatccccgcccctccgttgcattttttcttttcctacaagatttattatgcacctactgtgtgtatggctctgggatgctgtaataagcaagacagacaccatctttcccttcacggggcgtatgtgtctcgtgcatactgggagggcagggacagggtctccatccatttctgcattccaatgccaagagggtgtcagatctgggtgggtcgaggtagggaacaggtaaacataactcacagtgtgatgccgtgttacagccaggctgggttcctcacgcctgtgatggcagcgctttggggagccaaagtgggaggattgcttgaagccaggagtttgagaccagcctaggcaacatagagagacccgctctcaaaaaaaaaaaaaaaaaaaaaaaaagctgtcgcagtggcactctcctgtagtcctagctccttgggaggctgaagcggaaggatcacttgagcccaggagtcctagactgcagtgagctatgatggctccattgcactccagcctgggccacagagtaagaccctgtttcaaacaaacaaacaaatttaaaaaatcaaacaaactcccactcccccaaactccataccacaccctctcctggtctctctgggagacctggattcgagttctggcagagctggttattggcaaagtagcccctctatgcctcggtttctccaattctaatggtgatgattgcttgaataattgagttaatatgacctcattgatggattggaccgtgtgtgctgcaaacagattacacactttaaagtgtattcatgcctgtaatcccaacactttggtagactgaggcaagaggatcacttgaggccaggagttctaaaccagcctgggcaacgagtccccatgtctacaaaaaaatagaaaaaattagccaggcatagtgatgcacgcctgtagtcccagctactcgggaggctgaggtgggaggatggcttgagcccaggagtttgaggctgcagtgggcgatgatcacaccactgcactccagcctgaggcgacagagtgagacccccccccaaaaaagtgtatttatgggggtgaatgttaaatgagaatgtccactcgctgccttggtttactggaactgcaaattcaatggggacacacaagttttcaaatgcatgcggaatactggctggaggttaccccaaaaacgtagcctgtggattttaagaatgtatttatgagtatggttctcgttttctgggtgagtggtgggtgagaatagagggtgcactggcccggcgagttcggagatgcggaccctccccccctgcaatgtgaggaattttgctgtgtgaccctagtgagccgctgcacctttctggacccctcccgagggaggcctggggtcagggggcccctcggcagtcccgggagctgccacgcggtgacccgatctcctcccgggcacacgcccagcgccgcgcgcagcctaagccaccccggtggatgcttgatgagcccttgcaagctcggtttctccttttccctagctttttccaaagttccatccgtggcagactcgacctgcggggtctgcagccacgaggggccctcccagggcgccctttcctctggccgggaccgcccggcggcggccactgcccgagcgccagtctggggagcggagcccggcgcacccggggggcggggccagcgcccctgcagcacgcccgcccattggctgagcgcgagggcggcgctgcggccgccgcaaccgccggggccggattccccggagcggagtgcgccccgggctttgtgctgcgctgaggcctccggctcgagggggcggagccttgagcgcctagggctccctccctcgcccccatgggcacacacgcagacacgggcacacacgcagacacacacacacgcccatcatggacacacacacacgctcgcccaccatggacacacacacactcccaccatggggacacacacacactcccaccatggggacacacacacacacacacacacacacacactctcactctggaaccgaccaatcctggggctgcacagacacacacgcgcacacactctctctcgttctctctctctctctctcgttctctctctctctcgctctctctcccactctggaaccgaccaatcctggggacacacacacacacacacacacactcccactctggaacctgccaatcacacacacacacacactcccactctggaacctgccaaacacacacacacactcccactctggaacctgccaaacacacacacacactcccactctggaacctgccaaacacacacacactcccactctggaatctgacacacacacacacacacacacccaaacacacacactcccactctggaacctgacacacacacacacacacacacacacacacccccactcccactctggaacctgccaatcctggggctgctctagcgaggagacccctgggaccccgcctccttccgggcctctgcgtgcgcagtatatctcctaagagatccgcagcatggagagggcccgcccccgtggacggactcactccctccccactcactcactcactcgcttactcactcactcactcactctctctccgaagagaagaagcctgcggctcccgaagcgggaaggccctctggtactctgttccctttctagcctctatatgcgccgtatgtctccaaagagctgcgcagttctattccaaaggcgtcatcgcgtgtggggcggtattgtcaggcaaggaaaaggggcgcttccccgcttcaaggacacgcgctcctgcggtcgtcgctgctgaccacgaagctgtcaaaagttcacctccttggctgcccccaacccctgcccctttgccattaaatcatttactagattccaactagaggaatttggctccggggactcgaacctctgaggtcagggtctggggccagtgtgggagagaaaggccttgaatggaaacaaaataaattactttaaggagtttataaaactcacacttatagggagagccgcggggccctgtggtcaatgtaccagcaggcccatgacgcaactgttccgtttggaaatttctggaaagcagtaatttttggaatcataaatcttgagtattttttttttaaactttggaaaggtttttaaactttttttttttaagttttttttaaacttcggaaagttttaagctttggaaagaatgtaacaaaatgttattaacatatgtggagctatcgaatcatttaatggtggtttctgtattttctgttttgttttttatcacataccttcttaattaagaaaaacccaaactaatttgaactttaaaagggaggcaaacaaaaaagtgtcagagtgactggatttttgtgcgcaagtcatttaacaatgcagcgctgcgtctcctatttctctggcttttaaccttgctttggacaaattggtcgctttttgttttgatgtcgtttcaagcttacggaaaaattgcaagattatatctagatcaatcaattgtttacgttttattctacttgttttattacctttctaatatatttatgcacacacattatatacatttttttcccctgaactatttgagagttagttgcaggcatgatacatactccttaattcttcagtggatatttcctaagaacaagaaagttctgaggccaggcgtggtggctcatgcctgtaatcccagcactttgggaagctgaggcgggcggatcacctgaggtcaggagttcgagaccagcctgaccaacttggagaagccccgtctctactaaaaatacaaaattagccaggcgtggtggcacatgcctgtaatcccagctactcgggaggctgaggcaggaggttcgcttgaacctgggaggcagaggttgcagtgagccgagatggtgccattgcactccagcctgggcaacaagagcgaaactccgtctcaaacaaaaaaaaaaaaaaaaagaaaagaaagaaagttctcttacataatgatggtactggtgccgttgtcaaaatcaggaaattaacattgatacagtattttaatccaatgtcttctataatcttatctgttgtctcaatattgccctatatagattttttttcctaggcgaaggttccaatctaggatcacactttgcatttgaatgctgctgtctcttaagtccgcacaattcctcagttttctgtgtctttcccaacattggcttttatttatttatttatttatttatttttatttttttttgaggcggagtcttactctgtcacccaggctagagtgcagtggtgagatcttggctgactgcaacctctgtctcctgggttcaagtgattctcctgcctcagcccccaagtagctgggattacaggcatgcgccaccacacccagctaatttttgtgtttttagtagagaaagggtttcaccatgttggccaggctggtctcgaactcctgatctccagtgatcttcctgcctcagcctcccaaagtgctgggattacacgtgttagccaccacacctggccaacattggcagttttgaagagcacaggccagttattttatcgaatgacctcaagctagggttagtaatatatggaaagaaagctacacaaatattttgtctttttcattgcctcataatgggaagtacgtgttgttgccttgtcccactattgtgggcaatgttacttgaagtatttttaactagaatttttaagaagaaatacatttcccgtaaggctcagtacccaagacatgcatatacctgaatgaaaagtttcccacaacaagatttactcttgccattttctagtactgtgggattttttccttttcttttccccctgcaggaggggatgctgctgggggctgaggacaatgctaaacctggatgtctcgaggacaggggatggggtttctgtgtcatctatgttctgatgctttttcatttaatacaagaacaggtttcctatgatttggcacactgggacattcgacatgtgtttgttgaatgaaaaaaagaaaaaagagaaatgctaacaatttgttgaatagtccataaaagagcaaagctggcctggcgcggtggctcacacctgtaccagcactttaagaggccaaggcagacggaggtcacgtgtttgagaccagcctggccaacatggtgaaaccgcttctccactaaaaaaaaaaaaaaaaaaaatcagttggtgtggtggcgtgtgcctgtaatcccagctactcaggaggctgaggcaggagaatcgcttgaacccaggacatgggggttacagtgagccaagattgcaccactgcactccagcctgggtgacagaaagagattttgtctcaaaaaaaaaaaaaaaaaaaaaagcaaagctattattaaaacacactccacacttcacccctgagccccatattgattttgtaataaggcaaagataattttttttttctttttttgagatgaagtctcattctgtcgtccaggctggagtgcagtggcacgatcttggctgactgcaacgactgcctcctgggttcaagcaattctcctgcctcagcctcccaagtagctgggattataggtgcctaccaccacgcccagctaatttttgtattttgaatagagagtgtttcaccatgttggccaggctggtctcgaactcctgacctcaagtgatcttcctgcatcagcctcccaaagtgctgggattacaggcgtgagccaccatgcccagccaacaaagatgattttaagagaacctttgtaaaagctctcaccgatgcctgtcattattagaatatttgggagtagaatcatgtaactgatcaataacattgtttactgtctagcagaggcttttgaaaaatgtatttcctggctgggcattgtggcttacgcctataagcccagtttgggagctcggggagagcggatctcttgagcctaggagttcaagaccagcctgggcaatattgtgagacctcatctctaccaaatgtatatatacatatacaaaaattagccaagcatggtggtgtacgcctgtagtcccagctactcaggaggctgaggtaggaggagcacttgaacctgggaggcggaggttacggtgaaccaagatcatgccactgcactccagcctgggcgacagagtgagacactgtctctaaataaataaatgaaagaagaagctacttgaaaaaaatatgtatttccaaatatatgtcagttttgacaggatagtacacatacatagtaaaaaataaaaataaaatagggcacttttttgtgtccctttcagagggacatatgtcccatgtgtcctcccccctcctgcccctaatttttttgtttgtttttttatgagatggagtctcactctgtcgccaggctggagtgcagtagcgtgatctcagctcactgcaacttccgctccccaggttcaggtgattttcctgcctcagcctcccatgtagctgagactacaggtgcgcgacaccatgctcagctaatttttatatttttcgtggagacggagtctcaccatgttggtcaggatggtttggctctcctgacctcgtgatccgctcaccttagcctcccaggcttagcctccttagcctgctgggattacaggcatgagcagaagaatctcttgaacccgggaggcggaggttgcagtgagctgagatcgtgccactgcactccagcctgagggacaagagtgagactccatctggggaaaaaaaaaaaaagaaaaaaaagaaatactgcatcaaattgcacttgcctcttggtgcaagattcgttcctttgctttgaactgcctccctgaagcaaattggtgtttctgtgactccctctgtctagggaaggggtcctttagtggggacattgtctttcttggggagggtccaccagaggactctgacacagcggtctcctttctcctccgtcaacttagttagattttagtccctgatcttctcagcagtgtatagtgaaaaagccaccgcagctgaaagtttcaggaagatgatagttgcttctgtgtgctcacccaggagcttttgggaggtttagggagaactgggggaaaattgggaccagcagctcaatgtggctttgaaggggagacagcggatggacacagaacttgcatttttggagaggggaggtctgggtagatgttccctacatacacagcagcacttgtgtgcaggtgtgagggagtgacagcccccggacggtttggcattttcctgcaagtctgccatcttgtctggcagacatagcctgggctgctgactgtccctaccccaaaccagaatttgggcaggaacggacacttgggctcattacgtgtcaatgagggggatcaggtcaggggcacagggagaggaaagtcaaccccgtcctccactggggctgtttctcatcttgcatgacacgtggctttcataatgtcttcactttgcggtctctctcaccagaagaagctgctgttttgtggctagttcatctgtgtcatgccctttccccagcctgggctgcctgtgatttttttcttttcttttcttttcttttcttttcttttcttttcttttcttttcttttcttttcttccctccctcccttccttctttctctttcttttctttctcctttctttctttttctttcttttttcttttctttctctgtctttctttttctttctctttctctctctcttatctttcttctttctccctctttcttttcttttttctctttctgtattctttcttctttctctctttctttccttctttctttctccctcccttcctgcctctttctttctctttctttctccctcttctttctttctctctctctcccctccctccctccttccttccctccttctttctttttatctctctccttccttccttccttccctccttctttctgtctttctctttcttttctctctctctcccttccttccttccttccctccttctctcactctctctttcttttcaaagatagggtcttgctttattgcccaggctggagtgcagtggtgcagtcacagctcactgcagcctcaaacccctgggctgtagcaatcctcccacctcagtctcccgagtagctgggactattggtctacgggtgtgcaccatcacacctggctaatttttttatttttgtagagacaggggtctggctattttgcccaggctagtcttgaactactggactcaagagatcctcccgtgttagcctcccaaagtgccattacatgcacaagccactgcgcctggcagacttgtgattttcatgtggagcttttcacattctgtctaacaatccgagttcagaggaaccagtatggggagcaagagtatgtggaaacgtccagcaccagtttagaggactcccactcagctagggggtgcagtggccaccccgagtggcttttctttcttttctttccctccttccctccctccctccctcctttctttctttctttctttttcttttcttttctttctttttgagacagagtctcactctctcttccagcagtggcacaatctcggctcactgcaacccccgcctcccgggttcaagcaattctgctgtctcagcctcccaagtagctgggattacaggcacctgccaccatgcctgtataatttttgtatttttagtagagatggggtttcaccatgtcggccaggctggtctcgaactcctgacctcaggtgatccacctgccatggcctcccaaagtgctgggattacaggcgtgagccaccgttcccagcctctatttttttaaaattgacaaataataattgtatatgttacatatttatggggtaccatgtgatgttttgatatctgtttacattgtagaattactaagtcatgccaatttaaaagctatcacctcacatacttatcattgttttatggttaaaaatatctacatttttggcaattttgaaatgtccagtgcactattacttattatagcaaccattgtgtccaatacataactaaagcttatttctcctaagtgaaattttgtagtttgatcaacatctccctacagagttggaaacacctggaatgggcttatagtgttcgaaggatagtcttcaaagaattggttgggcgcggtggctcacgcctgtaatcccagcactttgggaggccaagatgggtggatcccgaggtcaggagttcaagaccagcctggccaacgtggtgaaaccccatctctactaaaaatacaaaaattagctgggcgtgatgacgggcgcctgtaatcccagctactcaggaggctgaggcagagaattgcttgaacccgggaggcggaggttgcagtgagctgagttctcaccattgcacttcagcctggacaacagagtgagactctgtctcaaaaaaaaaaaaaaaaaaaccaccaaagaacacaggtcagcatgtttatttaacccattagtgagggaacagcaggattataaagccaaaacatgtatagtcactgaaacaagaaggcagtgttagctgtgaggctgcttaatgtcccataggacaataaaactgtaatctttggggatgatttttttcttttttttttcggcaaggagagataggatctcactctgttacccaggctggtctcgaatgcttgggctcaagcaatcctcccgcctcagcctcccaaagtgctgggattacaggcatgagcctccatgcccagctgagagtatcttttctctgagatgaaaataatttgtagcatatctgtctgtaagttaactctaatttccttgagtctagttcctaatagaaatagtaaaatcggccaggcgtagtgggtcatgcctataatcccagcactttgggaggccaaggtgggcagatcacttgaggtcaggagttcaagaccagactggccaacatgctgaaacccagtctctactaaaaatacaaaaattatccaggcatggttgtgggtgcctgtaatcccagctactcaggaggctgaggcaggagaattgcttgaacctgggacacagagtttacagtgagcggagatggcaccgctgtacttcagcctggacaacagagcaagactcggtttcaaaaaaaaaaaaaaaaagtaatagtaaaatcaattacaggtacatttaactagtgcaggttgataaactatctggcccatcacttgcttttataaataaagttttattggacctagccatgcctcttcatgtacatatgtctgtggctgctatcatgccatcgtggcagagttgagtagtttcaaccaacaccatatgtcctgcaaagcctcaagtatttgcttgtggccctttacagaaaaagttgaccaactcctgtgctgacaaatgaaatagctcagataggcctgtcagctagggctccaacacaggattgcgaagtctcgcagcctctggccttgtttgcaatggttggataatttttcttcccattgtctaggccggaaggacttatgtgtttgagaggtttgtgttaggccattgatgacgcctcttttgaatgaaagggctgaccctctgaagtggctccagcccaggaaacaagccccttcctcttgtgtgtgtgtccttgccagagtgctggaactccgtgggtcctggatcattgttgtctgccttgtatattgcttccttcaattgaatttcagccctcaggttcccacagacagatcagtgttaatgatgttgataattatgataattatagataccctctgtagttaatttctatcaagcctaaaaatgtctctatcaaagaatctgatgtgttaccgacgtcatcctgtttatttcttgcaacagccttaagaaggaaggaagggactcttattaacaatcccccctccctttttttttttttttttttttttgagatagagtctcgctctgtcacctaggctggagttcagtggcacaatcttgactcactgcaaactcctcttgcgttcaagcgattctactgcctcagcctcccgagtagctgggattataggcaagcaccaccacacccgactaatttttgtatttttagtagagacgggtttcaccatgttggtcaggctggtcgtcttgaactcctgacctcaagtggtccacccacctcagcctctcaaagtgctgggattacaagcatcagccactgtgcttagccctattagaacttcctaatattcttgttttttttttttttttggacagagtctcactctgtcaaccagcctggagtgcagtggatctcagctcactgcaacctccacctcccaggttcaagtgattctcgtgcctcagccttctgagtagctgagtagctgggattacaggcgcccaccaccacgcccagctaatttctgtatttttagtagagtcggggttttaccatgttggccaggctggtcttgaactcctgacctcaaataatccacccacctcagcctcccaaagtgctgggattataggtgtgagcccccgcgcccagccccaagataattttcaagagtgatccatgccataaggaaaatgtaatgagataatgtgttagcttatgaatggagcaggaagggcgacttctgctggggaagtcagggaagatctgtgtaaggacctgaaggatgcaaaggagcaagtcacaaggggacaagggaccagggtgctccacccagaacagcttgtgcaaggtcctaaggtagggctgagcctgggtgtgtgtgggtgggaggtgcagaaaggaggccagcctgggagaagaatttagcaagactggcagggattagaccccccaaggcctgtagggagttggcttttattctgtatgcctgaactgtctcgtctgggagacggtagtcatctgtggctagtaaacattggaattgtgtcaggcacagtggctcatacttgtaatctcagcactttgggaggctgaggtgggaggatcgcttgagccaggagttcgagaccagcctgggcaacatagtgagaccccatttctacaaaaaattaaacacttagctgggcgtggtggcgcatgtccattattccagctacccaagaggccgaggtgggaggatcacctgagcccaggagattgaggctgcagtgaactgtcactgtgtcactgtaccccagaacctaagtgacagagccagaccccatcacacacccaaaaaagaaatcgttacacattttatccatatgacaaaatatcacaagtaccccataaatgtgtaaaatattctgtatcaatgtaaaactttttaaaaattttaaactgaaattaaaatgaaatgcagttaaaagttttgttccttggtaaaaattggagccctggtacactgttggtgggaatgtaaaatactgcagctaggctgggcacagtggctcacacctgtaattccagtactttggggggccagggtgagtggatcacttgaggtcaggagttcgagaccagcctggccaacacggtgaaaccccgtctctactaaaaatacaaaaaaattagcggggtgtggtggtgggcacctgtaatcccagctactcgaggctgaggcaggagaattccttgaacccaggaggtggaggttgcagtgagccgagatcgagtcactgcactccagcctgagtgacagagtgagactccatctcaaaataaattttttaaaaaagaataaatcctatattattccacttatatgaggttcctagagtcatcagagtcacagagacagaaagtaaaatgggatgtcgggcgcagtggctcacacctgtaatccctgcactttgggaggctgaggcaggaggatcacgaggttaggagttcaagaccagcccggccaacatggtgaaaccccatctctactaaaaatacaaaaattagctgggtgtggtggtgggcgtctgtaatcccagctactctggaggctgaggcaggagaatcacttgaacccgggaggcagaggttacagtgagctgagatcgcgccactgcaccccagcctgggcaacaaagcaagactccatctcaaaaaataaaaataaaaaaaaagaaaagaaaaagaaagtaaaatggcaggtgccaggagttggggaggaggatgagtgtgactgtttcatgggggcagagtttcagtttggttaaggtgagaaagttctggagatgggtggtggtgatggttgcatagccacataaaagtatttaataccactgaactatacatttaaacatgattacaatggtgaattttatgctatgtgtattttaccacaattaaaaaaaaaattggatttcctagttgcactaagcacattcagaagccacaggggagaagtggctactatgttggatggcccagatagagaacatttccgtcatcgcagaaatttcgaccagatggtgctgttcatatatggatgtagcttctggggccacttctgttccctgagtttggccggtgggatccactgtgctgagaatcacagtctggggatttggggtgaagaacactccccaactttctttcttattttttgttttgtttcattttttgttttgagacagagtctccctctgtcaccaaggctggagtgcagtggcatgatctcggctccctgcaacctcccctcccaggttcaagcgattctcctgcctcagcctcctgagtagctgggattacagacgcccaccaccacacccggctaattgtttgtatcatcagtagagatggggtttcaccatgttggccaggctggtctgaaactcctgacctcaggtgatccgcccaccttggcctcccaaagtgctaggattacaggcatgagccaccacaaccagccttttttttttccttccttccttccttttctctctctctttgtctctctctctctttttttttttttttttttttttgacagaattttgcacttgttgcccaggctggagtatagtggcacgatcatgactcactgcagcctccacctcccagattcaagtgattctcgtgcctcagcctcctgagcagctgggattacaggcatgcaccagcacacctagctaatttttgtatttttagtagagacagggtttcaccatgttgaccaggctggtctcaaactcctgacctcaggtgatccacccgcctcgacctcccaaattgctaggattacaggcatgagccaccacaccaagccacatttgcatgtttaagtaactaacatgtctcctccattagaccttgtgctcccaaaggcaggatctacagccactttttccccacagtggccacagtatctagattagtgcaagcaaatgtctgttgaagcaatcagtggtttgggggcaagttacttaacctccctgtacctcagtttccccatttgtaaaacaaaaaaataaaggagctaacagtgtatctacttcacatgtggggtgcagcagcatgctggagttggcttcctggagccagtggtgaaattttcaggcaattttgtgagccatttgttaaacatagatattcataaaaattacataaacctacagttaaacaaattacattaaaaacaaaagtttttaaattaacaaagctttttaaaagtaacaaatactcaaaactcaccacctcctaatatcatacgatgttttcctattatttgtgctgttgaggttatttactacttttgtgtcaatagtagatacattttgtgtatacttataaatactacttagaggaatgctactgtgtatcttttgtcagcttatgtttagtaacttcatgttggtggcctgaaatccaccactggtaggaatatttacaccatggaaatcggcaaatgctatataaatctgggcctccctgggcccctccctcaggcagctgttaaacatttacaagctcaccaatggtttggaggcttaaaccagttaatagatgtgtctgacatgtgggtaatgatgtagacgtgccgcttttactgttagtgtttggttggctttcactgtccgatccagaattgctgcatatgcagacaggaattggacaaagccatttatttatttatttatttatttatttatttatttatttatttccctctctctctctctctctctccagtttgcccgaccatctgtaagtcacacggctgcaccgccgaaggcctctgttgccacagcgagtgcctgggcaactgttctcagcccgacgaccccaccaagtgcgtggcctgccgcaacttctacctggacggcaggtgtgtggagacctgcccgcccccgtactaccacttccaggactggcgctgtgtgaacttcagcttctgccaggacctgcaccacaaatgcaagaactcgcggaggcagggctgccaccagtacgtcattcacaacaacaagtgcatccctgagtgtccctccgggtacacgatgaattccagcaagtgagttctggatgtgggtctggggggcagccgagaggagaaggaacgtggggttggttgtgacgatgccgcttgttaaaactgtgtgcaaacccagggttaattggctatgagtgaggtctctgctctcagatgctacttttgcaccctgttttggtcctgggcttgggagtgggagttgactacctttttctctaaaggaccagatagtatatacttctggcattgtgcccaccattctttttttttttttttgagatggagtcttgccgcaagactcccaagctggagtgcagtggcacgaacctggctcactgcaacctctgcctcctgggttcaagcgattttcctgcctcagcctcccaagcagctgggactgcaggtgcctgccaccatgcccggctaatttttgtatttttaatagagacagggtttcgccatgttggtcaggctggtctcgaactcccaacctcaggtggtccacctgccttggcctctcaaagtgctgtgattgcaggtgtgagccaccgcacccagtctggcattgtggacctcagttctaagctttctgtggttggcttcagaacaagaaaatataataaggacagagtccttggttttccctaaaatcctccacgtggcctgtcctcactgatgtagcttcatcattgtcacataaaggatataccaaggtctttcgtgtcttccctgacctgtagcctggtggtgtgccaagattagcccagaacatactgtctccaggaggaagagactcgcttctgcattattctcagggctttgctgttctctgaaggacagtataatcaaaccatttcctgccgtttgggtgagaaatagcagggttttctctcttcgacagagtcagatttcctacgcacatcgcagactttctgttcgtactgtgagcttcttccatgagctattttggggccgtaactgagttgcaaaaatctgtttcctggtttttgtattgaggttttatgttttgttttaaaacacacacacacacacacacacacacacacacacaccacaaaacaacacaaaaacaaatcagaaacagacacacatcaagaggccttgagctgacctgcttacgtaaagtatcttcctcttcagacttgagaattagccaagcgagagtgttggggtgggaaattgtatttccctgggtggagagggcgggaaggaaaacaagctgtaatttcagttcttatgactctttctttgagtgtttgtgaaacctgcaagtacaatatgttttgttttgctcgttgttgataaaaacctaccaaaaaaaccttttggctttattgaccaaaagggtctataaatcaccttttcataccagacagacttttgttttaggtttttttttttttttttttggccagtgtattcccaagattgaggaaatgaccatattccttttgattcatttctttctttttaaaatcacaattgaaataaaaaaaatgggttaatatcttctggcaagatgtttgtttaaaagacattggccttaaataaaaggcatttttccctcaccttaacaatggcctgagaaatatagcaacctcctttgattttctcactgatgatgcgggagatgctaaaacagaaaccctgagaaattgaccgcacatccttggtatctgggacctttcctgaacggaagaaaacaaaggagaggggggtgcattgtcaccgtattttattgcgtaggtttaaaaaaattaatatttttatttctgaagcttttaattaattaatttatttattttgagacagagcctcactctgtcacccaggctggagtgcagtggcatgatctcagctcactgcaacctctgccttccaggttcaagccattctcctgcctcagcctcccaagtagctgggattacaggtgtgaggcagcaagcctggccaatttttttttgtttgtgcttttgtttttttgagatggagtttcattcttgttgcccagactgaagtgcaatggtgcgatcttggctcactgcaactcagcctcccgggttcaagtgattctcctgccttagcctctaagtagctgggattacagacatctgtcaccatacccagctaaatttttcttgtatttttagtagagaccgggtttcatcatgttggccaggctggtcttgaactcctgacctcaagtgatccacccacctcggcctcccaaagtgctgggattacaggcatgagccaccgcacctggcctgaagcttttctttttatcttatgaaagacttaatcgtactgtggcattttctaatgtggtttgatatcaaatagggccagatgttttcttccattctggtggcttatctgggaaggagttcttgatgttttcagagcagagttctgggaacccatgttaaaaggccttggccaggcacagtggcttatgcctgtaatcccagcactttgggaggccgaagtggacggatcatctgagggcaggagttcaaggtcagcctggccaccacggtgaaaccccgtctttactaaaaatacaaaaacaaaaaaaaaattagctgggcatggtgatgcatacctgttatcccagctactcgggaggctgaggcatgagaattgcttgaacccaggaggcagaggttgcagtgagctgagatcacgccattgcacgttagcccccaggcaagtgtgacaagagtgaaactgcatctccaaaaaaaaaaaaaaaaaggtctcaccatctactgtcgttccaaagtacctgctgggatgtaatagcacagtgctgcttcctgagatgagaaggaccagatatttgtgatgaataaattttcaatgcgtatggggtatccactgggaaggggagaattacctaaaatccttgattcttcttggcctctctcacttcttcctattaagctgaggtctcaaatttgtctacacctccatctatttcaccatcatgtctggtctgacccagtccccttgaacaatctctttgctcctgcttccattctagtgacactggtaaaaagtggccacctgggccaggcgcggtggctcacgcctataaccccagcactttgggaggccgaggtgggtggatcacctgaggtcaggagttcgagaccagcctgaccaacatggtgaaaccccatctctactaaaaatacaaaaattagccaggcgtgggattacagtgggcgcctgtaatcccagctactcgggaggctgagacagcagaattgcttgaacccgggaggtggaggtcgcagtgagccgagagtgtgccactgcactgcagtctcggtgacagagtgagactctgtctcaaaagaaaaaataaaagtggtcatctgatcatatgccatgtccttccctaaaaccctccggtggcttcccaagaccaatggacagaatccaaactcctcatcgggagggctcggccagttctcattctcatttcattccggtgccccctggccgtggtggtcgttaccgcaggagcttttcctgcaacttgctacatccgctttcctctgtgcctttcaattagctgttccctcttcctataatgcttgtccctgcatttgagaatgatccactttttcccctcgtcatctagatggcagcttaaaagtcacctccttggcaaatccttcccgtctgagtcaatcatccgtgcactctctgtcacatcatttagttttaactcttcgatttgtcactagctgatatttttgtcttttttttttttttttgagacaaggtcttggtctgtcacccaggctagagtgcagtggcacccacatggctcactgtggtctcaaccccctgggctcaagagatcctcctgccacagcctcctgagtagctgggactatataggcacacaccaccacacctggctaaaaaaaaattctgtagtgttgggggtcttgctatattccccaggctcgtcttgaactcctgggtttaagtgatcctcccaccttggcttcccaaagtgctgagattacagggcctgagccactgtacctagcctttgttgtcaatttattcactctccccaaccagatgataagctttgtgagtgtatcagctagctcttgttgcgtaacaaaaccacctcagtgcttagtggcttaaaacactcctttaggagctctgatgatttcatgtgttgactgaaggtttgtctggcctgggcctgtttagctacggctgatggtttaggggagcctcttgtgtctttgatggtcagtgggggtctctctccataagtctcttaccccagcagccaggaagggcagacctcaatgttcaagtgcttttcaagcctcagcttgtatcacgtttgcaaatattccattggccaaagcaagccatatggccaagcccagattcaacaggtgggaacatagactccacttcttggtgggagaggctgcaaagaactcatggtcatttataatttcccactgggaaagcatattatctgctttgttcactcatgtataccggcagctgagaacgggggttggccaagggccagatagtaaatattttcagctctcagggccatatggtctctgttggagctacttaactctgcctttgcagcgtgaaagcagggttagacgatgtactaaccaataaatgtggccatattccaataggatattatttgcaaaaacaggtggcctactggatttggctcccagcccactgtttgccaactccaggcttagagcattgcctgccacataataagaatagaggcaataaaagaagtcaaacatttggtcagtattttgtttctgcctcagctgttctgccactacctgggtgtacttgcaacaccgttctgacaccatcctcctccaaagttagcatcagacgccacaagtttaaggctcagccctccatgagatttcccttgcttcagacactggcagcatcttggggatcccccagccacccacacttctgactaactggctctaaattgggggattcccacaaactgtttgggtttcataatttactagaaggaactcacagaatgaaaataaacctggccaggtgtggtggctcatgcctgtaatcccagcactttgggaggccatggtgggaggctcacttgagcccagaggttcgagaccagcctggacaacatagtgagatcccatctctacaaaaatttaaaaacattagccaggtgagggggtgcatgcctgtagtcccaggtacttgaggggcttaagcaggaggatcgcttgagcccaggagttcgaggctgcagtgagctaagattgtgccagtgcaccccagcccgggtggcagagcaagatcttgtctcaaatttaaaaaccctgctatacaattacagttttattataaaggatacacatacggcaagatctgggagagttctagatgcagaatttccatattgcctcctcgtggcaacagcatgtatcaccctcttgacatactggtgtgtccaccagctgggaagtactactgagcttcagcgtccagagtttttgtttgtttgtttgtttgttttgagacggagtctcactctgtcacccaggctggagtgcagtggctcaatctcagctcactgcaacctccacatcccaggttcaaacaattctcctgcctcagccccccgagtagctgggactacaggcatgcaccatcacgcacggctaatttttgtatttttagtagagacagggtttcaccatgttggccaggctggtctcaaactcctgacttcgtgattcacctgcctcagcctcccaaagtgctaggattacaggcgtgaggcactgcacccggcccagtatccagagttttaattggagtctcattccttaggcgtgattgattgaaatcattgaccatgtgattcaacactgccatttccagccccctcatctccctggaggtcctaaaagccccaaccctctgatcacagggttgttctttctggtgaccgccccccaccctcatgttatctaggcacccccccccccacaagtcaccccgacattcctaacactcctaacaaaagcattcctgtgactcagaaagttccaagggtttttgaagctctgtgccaagaaccgggatgaagaccagatacatactttatgatcctacagtcacaaaaatcactctgaagagttgaatacccaggagtgtgagaacaacagcagcagcaacaaggatgccaccaataaaaaatgacccttgtagcaacggataaaattgcgttctgtgtgcgaagtgcttttgtggtatgcttcattgagttcctcatcacaagctgtggcgttggtggtgttattttcagatgaagaaatggagactgtaacagttgggaatcttgtggtttcatgcaccagaaccccaactcaaattggcttaactggccgggcacggttgctcacacctgtaatcccagcactttgggaggccgaggcgggtggatcacctgaggttgggagttcgagaccagcctgaccaaaatggagaaaccctgtttctactaaaaaaaaaaaaaaaaaaaaaaaaatacaaaattagatggggcatggtggtgcatgcctgtaatcccagctactcgggaggctgaggcaggagaatcacttgaacctgggaggcggagcttgcagtgagccgagatcgtgccattgtactccagcctgggcaacaagagtgagactccatcttaaaaaaaacaaaaacaaaaacaaaacaaaaaaaccattgacttaaccaagattaaaggagtttgttggtacccataaccaaaaagttcagggagttggttcaggtatagctgtatcaagaagcttaagcgatgtacctgatcagtctccttcatctttattttcctctttgttggttttgttatcaggcagcttctccctcacccttcaccccatgctagcaagatggcaaaacccttagatactccagaaggaagacaatttccccttccagcatgttctagcaaaaccctcactgcactgacttaagttctgtacccaccacctctgagcccccacaggaatagaaggtggtgctcagcttggcttggatcttgtgcccatcctggatctagaagggctttggcaaccaagaactgatctcagagaccccgtgttggggaggactggttcccaaaggactcctgggggctgtgagtttgatggcatcaggctgcaggctggcaaaaccaaaggctgcccaagtcacttgccattaaacatggggtcatgttacagccgtagttgcatcacatcccacacagaacagcaaatgtcctgtctccttggagtagcaggttgaattctgccacgttggggtaactgtcagttctgccacatcaggcccatcatctcaaggtaacggcacattcttattaccacatgcattagtccatttctgcactgctataaagaatacatggaactgggtaatttataaagaaaagaggtttaattggctgacagttctgcaggctgtacgggaagcatagcagcttctgcttctggggagacctcaggaaacttacaatcgtggcggaaagcaaaggggaggtaggcacatcttacatgactgaaggaagagagaaagggggaaggtgctacatagttttgtttgtttgttttgagacagattctcactctgtcacccaggctgggctgcagtggcacaatctcggctcactgcagcctccacctcctgagttcaagcaattctcatgcctcagcctccccagtagctgggattacaggtgggcaccaccacacctggttaatttttgtatttttagtagagacggggtttcaccatgttggccaggctggtctcgaactcctggcctgaagtgatccgctcgccttggcctcccaaagtgccggaattacaggcatgagccaccatgcccggctggtgctacatacttttaaacaaccagatctcgtgagaactcactcactatacactgccaaggggtatggtgccagaccattcatgagaactccgcccaccatgatccagtcatctcccaccaggccccacctcccacattggggattacaatttgacatgagatttgggtggggacacagatccaaaacatatcgccacgataatgctatgagtcccattgctgtcacgcacagggtagatcatggtcctgcctccatgggatatggtgtgaatcccatcactgtggggtccagcaggagtcctgtcccatcactttggggtaaaatatgagtcttgtcactttggggtaaaagcaagaggacctgcaaccatagggtaatggcataattctctcacttaaggcagtggttcttttctggggacaatctggcatcctccctccccaggggacttttggcaatgttgggagactttttttttttttgagatggagtctgactgtgtctcccagctggagtgcagtggtgctatctcggctcactgcaacctctgcctcccaggttcaagcgattctcctacctcagcctcctgagtagctgagattataggcacgtgccaccacacccagctaatttttgtatttttagtagagacagggtttcaccatgttggccaggctggtcttgaactcctgacctcaggtgatctgcccgcctcggactcccaaagtgctgggattacaggcgtgagccactttgcctggcctggaggacatttttaattgccacaacttgtgggagggatgctactggcagctcgtgagtggagcctagggatgccgctcaatatcctccaatgcataggacgccacccccactaccacagtggagaattacttggccccaaatgtgaacaatgctgaggtcagaagaccttgccgtagcatgatggacttatgccatcacttgagaccctgcatagtgtgctgtcttcccaggctgatcttgaactcccaggctcaagcaaccctccctccttggcctctcaaagtgcaggaatgacaggcaggagccaccacgcccggctccagaatctacatttttaacaatcaagcgatatgtcctattgcagatcggcagactgtgttttcagaaatatcatctcaggcagaaagggccgggtgcagtggctcacacctgtaatcccagcactttgggaggccgaggcgggtggatcacttgaggtcaggagtttgagaccagcctggccaacatggtaaaaccccgtctctactcaaaaatacaaaaattagccaggcacggtggcgggcacctataatcccagctactgtggaggctgaggcaggagaatctcttgaacccagaaggcagaggttgcagtgagctgagatcgcaccactgcactccagcctgggcaacagagcgagactctgtcacacaaacacacacacacacacaaagaaataccatatcaggcagaaagatgcctgagatgtctgaaggaccttggataccgtgacacccccctcccctttctctttctctctctctctgctccgtccttagcttgctgtgcaccccatgcctgggtccctgtcccaaggtgtgccacctcctagaaggcgagaagaccatcgactcggtgacgtctgcccaggagctccgaggatgcaccgtcatcaacgggagtctgatcatcaacattcgaggaggcagtgagtgtctctgtgtgggcgtcgggggtgcctgttgggctccatgtccctctgagctgtgagcggggaagaaaagcagtgcagaccctgctgcgtgctcctacagcacttttaggatggtcgttcagtggctcccccatggatagaaccatgctgggagtctgcctcaaaacctgaaatgaacagctcagtcttggccttactaaccttgagattctcattttctactttgggagttggggcatcaggaatctgcatttacatttatttttatttttatttttatttttagagatggggtcttgctctattgcccaggctggagtacagtggggcaactctagctcactgtagcctcaaactcttgggctcatgcagtcctcctacctcagcctcccaagtagctgggagtacaggcaggtgtcactgtgccgggctaattttttttttttttaatttttttccagggccaggttctcactatgttgcccaggctggtctcaaactcctgggctcgagcaatcttcctgcctcagcctctcaaagtgcagggattacaggcatgagccaccccacctggctttggaatcgtcgtttttaacaatcaagcaatatgccctattgcagaactgcaggctgtgttttcagaaataaatctcagggccgggtgcagtggctcatgcctgtaatcccaacagtttgggaggccgaggcaggtggatcacgtgaggtgagaagtttaagaccagcctggccaacatggtgaaaccctgtctctactaaaaatacaaaaaaattagccaggcttggtggtgcgtgcctgtaatcccagctacgcaggaggctgaggcaggagaatcgtttgaactcaggaagtggaggttgcaatgagctgggatcgcgccactgcactctagcctgggcgacagagtgagactccatctcaaaaaaaaaaaaaaaaaaaaaaaaagccaggcgctgtggctcatgcctgtaatcccagcactttgggaggctgaggtgggcggatcacttgaggtcagaagtttgagaccagccaacatggtgaaaccttgtctctcctaaaaatacaaaaattagctgggcacggtggcacatgcctgtagtcctagctacttgggaggctgaggcaggagaatcacttgaacctgggaggcagaggttgcagtgagccgagatcacaccactgcactccagcctgggccatagaccaagactccatttcaaaaaaaaagaaaagaaataccatgtcaggcaaaaaggcattcctttgtttatttctttagcgaacatgtactgaatactcacagtgagtaagggaaagtccttaccttgatggatttttgcgcataagtaaatcgacagatattgtaaggtcaggttgtggtctgtgctgtgaagggaagtgcagcagggtaataggtggaatggaaatgggcaacttttccctataaagggctctttcatgaatatattcagcctggcaggccgggcagtctctgccgtaaccactcaactctgccgttgtaatatgaaaacagccatagacccatgtcagctagcaggcatggctttgttccaataaaactttatttacaaaacaggtagaatttggccagtgggctgtcatttgtcaacctctaaaatggagactaacaggggttgctatttttttttttttttgtagttttagtagagacagggtttcaccatgttggccagggtggtcttgaactcctgacctcaagtgatccacctgcctcgccctcccaaggtgctggtattacaggcatgagccaccagcaccaagctgggggttgctattttagagaagtctctggtatgggaaaggagggtttgagatgatgatggaacaagccaaggagatatatggtggaataatattctgagcaacagacgcagccagtgccaaggtcctggggcagaagtatgcttgacccatttaaggaatgctaaggacttcagattgtgttctaagcatgatgagttttgagctgggtatgtccagtcatttgcagcctgagggttatcttctcaccatggagaatcatgagaagattgaaatatgtctatagaaacccactggatattctctcctttccttagacaatctggcagctgagctagaagccaacctcggcctcattgaagaaatttcagggtatctaaaaatccgccgatcctacgctctggtgtcactttccttcttccggaagttacgtctgattcgaggagagaccttggaaattgggtacgtgggcctgattgtgtgtatggcctgagtgctaactaggaagttcgtgtattagaacaacttaaggatttttttggccaggtgtggtggctgatgcctgtaatcccagcattttaggaggccaacgtgggtgaatcacttgaggcggggagttcaagaccagcctggccaacatggtgaaaccctgtctctactaaaagtacaaaaattagccaagtgtgatagtgcatgcctgtaatcccagctacttgggaggctgaggcaggagaatagcttgaacctgggaggcagaggttgcagtgagccaagatcacactactgcactccagcctgggtgacagagtgagactctgtccaaaaaaaaaaaaagaaaagaaaaggaaaaacttaaggattttttaaaaatcaaataaaaacaaataaaaaacaaataaaagtatatctggcaaaacctcgggaaaaaagaacttggaatgtgcctaaaggtccatccagccaaaaattgtaaaagcttttttatagtcattcttgagaaacaaaagtgggagcagcccaaccttggtgcccatcctccaagggtacaggctggaatttttgctaaatttgctgtttgggctgcattgtgagtagagtttggcatgcataaaatgaacattccctcttagtcccggttgtccatcctaatttctgggatggactccatctcagtatattccagtatattccaaccttctccttgaggtcctagaaactctattagcaaaacagcagaaactcaaactagctagatcaagattgactcataggcaggaggtctgtggaagacccagattctttccatctttgtgctcctcatggtcacaagatggctgcctcagccccagcctcacatctgtagaacagacagcaaatggggaaagggacaaaaggacatgttaatcaacatgagctggtaagtgacttgagaaggtggtctaaacaatatagtttagactatattatctgtactccagcctaggcaccagagtgagaatccatctcaataaaacaaacaaacaaacaaacaaaaaccttcaatggctcctttctccttattaaggatggccacatgttcttggtcttggtctggcatgcaatatactagagggtctggtccattgcaactacagctatttcctgtcacctattggccaaaacaggctactttgctcttccctgaactcagcttaggtgcctctgtgttatcagtatttcccctatttgcagaaattggtttctgcaaaacctattcctcagtccatcacagactcaccacccctcttcaagactgagctgagcctccttcctggccatgaaaacttcctcaacttcctctgttatccacattcaacaaatatgtgttgagtatgtgccaagcaagtggagaggattaggcacgtagcactgaacaagatcaactccgagcatggccacaccatcttggagttgtagaagaccagccgttgaatgactagatgtgtgtgttttttccataggaactactccttctatgccttggacaaccagaacctaaggcagctctgggactggagcaaacacaacctcaccatcactcaggggaaactcttcttccactataaccccaaactctgcttgtcagaaatccacaagatggaagaagtttcaggaaccaaggggcgccaggagagaaacgacattgccctgaagaccaatggggaccaggcatcctgtaagtcactggtccccaacctttttggcatgagggaccggtgtagtggaagatggtttttccatggactggtggtgggtggggatggtttcagcatgattcaagtgcattacatttactatgcactttattcctattatgattacattgtaatatataatgaaagaattgtacaactcaccatcatgtagaatcaatgggaaccctgagcttgtgttcctgcaactagatggtcccagctgggggtgatgggagacagtgacagatcatcaggcattagattttcataaggagtgtgcagtctaggtacctcatgtacacagttcacaatagggttcacacccctgtgagaatctaatgccgccgctaatctgacaggaggcagaactcaggtggtcatgcaagcgatggggagtgactgtaaatacagatgaagcttcacttgctcacctatcactcacctcctgctgtacagccctgttcgtaacaggccatggataagtactggtctgtggcccaggggctggggacccctgctgtaagtggtccacaaaccagataatgtggctgtcctctctcatccatcacagtcacccccagggggtattacttccctctaacaactcactgtgtgataggctttcttactgagggcagattctgcacatttattaatattatcactatgcttactgtgccatatagtaccggatacgggatgaagtcatacaagcactgaatgaatggatgaatgaatgatggatgaatggatgacaccttcttatatgtgtatcaggctgatgctgaagacttcaaagttgagtaaaatacctatgtcagtctgcatctcctgggaagtgactgccaagttgaagttaggagtgcagaaaatgtattgagggtaatattcataaaatatgaaacagaggaagagcttcttttttttttttttttttttttgggacagagtcttgctctgtcacccagggctggagtgcagtggcgtgatcttgcctcactgcaacctccttcccctgggttcaggtaattatctcgcctcagcctccagaatagctgggattacaggcacatgccaccaagcccggctaatttttttttttgtatttttagtagagacagggttttgccatgttggccagggtggtcttgaactcctgacctcaggtgatcctcccgcctcggcctcccaaagtgctgagattacaggtgtgagtcaccacgctcagccatgaagagccttttgacaatagcgtgtgtctgacctctgtgaacagagagcgggaaggagggaggatagggctgggagagtctcagatggtgatgcatccctgagtcttggccaaacccagaaagagatcaaggccacggttgtctgcagggaagttctgcattgcaaagggacggccaggcatctaccaagctcagtcataggtgggggctgtccagggagagtcaggttttggctggaatgctacagcaggtcctgcagtttctgcagctgcaggctgcctgctgactgcacttccctgacagattctaaacagtgagctgccaagggcttctgggataccttcatggggagttagttacttatgtcaaaatgtagtgcaagggctgggcatggtggctcacgcctggaatcccagcactctgggaggccgaggcaggcagatcacttgaggtcaggagttcgagaccagcctggccaatgtggtgaaactccatctctactaaaaaaaaaaaatacaaaaactagctggacgtggtggtgggtgcctgtaatcccagctacttgagaggctgaggcatgagaattgcttaaacccggtaggtggactgcactccagccttggtgacagagcaagactgtctcaaaaaaaatgtagtgcaaggagagagagcgaggttggggtgaggtttaggagagggtttgtcttctaggcagagagaattacttagatgcgtctctccgatgtctaatgatctgcagggtctctaaactcacttggcataggtttatttgcactggagttgcacctccttccaggtcagtcttacaagtccatatgcgagacaacgttgtgtcaggacaaacatcacccttggaaatcccttcctccaataactattggccggttgtccttcttgcgcgggtacagactgcgcttattcagttgactgtctggctgagtcaagtcattggcttacgtgagtgtgagtggccaagttgcaaaactggctcttacctttgaatcttcccccattcatactcagccaggcacatggggaggagacccttaagggaatagcagcgtcacctctgccttctcacggtccctccaggaagtgtgggggtcccaggctttggtctgaaactacactgaaatagctcatttttgccttttgttttaacttttccaggtgaaaatgagttacttaaattttcttacattcggacatcttttgacaagatcttgctgagatgggagccgtactggccccccgacttccgagacctcttggggttcatgctgttctacaaagaggcgtaagtagaagagttagagagacgctgaggaggcgagggctggctggctctgtgcttgctacgtttgtgctccaatctgcccctcttgggttcctgtctatctccctcctcctcctggaataaatatcttaggttcctttttacaatctcaccagtcgatggcatgcaaagtcaatagtgtctgcttttatcaaatgcctaaaatggaagcagacagctttcccatagaagcccggactggccagtttcctggggcaatattctattttgccttgcctgtgtatgtctcatcagacatccttagtagtcaggagctcagtctactaagtggatgttatcaaatgtattgcttatctatttttcttttttatccccaattttttttttttttttgagacagagtcttgctctgttgcccagggtacagtgcagtggcagatcttggctcactgcaacctctgcctcccgggttcaagcagttctcctgcctcagtctcttgagtagctgagattatgggcatacaccatcacacgtagctaatttgtgtatttttgatagagacgggttttgccatgttggccaggctggtctcaaactcctgacctcaggtgatctgcccaccttggcctcccaaagtgctgggattacaggcatgagccaccgcacctgaccagtagtaatattaataatagttctagccctcaagatttaccttgtgccttgctgagcactgacacacagtctaatcttatcagtaacttgtgagggagctcctgctattactattattacagattgagtatccctaatctgaaaatctgaaatttataatgctccaaaatccaaagctttttgtgggccgacttgatactcaaaggagatgcttattggagcatttcagatttcagatttttagattagagatgctgaaccagtacaatgcaaattaactagtaaaatgcaaatatttcaaaaccccaaaatatccaaaatccaaaacacttctggtcccaagcatttatttatttatttatttatttatgtttttgaaacagagtctccctttgtcgcccaggctggagtgcagtggtgcgatctcagctgatgctacctctgcctcccgggttcaagcaattctcctgcctcaacctcctgaatagctgggattacaagcatctgccaccatgcccagataatttttgtatttttagtagagacggggtttcaccatgttggccaggctggtctcgaactcctgacttctggtgatccgccattctcggcctcccaaagtgctgggattacaggcgtgagccactgcacttggccaagtctcaagtgttttgaataagggatgcccaagctgtgttttttcattgagatgtcagggttgacagttcctttctctttggctgttcccgagttattttttcttgcggcattagattgttgggtgagtaacatgtgaccctatgggatgtaacttcccaggcctcatctgcacggcactcagtgtgacggtcttgtaagggtaactgccttctgctgttttgtcttgaaagcccttatcagaatgtgacggagttcgacgggcaggatgcatgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccagtgagtgtgtcttgggaatgtgaatttgtatgtgaatcagacctcttgcttttaacaggctgatgcagtgaggttgtataaaatgctccttgatatggttattggctttttttttttttttagacagggtcttactttgtcacccaggctagagtgcaatgcagtggggtgatcatggctcactgcagcctcaaactcctgggctcaagcaatccttctgcctcagcctcctaagtagaaggaactaccagagtataccaccatgtgtggcttttttttttttttttctttgagatgaagtctcactctgtcacccggactggagtgcaatggcatgatctcggctcactgcaacctccgcctcccaggttcaagtaattctcccacctcagcctcctgagtagctgggactacaggcatgcaccactatacccagctaatttttgtatttcttgtagagacagaacgttgctgtgttacccaggctggtcttgaacccctggcctcaagtgatcctcctgcctcggcctcccaaagtcctgggattagaagtgtgagccaccttgcccagtcagttattggcttttaaaggagctgggtattgaggcttatagtttcagacgaggcagtagcaacaagccacttgatgggaatatttatatttttcatcctattatgaaaaattgtcaaatattcacaacacagaacaaaaccccatagttagccgcctcccagcttcagcctttggtcatttttgtttcatctcgacgcctgttccctcttcccacttgttacttctttttgttttgttgtttgttttggcctggagtatttcacagcaatttaattatgtttgtttgtttgagatggagtctcactctgtcacccaggctggagtgcagtggcgccatctggactcactgcaacctccacctcccaggttcaagtgattctcctgcctcagcctcccaagttgctgggattacagcacacttggctaatttttgttttgttttgttttgttttttgagacagagtctcactctgtcactgaggctggagtgcagtggtgtgatctcagctcactgtaacctccccgtcccagttcaagtgattctcctgcctcagtctcccaagtagctgcaactacaggcgtgccaccacgcccagctaatttttgtatttttagtagagatgggatttcaccatgttggccaggatggtctcagtctcttgacctgcaatctgcccaccttggcctcccaaagtgctgggattacaggcataagccaccatgccagccttttttttttttttttttttttttgagatggagtttcgctcttgttgcctaggctggagtgcaatggccctatctcagctcactgcaacctctgcctcccgggttcaagcgattctcctgcctcagcctcccgagtaactgggattacatgcatgcaccaccacgattggcgaattttttttttttttttttttttgtagagacaaggtttctccatgttggtcaggctggtctcgaactccgagcctcaggtgatccgcctgcctcggcttcccaaagtgctgggattacaggcatgagccaccgcgcccagccatttttgtatttttaatagagatggggcttcaccatgttggccaggctgctctggaactcctgacctcaaatgatccgcccaccttggcctcccaaagtgctgggattacaggcatgagccactgggcccggcctaattatatttttgtaaaacctaagtgcttctcttatagcagtagttcccaaaggaggttaactgctctgccagggaacagctgccaatcaatgtctggagacatttttggttgttacagctgtggagatgaaaccactggcatttcgtgggcggaagccagagaggctgttccatgtcctgcaacacacaggatgcaccctccttcatgacaaagaattatccagtcctaaaagccaatagtactaagggtgagaaaccccgtcctgtaggctcaaattcaagctttttttttttttttttttttttttaacggagtttcactcttgtctctcaggctggagttcaatggcgcattctcagctcactgcaacctctgcccaggttcaagattctcctgcctcagcctcccaggaagctgagattacaggcgcccaccaccatgtccagctaattttttttttttttttttttttttttttttttagtagagatagggtttcaccatgttggccaggtgtagtctcgaactcctgatctcaggtgattcagatgattcgcccacctcggccttctaaagtgctgggattacaggcatgagccactgtgcctggcctcgaattcaaactttataaatcaaccctatcttcttcagttaatccccgctcattcatcctgtatcttttagtgacaccaaaagacttacagttttcagaaacttctagctcccaggtgtttggactccctccccatccccagctccctcggccacctccgttactttgggttttttgggttttgtttggttggttggtggtggttttttttttcttttttgttttgttttgttttgagacggactcttgctctgtcacccaggctggagtgcagtggcgcaatctcggctcactgcaagctccgcctcccaggttcacgccattctcctgcctcagcctcccaagtagctgggactacaggcgcccaccaccacacctggctaattttttgtatttttagtagagacggggtttcactgtgttaaccaggatggtctcgatctcctgacctcgtgatccgcctgccttggccgcccaaaatgctgggatgggtgccctcatgatgtctttaacttgtgtgtcccccgccatcctcccaccagctttctttgcacactgtttctcatgatggacccatttcctttctccctgacagacccctctgtgcccctggatccaatctcagtgtctaactcatcatcccagattattctgaagtggaaaccaccctccgaccccaatggcaacatcacccactacctggttttctgggagaggcaggcggaagacagtgagctgttcgagctggattattgcctcaaaggtgagtgcaggcagctgtgctaggatcggtggggtttgcacacgtgtgtctgatgcactttgcttcacctctagggaagcagctatctcttcctgtgtctcagtgtcggaaggcacacacacacacactccattctatctcatatgaaaacacacatacatgtttttatctatttatttatttattttattttttatttatttacttttttgagatggagtttcactcttgttgcccaggctggagtgcaatggcgcgaccttggctcatcgcaacctccacctctcgggttcaagtgattctcctgcatcagcctcccgagtagctgggattacaggcacgcgccaccacgcccggctaatttggtatttttagtagggacggggtttctccatgttggtcagcctggtctcaaactcccgacctcaggtgacctcaggtgatccacccaccttggcctcccaaagtgctgggattacaggcatgagccaccacacccggcctattttttttttttttttgagacagggtcttactctgttgcccaggctggagtgcagtggcatgatctctgctcactgcaacctccacctcccaggctcaagcaatcctcttgcctcagcctcatgagttgctggaacaccacaattgtctgcaggtgtgcaccagcatgcccaggtaatttttttttttttttttttttttgagacagggtctcactctgtcacccaggctggagtgcagtggcatgatctcggctcattgcaacttctgcctcccaggcgcaagcgattctcctgcctcaggctcctgagtagctgggactacaggcgcctgccaccacacccggctaatttttgtatttttagtagagatggggtttcaccatgttggccaggctggtcttgaactcctgacctcaaatgatccacccgcctcggcctcccaaagtgctgtgattacaggcatgagccaccacgcctggccctggctaatttttaaacttctttttgtagagatggagtctccttatattgcccaggctggtctcaaactcctggcttcaagcaattcacccccctcagcctcccaaagcgctgggattacaggcgtgagccactatgaccggctcatacatacacatttttaaacatcgtaacacaagcacgcactgaagacttgtgtcaaaaccagatttttcccatgtcttggcaccatttccctctgggattttctcctcttgtctctccttctttctccctccctgccttccttgttctcttcatccctcctcacactgatggggatgcagctgtgttaacccacgcaagacttctgtgcaaagctagaaacacaactaatggttattgacaaagtcagggaaggattttggccccactgagatcctttagttgtaaggatcgaaggcagcaagaattggttatctcatatcccccaccccatactttcaattaaaaatgtctgccaggcttggcgctcatgcctgtaatcccagcacattgggaggccaaggtgggaggatcactggaggccgggagtttgagaccagcctgggcaacatagcaagatcccatctctaaaaaaatttaaaaaaatggtggtgtacacctgtagtcccagttacttgggaggcccaggcgggaggatctcttgagcccaggagttcaagtctgcagtgagctatgattattccagtgcactccagcctgggtgacagagcgagaccctgtctctatatatataaaaaaaattatacaaaattaaaaaaaaaaggcattaagtgcattcacaatgttgtgcaatcattttattgtataaaaattataaataaaatttataaataattatataaataattttattataaaacttaatgacaaatttttcttaatcttgtttacttaatagacctccatccatctgaaggaaaatggaataatatttaaagtctcaaactagtgtgtatacattagtttaaaattattattattattattttctttttttttttttttgacacggagtctcactccgtcacccaggctggagtgcagtggcttgatcttggctcactgcaacctccgcctgctgggttcaagcgattcttgtgccttagcctcctgaatagctgggattacaggtgctgccactacaccggctaatttttgtatttttagtagagacggggtttcaccatgttggccagggtggtcttgaattcctgacctcaaatgatccacccgtctcagcctcccaaagtgctgggattacaggcgtgagccaccgcgcccagcctaaaattattttaacattgggtttttttagaacccaccaaactggagaagcatctgtcacttttttctttttctttttcttcttcttttttaagatggggtctcactctgttgtccaggctggagtgcagtggcacaatcatagctcactgcaggcttgaactcctgggctcaaacgatcttcccgcctcagcctcctgagtagctggactacacaggactacaggcctgagacactatacctggctaattatttaaaataattttttaggccgggcacagtggctcatgcctgtaatcccagcactttgggaggccgaggcgggtggatcaccaggggtcaggagtttgagaccaccctggccaatatggcaaaaccccgtctctactcaaaatacaaaaattagccaggcgtgggcctgtaatcccagctactcaggaggctgaggcagaagaatcgcttgaacccgggaggtggaggttgcaatgagccgagcttgcaccattgcactccagcctgggtaacaaaagcaaaactccatctaagaaaaataataataataaaaataataataattttttagaggtggggatcttgatatgttgcccagggtggtctcgaactcctgaccacaagcgatcctcctgcctcagcctcccaaagtgctggtattacagacctgagccactgcgctgggcccatttccttctttagttttggtttccttgtgcatcttgatgtatttttcttgagatattttctgttagtgatatcctcggtccatgaccctggaggagaaggccagggggccactggcgaggtgtggctgaggccaggagctcaacatttgctcttggctctggccctgacctgctgaagggctttggctaagttcccaagcaagtcaccgtctgcctcctttttgggagaaggggcgggaggacagatgatctctgggagctgtcccagctctaagctcatatgctatatgtatgtgtgtgacatcatccccgcctgagccgagggttgcaaacgtgatttatctgctctgatgctttatataactccagggcgagtccagtcatcagctccgctgtaagctgttggccctgcattcaagtaaccagaaccacccgtgagagctgccaccagtaatgtcactcgaagcttccttttttttttttttaattccgaaagtctaaatctgtaattaccaagggaccatttaaacatggttttatttgtaattgtcacaaagttaatatcattaaaaggaaactcactaaggacaaattctgtgtgatttcactcctaggaggtccctagagtcctcagattcatagagacagaaagtagaatggggagtgccagggactgcggaggggacgggttgaggacagagtttcagtttgggaagatgagaaagttccggagatgatggtggtgatgattgcacaacattgtgaatgcacttaataccacagaactgcacacttaaaatggttgagatttaccgggcacagtggctcacgcctgtaatcccagcacactgggaggccgaggtggggtggatcactttgaggccaggagttcgagaccagcctgggcaacatggtgaaaccccgtctctactaaaaatacaaaaattagttgggtgtggtggtgggtgcctgtaatcccagctactcaggaggctgaggcaggagaatcgcttgaatctgggaggcagaggttgcagtgagccgagatcacgccattgcactccagcctggcaacagagcaagactccaccaaaaacaaaacaaaacaaaaattgagatggtaaattggtatattttatgtgatgcttatttttccacaatttcaaacacacacacacacaaataaataagcttacaaacccttcctgttaatatcactagtgtatatgttgttaccacggtaaaatatacatcacatacaatttattattataaccatgtttaagagcacagttgagctgcattaagtgcattgccgtggttgtgcggccattaccaccatcatctccagaactttctcatcttctcaaactgaaactctgtccccatgaaacactcactccccttctccttcccccagccccagcacccaccatcctcctttctgtctctgtgaatctgattctagagacttcattatgctcatttttcttttcttttctttttatttttttgagacggagtctcgctctgtcacccaggctggagttcagtggcgtgatctcggctcactgcaagctccgcctcccgggttcacgccattctcctgcgtcagcctcccgagtagctgggactacaggcgcccgccaccacgcccggctaattttttgtattttttagtagagacggggtttcaccatgttagccaggatggtctcgatctcctgacctcgtgatctgcccaccttggcctcccaacgtgctgggattacaggcgtgagtcaccgcgcctggcccattatgcttcatttttctaatctcaggaaaaccacagtgtaccatgtttcatgcagtggattctaggaagaggtagcaggtatcaggaatgatacctgtgcctgaacaaatatcccttcctctccaaataataataataataataataatagtaataataataataataccaggagcttcccttattcaggcagttctacatttttttttccatctgtaatgctgtaactagctcccatcagagttaacccaggcagggtattctatgtctatttataaacttaagaagtattttccagtctctcataggcttttaaagctgtgtaaatacttgggtttccgagtggatactcaccattcacaggaaggtacttgatacacgatttagagcttattgtctatcctcgaggcattaaggggaggagagaaaatggaatttcctttgctcagcagtcaccaggcaccaagcagggtggcagcaggggaggtggctctccagggactgttgcagattttgcttgtaaagagctgtgtccgtccatctcagtggctgtaccagaggcataactgtgcttgcaccgtgggtcacaagaaccctgggatttgacttcggggcttaagacatgaccagctgcggtacttaagtattgtaggctgggtgcgatggctcatgcctgtaatcccagcactttgggaggccaaggcgggcagatcgttcgagctcaggagtttgagatcagcctggccaacacagcaaaactctgtctctaccaaaaaaaaaaaaaaaaaaatacaaaaatcggctgggcgcagtggctcacgcctgtaatcccagcactttgggaggccaaggcgggtggatcacctgaggtcgggagatcaagaccagcctggccaacatggcaaaaccccgtctctaataaaaatacaaaaaaaatgccaggcgcagtggctcaagcctataatcccagcactttgggaggctgaggcgggtggaccacctgaggtcaggagttcagaccagcctggccaacatggccaaaccccgtctctactaaaaatacaaaattagccgggcatggtggtgcacgcctgtagtcccagctacttgggaggctgaggcaggagaatggcgtgaacccgggaggcagagcttgcagtgagccgagatagcgccactgcagtccggcctgggcaacaagagcgagactccatcccaaaaaaacaaaaacaaaaaacaaacaaacaaacaaaaaattagccaggtgtgatggtgcatgcctgtaatcccagttacggggagtggagctgagacaggagaatcgcttgaacccaggaggcagaggttgcagtgagccaagattgcgccactgcactgcagcctgggcgacagagcaagaccccatctcaaaaaaaaaaaaaaaaaaaaaaaagagagaaatagtattgtattttgtatttttaggactgctacctttataagctactggtgttcttcttcatttattaatttttaaattcccttttctatgcatgtttgaaaagttccttcctctatctcctctcatgcctttaggtcagggtttctctgtcttggtgttttttctgtctggcgttggatcattctctggggtgggactgtcccgagcacttcagggtgctcagcagcatctctggtcttcacccattccatgctccaggaggacgccccagccaggtcctgacacctaaaaatatctccagatgttgcccaatgtccctagtaggagacaaaatcaccccctgggtgagaaccattcactgatcaagtctgatttctggactcatgaatggaccccttagaattccatgtggaggcccagtgtggtgacccaggcctgtaattccagcactttgggaggccgaggtgggcagatcacatgaggtcaggagttccagaccagcctggccaacatgatgaaactctgtctctgctaaaaatacaaaacattagccagggtggtggcaggcgcctgtaatcccagctacttgagaggctgaggcaggagactcacttgaatccaggaggcggaggctgcagtgagccaagatcacgccactgcactccagcctgggcgacagagcaagactgtctcaaaaaaaaaaaaaaaaaaaaaaaaaaaagaattccatatggcattctactctgccctcccatcttatttgtgtggttgattaattgattgattgatattttcatgcagctgtgacctggctccttctcctcctccttcttctccttcttctttctttttcttcttcttcaacatgatttcactctgttgcccaggctggagtgcagtggcgattcataggcatggtcctcatgggctacagcctcagactcaaacctcagcctgagtagctaggactccatgggtgcactgcgccgggctcagcaccccacagtggtgagagttgttacggtgatttagtgtggccgtcggttactcaggtagacttggtttgttgtccttgactgctgcaccgtcctccatagcatgcatttaagatccacattttatatttgattccctaaataatgagacagcttcttgtaatcacaaacgtgatccaaacatgatcacgatgaaccatccgtttctagggtttgtgtgagaactttcctatgcttgggaatggagtcactggcccgtaaatctgtgcttaatttttttttttttttttttgagtccaagtctcgctctcagtctcgctttgcccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtgtgtggtgtgtgtgtgtgtggggtgtgtgtgtgtgtgtatgtgtgttcagccgcagagacttgagccccccttttctgtttctttctccagggctgaagctgccctcgaggacctggtctccaccattcgagtctgaagattctcagaagcacaaccagagtgagtatgaggattcggccggcgaatgctgctcctgtccaaagacagactctcagatcctgaaggagctggaggagtcctcgtttaggaagacgtttgaggattacctgcacaacgtggttttcgtccccaggtcaggacttggcgctgggctctcttagtgggtgccaattggcttggtgttggtggaaggtcattacttagggaccgagaggtagtgggacccagagacggcagaagggtgggtggagtctgaatggagccctttcctgggtggaggaagagatcttgcagtttcgaaatttcgaggggaattttatcaggaagagcaaataatcgcacaaaaggggaaaaatggacaaaactcagcatttgcctttcttacctctcctgagctggtctccacgtgagttccaaaacaaactccgttagacgattaacatttttttttttctctctctctcttttttttttttttttgacagagtctcactctatcgtccaggctggagtgcggtggtgcgatttcagctcaccctttccgggttcgagtgattcttgtgcctcagcctcccaagtagctgggactacaggtgcgcagcaccacgcccagctaatttttatatttttagtagagacggggttttgccatgttggctaggctggtctctaacccctgacctcaggtgatctgcctgcctcggcctcccagagtgctgggattataggtgtgagccaccgtgcctggccgtgattattgaggctttagctgagcgcagtggtgtaagcctgtggtcccagctagttgggaagccgaggtggtagggttgcttgaggccagcctgggcaacataatgagaccccatcgctaccaaaaaaaaaaaaaaacagtttaaaaattagtcaggcatggtaatgcatgtctgaactcctagcccatggggaggctgagaaagaaggatcacaagaggccaggagatggaggctacgataagcgatgatggcgccactgcgctccagcctgggtgacagagcgagaccctgtctctaaaaaaaaattaaaagtatctgttcagatgtttaccaatgctattcatccgagcagacttttctcccagaaccaccagtgtgtaagaatcctcttttttttttttcttttctttttctttttttgttgcatgtttcccctatgaccctgagtccaaaagaatgttcagggggacagccaaggcttcaaagtggttactgtttcacctgttacaaacaaaatgttggctgggcacagtggctcactcgtgtaatcccagcactttgggaggccgaagtgggagaatcagttgaggccaaaggtggagaccagcctgagcaacagagtgagaccctatctctactaaaaaaggaaaaaaaaaaaaaatagccagacatgttggtgcatgccttgtagtcccagctactccggaggctgaggcgggagaattgctggagcacaggagttggaggctgctgtgagctatgatggcaccattgcactccagcctgggcaacagagcaagaccctgtctcaaaaaggaaggaagggaaaaaaagaaagaaagaaaggaatggagggagggagggaaagaggaaggaaggaagagagaaagaaaaagaaagaaagaaagaaagaaagaaagaaaggaaagagagaaagaaaggacagagaaaggaagggggcaagggagggagagaggagggaaggaaggaaggaaaaaaggaaaagaaaaaagaaagagaaagaaaatgaaaagaagaaggaaggaaagagaaagaaagcaaatgaaggaaggaaagagggaaaaagagagaaagaaagtaaaagaggaaagaaggaaggaaggagagagagggagagagaaaaaagaaagagaaaagaaaaggagaaagaggaaagaaaccagaaagagagagagaaagaagaaagaagggaaagaaaagaaaaattctgccagacttggagaagtggctgagtcagttgtgatgtccacatgtagtcacgtttgacatcccagggccacctcagcaggccgtctctggggagaattttctctgatttcttccccttcccttgctggacccctgcacctgctggggaagatgtagctcactccgtctagcaagtgatgggagcgagtggtccagggtcaaagccagggtgcccttactcggacacatgtggcctccaagtgtcagagcccagtggtctgtctaatgaagttccctctgtcctcaaaggcgttggttttgtttccacagaaaaacctcttcaggcactggtgccgaggaccctaggtatgactcacctgtgcgacccctggtgcctgctccgcgcagggccggcggcgtgccaggcagatgcctcggagaacccaggggtttctctggctttttgcatgcggcgggcagctgtgctggagagcagatgcttcaccaattcagaaatccaatgccttcactctgaaatgaaatctgggcatgaatgtggggagaaaccttcactaacacactcttgctaaaacatagaatcatgggagtgcttcctgggtaccccctccctgccttctgtttgcagccactgtttgctcactaaacatctctgcacctcccgcgtgcatttgcagaggtgggtgggggtccccggagtctgagctccccgcggctgggtgccccgacccagcagctcctacaccatgaatggaggttgatctggaaacagaatattttcatgaaagggcgacagggtatgaacaaaagaacaccgtgtcgctcactgaattccacggaggagagtcagggatctcttccttccttccttccttccttctttctttttttccttctttcttttttccttctttcttttcttttctttcttccctccctctctccctccgtccgtccctccctcccttccttctttccttcttcttttttttttggatggaatttcactcttgttgcccaggctagagtgcagtggtgcgatctcggctctccacaacctccacctcccgggttcaagcaattctcctgcctcagcctcctgagtagctgggattacaggcatgcgccaccacgcccggctaatttttgtacttttagtagagacagggtttctccatgttggtcaggctggtctcgatctcccgacctcaggcgatccgcccgcctcggcctcccaaagtgctggaattacaggcgtgagccaccgcccctggccagggacgtttcttttcaacttgagtcttaagagaatgaagcagtatggtcctgggagagagaaaaagcttggagaacttgggagaaaggcaaggagatgtttacctgtcgtggcttttgggaggaacaggaggtgagactaaagaggcaagttgggaccacttggagagattttcttcctttagcagagtgtttatttatttattttttcccaggcacctgtgtggcctgatctgccctctagtggccatttgcaatactaactgtagccaagaagggtctaaaaatgtacgggcttggtccaaagcagatctcaatctcagtcctgctattaataatattcgggtggctcacgcctgtaatcccagcactttgggaggccgaggcgggcggatcatgagatcagaagatcgagaccatcctggctaacacggtgaaaccccgtcactactaaaaatacaagaaattagctgggcgtggtgacgcagctaccccaggcggggcaatcacttgaggccaggagttcgagaccagcctgaccaagatggtgaaaccccgttactacaagaaacataaaaattagccgggcgtggtgacacacgcctgtagtcccagctactcgggaggctgaggcaggagaatggcgtgaacctgggacgcggagcttgcagtgagccaagatcgtgccactgcactccagcctgggccacagagcgagactccgtctcaaaaaaaataaaaataaaataatatttggggccacagctggacttggtagctcacgcctgtaatcccaacactttgagaggcccaggcggggcaatcacttgaggccaggagttcgagaccagcctgaccaagatggtgaaaccccgttactacaagaaatataaaaattagccgggcatggtgacacacgcctgtagtcccagctacttgggaggccgaggcaggagaatcacttgatccctggaggcggaggttgcggtgagccgagatctcgccactgcattccagcctgggtgacagagcgagactctgtctcaaaaaaaaaaaaaaaaaaaaaagaataaatacataatactaataataataataaataatatttggggtcagattattctagggcactgtccaacaacactgagaagcatccctggcttccactcatctgatgccagtagtgtgtcttccccctaaagtagtaataaccaaaaatatcttcagacattgctaaatatccccctgggtgatggggtcagaaggacccttggttgagatgaccaggttagtgtgggattgctggataataaaatgctgcctaggccaggtgctgtggctcatgcctgatgcctgtaatcccagcactttgggaggcccaggcaggcagatcacctgaggtcaagagtttgaaaccagcctgggcaacatggcgaaaccccgtctctactaaaaatacaaaaattagccgggcatgatgatgcacgcctgtaatcccagctacttgggaggctgaggcaggagaatcgcttgaacccagaaattggaagttacagtgagccaagatcacaccactgcactccagcctgggcaacagagcaagactctgtctcaaaaaaaaaaatcagttgatgctttgtcttttgccacttcatggtctttttggttataatctttttggtatataaactcatttggcctgtttgatgagcccattttacatctctggttgttgagataccaatttctcagtagttattcatgaagcaccaacgtcttggttattttcacgagacccatttgtgcctgtatagaaattatctgaatcttgctaatacggacatatctttggcttgataagtggtggagctgttttcttttccattctacaatgttgttagtcttttaatacaaaaagaccataaagagaatcttaagaaatgcccccaaagtaggatttgttttctgaccacacattttctgatgacgctgcaatagaaactaaaagttaatttcaaaagattaaacagaaaacttcacttcttggtggttaaaagttaaacacttacaggctgggcgcagtgactcacacctgtaatcgcagcactttgggaggcccaggcaggcggatcacctgaggtcaggagtttgagaccagcctggccaatatggtgaaaccccttctctactaaaaatacaaaaattagccagatgtggtaacgtgcgcctgtagtcccagctactcaggagactgaggcagaagaatcacttgaacctgggaggtggaggttgcagtgagccgagatcacgccactgccctccagcctgggcaacagagcgagactctgtctaaaaaaaaaaaaagttaaaaagttaaacacttacatatctatcgggccaaagcagaaatggaaacttccattgaagtccttttggaaaataatgaaaatgtgaatatcacataccttaacttgtagaatattgtcaaagcttggctttgatgttacttagcagacttaaatggattgataaattaagaaataaactttaaactataaaactataaatgtgttaggaagggaaaagcaataacagctaagcctatggtaaacataatcaaagggaaaacacaaaccagaaggaaagaagatgacataaaactagcgtctgaagaaaattttaatgtgttaagttctttggacaatggtgcacttgctaaatttgaaagtttcagtaaggtgggaaaatttaacttgtctaaatggattcaaaaagaagcagaaaaattaagtggttatgaaccttggaaaaagatatgtgtcaaataatttcctcaaaaaagtcccttggcccagagagttttatagacacgttctttcaaattgtgagagagcaactatttcctataatagaaaaactattttagggcacagaaatctataaaagttatcccagttcattttatgaaatgaacataacacccttaaagaacttgacaaagaggttgagcatggtggctcatgcctgtaatcccagtactttgggaggctgaggtggggggcggatcacaaggtcaagagattgagaacattctggtcaacatggtgaaacactgtctctactaacaatacaaaaattagccagacatggtggcacacgcctgtaatcccagctacttgggaggctgagccaggagaatcgcttgaacctgggaggcagaggttgcagtgaaccgaggttgcgccattgcacactccagcctggcaacagagcgaaactctgtctcaaaaaaaaaaaaaaaaaaaaaggaacttgacaaagatactgcactgaacaaaagccacaggccaagctaatatgtgatgttagattcaaatgtcccaaataaaacactgcactggcaatattgtttatctccaaaatgcaaggatggtttaagatcagaagatttgataacatcatctagttcatcaagaggtgcaataaggaagatcatatctgtttcaataaccttaatttaaaattcctaacttagagaaaggggaggaaaaaaagaggcttcataaaactcataatagaatatttcttctacaagataaatattacctaggttaaaccaacagccaagctaacatcattcttaaaattattcttagcagagttaggaacaaaacaaggaagccccatctcatcattactaattaacatttctctgggcatccagccaatgtaataagacaagaaacagaaatcagagttgtaaagaatggaatgtgggaaataaagtcattgctatttgcagagcgtctagctcaagggtaggcaaactatggcccatgggctagctgcctgtttttgtaaatgaactcttattggaatgcaaccccacccacttgtttacacatcatgtagggctgctttaagctacaatgacagagtagttgtgacagaggtcatttggcttgcaaaacccaaaatatttattatctagccctttacgggaaaattttgttgacccctcttctagtgtgtcattgaaaacccaggaaagccaattatgaaactttttaaatgagttagagtttgggaaagtaggtacatagaaataagcaaaaagactgtagatacacaagcaataattagaatataaaataagggaaaagatccctttcaaaattgccgtaaaaccttagcacaactcataataaccccatctagaatgacttataaaggaacacgttttaaagtgttactgatatattaaattgtacaaataaacatgaaagcctgtttcaaatcatttaaagaaagcttactggcaaatggaaaagagtaagttgtatagcacgatacataaaaggttaatatccttaatgaataaacaacacaggagtaaggaaaacacaagaaattcatggaaaaacagacaaaagacaaggaggggacaattctttggagaatcacagagaaccaataaaggaaaaatgaagtcacactcagtaatataaagatccgcaaataacgtagtcgagtgatagcatatttttaatctcttgggttaaagatctagacaaacaaacatagaaagaaaaaaaaaaactattaaggcttaggggttgctgagattgtcctggaatgcagtctcatggcctgctggtgcaaccacaagtcaatatagagtttctggacaaccatttagctgtaggtattaagaagcttaaagagtttcttatctccctgaacctagtaatattttcctctaggaatctactttggggaagtaataagacaatcagacaatgatcaaaggaatatttataacagcaaaaaaaaaaaaaaagagccatgtgcggtggctcatgcctgtaatcctggcactttgggaggctgaggtgggcagatcacctgaggtcaggagtttgagaccagcctggccaacatggcgaaactccgtctctactaaaaatacaaaaattagctgggcatggtggcggactcctgtaatcccagctactcaggaggctgaggcaggagaatcgcatgaactcaggaggcggaggttgcagtgagccaagatcacgccgtcgcactccagcctgggcgacaagagtgaaactctgtctcaaaataaataaataaataaggaggatggttaagtgagtgacgactcacgtagcaaatggaatattttacagtcattcatcgttttccaagttttctgcagggaacacatgctacttttgtagatgatggaggaaaaccctaatattaaaaaggaaaagtcccaaaattctctcctaaaatgttatgttgaaaggaaaatatttagtaaatgcttccaatataataagtagacaaagtttacttataaaacaggcttgatcctcatcatgttcacacataatatttacagggaaaaaattgtccaaaggaagcagtgggctgtggatttatgagtgatttatattttcttttcttttttttttttttgagacagagtctcactctgtcgcccaggctggagtgcagtgacacgatctcagctcactgcaacctccgcctcccgggttcaagcaattctcttgcctcagcctcctgagtagctgggattaaagctgtgcaccatcaggctcggctaatttttgtatttttagtagagacggggtttccccatgttggccagactggtcttgaactcctaacctcaggttatctgcccgccttggcctcccaaagtactgggattataggcatgagccacctcgcccagcctacattttcttctttatccttttttctttgtattttaaaatttgttagctatcaacctttgttgtttaatatgtcttcttaagggatggggagaagtgtgccaattgcatagatgtttcttggagttaatcttcctgacctgagtgatgtgattccttttctaagaattgcagcttaatcactcaaattatacaggtgccctaagcagcaataagaaggaaaagatgtattttttcctatttaaactgatgatgtcgatcagtagcttgggccaatgagcaaatgccatttggcagggcttcctgaaaagctagactcttacgtgcttttggtgtcttatttttgtcactgaccctggctggcctatttatctgcaaaatgaaaaacctgaaatcgagcatgtcgaggggaatatcggtgtgtgtctaccattgacggtcttagaagcactcatccctcacgaggtgggcctgctctaatccttcagatgctcacaagggtatattgaaagctgctctgagtggtcattcctggcagtctgtattgtaatccatgttccccattgctgcaccctcctgcgctctgatctttcttcttaatcaagccttttattctccagtgtcacttttttaaaaaaaatgatggtgatggtgtcatcatacatgtcctactgtcgttccaggccatctcggaaacgcaggtcccttggcgatgttgggaatgtgacggtggccgtgcccacggtggcagctttccccaacacttcctcgaccagcgtgcccacgagtccggaggagcacaggccttttgagaaggtggtgaacaaggagtcgctggtcatctccggcttgcgacacttcacgggctatcgcatcgagctgcaggcttgcaaccaggacacccctgaggaacggtgcagtgtggcagcctacgtcagtgcgaggaccatgcctgaaggtagggctgctgctccggggtccgagtgtcatgggtgggacatcaaggctgaccaaggacagattctccaccctctaagcagtgcatatctgtattttaccttattggccttcatttttgtttgagacggagccttgctctgtcgcccaggctggagtacagtggtgcgacctcagctcactccagcctctgccacctatgtcaagtgattccctgcttcagcctcccaagtagctgggactacaggtgtctgccaccacgcccagctaatttttgtatttttagtagagatggggtttcaccatattgcccaggctggtcttgaactcctgggctcaagtgatccacccacatcggcctctcaaagtgctgggattacaggcatgagcaccgaacctggccttttttttttttttttttttttttgagatgaagtcttgctctgtcgcccaggctggagtacaatggcgcaatcttggctcactgcaatctccgcctccctggttcaagcaattctcctgcctcagcctcctgagtagctgggactacatgcgtgtgccaccacacctgtattttcagtagagatggttccaccatgttgcccaggctggtctccaatgcctgagctcaagtggtccgccaaccttgagctcccaaagtgctgggattacaggcatgagccaccatgccaggtcatattttaaaattatgagtcataggcaatcattatgtaaactttagaaaatacaccactgcactcccgcctgggtgacagagcaagactctgtctcaaaaaaaaaaaaaagttatacgcagaaagtaacccatttaatcttcctaacaatcttgtgggatgagttttagatgtccgttctctgacgaggaaaatgggttgtgggaaaatgacgtcaccagcccaaggttgcaccatggacaggtggcagaagtgggatctcatccaagagttacatccctgcctctcacttcctctccttacagccaaggctgatgacattgttggccctgtgacgcatgaaatctttgagaacaacgtcgtccacttgatgtggcaggagccgaaggagcccaatggtctgatcgtgctgtatgaagtgagttatcggcgatatggtgatgaggtaaggcccttgactcttgggcatgcccctgcacacttcagcatgccccttcagagttgcacttggtacctccttcctctgctgaaattttgattccagtgcttctctcatcaggtactgtgctattagtacttaaagccttgatacctgacttcgcaggaagatgggtcagaaatgccaatctaccagcttgttacttttcttagtttctcacattgctttccagctgtgtcctctaagttgaatgatgtctgcctcccaccacaacaggagactcatttcactttagaaggagttatttgagtcttaaaaccttataaattgctgggtacagtggctcacacctgtaatccaagcactttgggaggccgaggcaggcagatcacttgaggccaggagtttgagaccagcctggccaacatggtgaaaccccatctctacaaaaatacaaaaattagccaggcgtggtggtgggtgcctgtaatcccagctactcaggaggccaaggtgggaagctgaggcaggagaatcacttgaagccaggaggtggaggttgcagtgagcagagattgcaccattgcgctccagcctgggtgacagagtgagactctgtctcaaaaacagcaacaacaaaaaccttataagttactttcattagatgcttccattgagccagacaccatgcaaggtgctgggtgagtgcagagatgcacaagacatagaatccaagacaaataacccaaaagaacccaaacagttgctaagctcttcccagggctcactgtatgtcccaaacacattcagcacgttacacagagtatctcattgatcacattttattacctctaggaaattttgagaggccccattatttttatggacagctaggcaaaaaaaaaaaaagggccgttaattctaattttatttttttcgtagaatatagatcctgagtactgttaagtgtttgtaaaatgcattgcttgtaagatgcattccaatttcagaaatgccaaaatgcaaaaataatatacctcttgggactgaggaagtacaatacgtcctcacattatcccagtgagctgggtactgaggcttccagagtttaagttgctgcacaaaacctggaagaatagaatcatgatccaaatgcatgactgatatttcaatccagaaactgccaaattttttttaccataaaggtctggatagtaaacatgtttgactccgtggccagatgatttctgttacaactactcaattccaccattctactgagaaagctgccatgggtgatatgtaaatgaatggatgtggttgtgtgccaataaaactttatttacaaaaacacgtggtggaccaggtttagttggtgggccagagtttgccaacaactaacagagattacagcaaaatgtctgatttcctggaactttgagagggagtcctcctataaccaggtggacctccctctacccctcctgggaccacatctactcttggcaaccaaagattttggctttgacaataatttacaattgagatctaattctaaattattgtggcttgtgggccaaatctggcttgcagagcattgtaaagaatgtgcaacagggttgaggtcaggagttcaagaccagcctggccaacatggcgaaactccgtctctgctaaaaatacagaaattagctggacgtaatggtgggcgcctataatcccagctgctcctcgggaggctgaagcagggagaattgcttgaacccgggaggcaaaggttgcagtgagccaagatcgtgccactgcactccagcctgggcgacagaacaagactctgtctcaaaaaaaaaaaaaaaaaaaaagaatacgcaacagagactatatgtggcccttcacagcttcacagaaaaagtaaactttcaaaaatagaaagtgtccttactgaacttgtcattctgggcctattttggggccctgtttgctaaatgaatggcttgatttgccttttttaacattcatttttaaaataaaattgctaaatgaatggcttgatttgccttttttaatattcatttttaaaataaaattccttatcatacagagctcagctagtttttaattggcagaaacgtgcatatgcctctaatccatattcatgagttactttcctctgccttttgatgtctctgtccacaatagcctttggaattatgatttgtagttgctagatagaatttaatctcatgattggggtatcatttatttttggggatttggattgcctctggtttttaccatgttaggtaatactaattttatctggaaaccattttagctttttggattgacagctttagttattgtttcagtcagttcttgctgcgtaacaaactgcccccaaaggtactggtttaaaacaaaggacatttattctttctctcaattctgcaggttcactgggtgattcctttgtcctgggccagtttggctggggctggatggcctcattcacatggctggggcctcagctgggggcacttggagctttgtcctcatgtgttctctcactgcccagtgagctagcccaggcaaggaaggacatgccccatatacaaacacttcttaggactctgtttgcatcacatttgctagtgtccctttggcaaagtgagcccatggctaagcccagaatgaggaagtacaatacatcctctgagtatctcagtgagctggatactgaggcttccagagtctcatagacacagaaagtcatgattccctgggggccataattgcaaagtttattaatatattatcctatatgtattaatcctgtaggtcctaaggaaataattcaaatttggggcagggaacaaagctctatgcataagattttcatcagtagcaaaatatgcaaaccactaagatgtccatccattggagaatggacacatggaagacggtgcatccatagaattggtggatgaagagccattgaaaatgatgtttgggggccaagcatggtggctcatgcctgtaattccagtgactcaggaagctgaggtgggaggattgcttgaggccaggagtttgagcctgggcaacacagccagaccccatctctgcaaaaaaaaaatttcaaaattagctaggtgtggtggtctatgcctgtagtcccatctacttgggaggctgaggagagaattgcttgagctcaggagctccaggttatagtgggctgtgactcactcactacactgcagactgggtgacagagcaagaagactctgtctccaaaaaaataagataaaatgtttgggatgacctttgttcagtgtaatgtagaagttaaaattacatgctctggagtttagttcgtttgtgttgttatcccccagcagttaagaatccccctgtatctgctgggtgcagtggctcacgcctgtaatcccagcactttgggaggctgaggcgggtggatcatgaggtcaggagatcgagaccatcctggctaacacggtgaaaccccgtctctactaaaaatacaaaaaaattagccgggcatggtggcgggcgcctgtagtcccaactacttgggaggctgaggcaggagaatggcgtgaacccaggaggtggagcttgcagtgagccgagatcgcgccactgcactccagcctgggcgacagagtgagactccatctcaaaaaaaaaaaaaaagaaaaagaaaaaagaagaaaaaggaatccccctgtatccagactagcttatgatagaggaaaagcttcttagctcccagagttgaacaactgaagagcttctcacatggctggatccaggattcctttgggtcggttgcatcttttttttttttttttttttttttttgagatggagtctcactcactctgtcatcctgtcatccgggctggagtgcagtggtgcagtctcagctcactgcaacctctgcctccctgtttaagcgattctcctgcctcagcctcctgagtagctgggattacaggcacccacgaccacacccagctaatatttgtatttttaatggagacgaggtttcaccatgttggcctggctggtctcgagctcttaacctcaggtaatccacccaccttggcatcccaaagtgctgggattacaggcgtgagccaccatgcctagcctgggtcagttgcatcttaacggctcctggcagtgagcccagtagcccctggttgtccaccggtggttgtagtggttccaaacctcatttctttgcagtgccaaacccagaggaagacagagtgcatcccagcattcccagctagactgaggtcatgtgacatccagtgcccaatcatgtgaccagaggaatgctgtatgctgattggcttgggcatgagggattttttttttttttttaatttagaaacagctttattgagctgtaacttacataccataatattcactcccaccacatgctagagagaattttgtaaatggagtaaaattacactccaacagtataaattgtgcacataaaaataaagttttaggccaggagcagtggctcacgcctgtaatcctagtaccttcagaggccatggtgggtggatcacctgaggtcagggttcaagaccagcctggccagcatggtgaaacttcgtatctactaaaaatacaaaaattagccgggcgtggtggtgcacgcctgtaatcccaactactcgggaggctaagacaagagaatcacttgaacccgggaggcagaggttgcagtgattccgagatcacaccactgcactccagcctgggtgacagagtgagacaccatctcaatatatatatatatatgtaaataaataaataaagttttacatcactttttttcttgatcaaagcaatgctaggtaattaaggacattgttggcaataacagaaatgtgtctatgaaaaggttcttaagaaggtgactgtaacctcacattctcctttcattttctcccccatctctgcttctctctagggtgaacacagttggtctgggtgggattggggttgtgctgtgtggggcagaggctgttggggattcgtgatgggaattcctaatagtgacccttgggtcccaggaacaggagacacgggccagtcaaaggcatgggaagaagctaggagaagttaggattcgagttaaatccagtgccaacagggtgaccagttgtctaggtttagccaggactgagggctccctgggatgtgagattttcaatgtccacactcagaaagttctgggcaaatggggacaagttggacacagaagcagaaaaaaaatcaaggagggtctgcagtggaaacgggcattgttcactctgcagaatctgtattcttgctgtcaacaatgccccgaacttcctctggaatctgctcctcacccttgagtggctctcacctcccactctcaaccccagcctggtaccagggcaaaacacaaaactcagccccaaattagccatgacaaaaatgcaaatcaagaccacgatgcaataccacttcatgcccacgagcgtggcaaaaaacaaacagacggacaataacaagtgtcggtgaggatgaggagaaatcggaaccctcatacattgctggtgggaacataaaatggcacagctgctttaggaaagagtttggcatttctttcattctttcttttttttttttgagatggagtctatctctgtagcccaggctacggtgcattggtacgatcttggctcactgcaacctccgcttcctgggttcaagtgattctcctccctcagcctcttgagtatctgggactacaggaacccacgacctcgcccggctaatttttgtcttttagtagagacgaggtttcaccatgttggtcaggctggtctcaaactcctgacctcgtgatctgcccgcctcggccttccaaagtgctgggattataggcgtgaaccaccgtgcccagctggtggaaggtattttttttttcttttgctagtttcataaacaaagccacctctagctatttaattgcattttcagtatctcccgttaaaaaaattttttttttcagagacagagtcatggtgtgtcacccaggcccgccatccgccaccatgcccagataatttttttttttttttcaaacagagtcttgctttgttgcccaggctggagtctcgctttgtggcacacgcctataatcccagttactcaggaggctgaggcaggagaatcgcttgaactcgggaggcggaggtcgcagtgagccaagatcatgccactgcactccagcctgggtgacaagagcgaaactccgtctccaaaaaaaaaaaaaaaaaaaaaaaaaaagaagatgcatttcccctttgtcctggatagcagctaccttgggtttctatatttgcttatttgtccctctctactcggtgactcattccacttggaagaaactttggactggagttccctgcccccacccctgccaccagactgatttgttttcttgctgttattgtcacacgataagcatggggttgttggctttttttttttttttttttttaacatttctttctcttctccactctccacccccctcctaaatgttccagcccggttctctgcatgcactattagcttggaactgtgtcgaaaacttttcagagttttggctcgatgcttgcaggtttcatggtcttattcccaagagcctcctgtctcttctcataagttctggaattatctctagttacgtgcttatcacagggtatgtttcccactttgcaaatctccatttgggtggatcccaactgttttatttatttatttattattttattttatgtgtttatttttgaggcaaagtataccacattttctttttctttttgagacagtcttgctctgttgcccaggctggagtgcagtgtcacgatctcgactcactacaaactctgcctcccgggttcaagtgattctcctgcctcagcctctcgagtagctgggattacaggcgcacaccaccacaactggctaatttttgtatttttagtggagacggggtttcaccatgttggcaaggatggtctcaatctcttgacctcgtgatctgcccgccttggcccctgaaagtgctggaattacaggcatgagccaccgtgcccgggcttcaactgtttttataatgattaaaaaaaaaaaaaatcgaaaggcagcaccgtggcaaagaaagagcttttttatttgtccttagacattaagcccatttatccatttggttctgatgtgacagaggctgggagttgcagggaaaggcaggaaatctggcataggccctgcagatccttcatttccactcttttctaattttgctggatacatggcaaaaatattctgcagtggtcttaaggagaagttctagagccagacagttctctttttttagtttctttctttttatttatttattttttttgagatggagtcttgctctgtcacccaggctggacttcagtggcgcgatctcggctcactacaagctccgcctcccgggttcacgccattctcctgcctcagcctcccaagtagctgtagagccagacagttctgagttcaagagctggccctgccactttgcagctatgagatctcggacaaaccatataatctcttaaaccaggggtcagtcagtaagctatatcccataggctaaatgtggcctgctgcctgatttctaatgatttgtgagctaggagtcacttttgcattttatttatttatgtatttatttttgagatggagtcttgctctgtcacccaggctggagtgcagtggcacaatcttggctcactgcaacctccacctcctgggttcaagtaattctcctgtctcaccctccgagtagctgggattacaggcgtgtgccgccatgcccagctaatttttgtattttgggtagaggtgggggtttcaccatcttgaccaggctggtctcgaactcctgacctcaggtgatccgcccacctcggcctcccaaagtattgggattacaggcatgagccaccacgccctgcccacttttgcattttaaaatgattaaaggaaaaacaaggagagacgtgaaccaaagggtgcaaagtttcagatgggaggaatacgttctaggaatccactgctctgtagatgaatggtgactatagctaataacacatattgcaaaatggctagaagaatagattttaaatgttctcacaacaaagaaataagtacatgaagtgatgaggatttaattagcttgttttaatcattccacaatttatactgtaacataactttacactgtaccccatacgtgtacacaactattatttttatttttgtttatttattttagagacagggtctagctctgtcacccaggctggagtacggtggagccttcatagctcactgcacccttgacctcctgggctcaagtgattcttccgccttagcctcctgagtagctgggactacaggtgcgaaccatcgtgcccggctaattgttctattttctgtggaaatggggtctggctatgttgcccaggttggtctctaactcctgggctccagcaatcctcccttcacggcctcccatagggctgggattacaggcacgagccactgtgcctgacctataatactgttgtcaattaaaaataaaacaaatgatttttagaaagataatattatggaaattaatattaatagaaaatagataatagggctgggagctgtggctcacgcctgtaatctcagcactttgggaggccgaggtgggcggatcacttgaggtcaggagtttgagaccagcctggccaacatggtaaaaccctgtctttactgaaaatacaaaattaggcaggcgcggtggtgagcgcctgtaatcccagctactcgggaggctgaggcaggagaatcacttgaacccgggaggcagaggttgcagtgagccgagattaagccattgcgctccagcctgggcaacaagagtgaaactccgtctggaaaaaaaaaaaaaaggaaaagaaaagaaaccatcagggtttaatgctcggcttctggcttaggaagtctggctcttaccgataatgataacctctgcatatatctttatccatagcactatggttataaaattctgcaattctcaaagtcgcttatgtgtcttagtctgtgctttgctgccttggcgtcatttctgagcaggatcctggctgtgagctccctgcgaggggtggacactcccagatgtgcaaagctcagccaccctccttctcctcctctcttcctcccaggagctgcatctctgcgtctcccgcaagcacttcgctctggaacggggctgcaggctgcgtgggctgtcaccggggaactacagcgtgcgaatccgggccacctcccttgcgggcaacggctcttggacggaacccacctatttctacgtgacagactattgtaagtctccatggcagcctcagctgactggggctgtgcttagcactgagcatggtgggacattgcaggggatgacttggagaggccgcaggtgctggccctggccttgactctcaggcctatcagctgctgcggtgcttgccctctttgatcctgcactttttttttttttgagatggaggcttgctttggagtgcactggcacaatctcagctcactgtagcctccgcctcccgggttcaagtgattctcccacctcagcctcacagtagctgggactacaggtgcccaccaccacgcccggctaattcttgtatttttagtagagatggcatttcaccatgttggccaggctggtctcaaactcctgacctcaagtgatccgcccgcctcggcctcccaaagtgctggaattacaggcatgagccaccatgcctggcctgatcctgcacttaaaaaaaaaaaaaaaaagtttcagaggtacttgtgcagttcattatataagtaaattgtggctgggcacggtggctcacacctgtaatcccagcactttgggaggccgaggcgggcagatcacaaggtcaggagatcgagaccatcctggccaacatggtgaaaccccatctctactaaaaatacaaaaataaattagccaggcatggtggcgggcgcctgtagtcccagctactcaggaggctgaggcaggagcctcaggaacccgggaagcagagcttgcagtgaaccgagatcgtgccactgcactccagcctgggcaacacagtgagactccgtctcaaaaaataaaataaaataagtaaattgggtgttgttgggggtttgctgtacagataattttgtcacccatgtaatcagcatagtacctgataggtcgttttttgatcctttccctcttctcacccaccactctcaagtaggcacctgtgttagtctgtacttacactgcaataaagaaatacctggccgggcacagtggctcacacctgtaatcccagcactttgggaggccgaggtgggcggatcacttgaggtcaggagttcgagaccagcctgaccaacatggtgaaaccccatctctacccaaaaatacaaaaattagctgggcatagtggtgtgcacccgcagtcccagctactcaggaggctgaggcaggagaatcacttgaacccgggaggcggaggttgcagtgagccgacatcacgccactgcactccagcctgggtgacagagtgagactctgtctcaaaaaataaaaaagaaagaaagagtgaaagagagagagaagaaaaagaaaaagaaagaaaaggaaagaaagagagaaaaagagagataaaagaaagaaaaagaaagaagagaagagagagaggaagaggaagaggtctgagactgggactcagtaatttataaagaaaagaggtttaattggctcccagttctgcaggcagtacaggaaccatgatgctggcatctgctcagcttctgaggaagcctcaagaaactttcaatcatggtggaaggtgaagtgggagcaaggtgttaagacggggagatggtgctacacacttcttaaacaaccagatcccatgagaacccacttattatacagtacccagtagggatgttgctaacccattagaaaccgcctccatgatccaatcacctcccacccggccactcctccaacattggggattacatttcaacaagagctttgggtggggacacagatccaaaccatagcagtcccggtgtctactgttcacttctttctgtccatgtgtggtcagtgtctcactctcacttatgggtgagaacatgaggtagttggttttctgtccctgtgttaattcaattaggataatcacctccagctccattcatgttgctgcaaagaacatgatctcattctttttcatggctgtgtagtattccatggtgtgtatgtataacattttctttatctggcaatcctgcacttcctcatctgtacatggagataataacagaaccacttcaggaggtggagggacattttaatgacacaaatgttaagtgcctggcacctgttgctagtgtctccatctttgttactagagtttttttggctagatgaggtggctcacacctgtaatcccagaactttgggaggctgaggcaacaggattgcttgaggacaggcattagagaccagcctgagcaacatagcgagactctgtctccacaaaaaaatacaaaaattagccagctatggtggtgcatgcttgtaatcccaggtacttgggaggctgagacagggggatcacttgggcccaggaatttgaggttgcggtgaactgtgattgtgccactatactccagcctgggtgacagagtaagaccctgtctctaaaaaataaaaattaaaagaagtttacatctgtcaaaagtcatgctgggatcgggactagctatgtaatttgcaagacccagtgaacaatgaaaatgcagaactccttgctttaaaattattaagaatttggccgggcacgttggctcacgcctgtcatcccagtactttcggaggctgaggcgggaggatcacctgaggtcaggagtttgaggccagcctggccagcaaggtgaaaccctgtctctattaaaaatacaaaaattagccgggtgtggtggtgcatgcctgtagtcccagctacttgggaggctgaggcaggagaatcacttgaacccgaaaggaggaggttccagtgagccgagatcgtgccactgaactctagcctgggtgtcagagcaagactctgtcacaaaaataagtaaataaataaaaattaaaataaaatgaataagcatttcagaggggcaacagcagagcattaaactgacagaaaagggtcctgcatccactgcctgagatgtgggagggatggaaatgagcagtgatttggggcaggggtggggaagagtgtgcttccagaatactgacctctgagcccactgcctggtcccactgcacctacgggactgtttcgggactgctggaaaatcaggatgtggaagagcagcagagaggttcatggacaagggagggaaggaacagggtggcccacccattccaggagtggatgtgatttttgatgtgaactttgttggaaacacattgatatgaaacatatattttcttattctatttcagtagacgtcccgtcaaatattgcaaaaattatcatcggccccctcatctttgtctttctcttcagtgttgtgattggaagtatttatctattcctgagaaagaggtgagttcagtgagttcagtggtgtgctgggaacagttggttctctgggggaaaacatgccttgatataggtataggcatatttaagtttattatgaattttgctgatataggatgtgtaacatgcaatttacagataattgtcataatatgatatacacaactctttattgtaaattccctctagacagttgattctcacagaatgtttttattgatttttttttttgcccaaacctttatatccgaagctaacctattattgcaattgataaacaagtaaagctccaatgtgaatgttgattaatttttcaaaatttacattaaggagtaggacttgactgggcacagtggctcacacctgtaatgctagcactttgggaggccaaggcgggtgaatcacctgaggtcaggagtttgagaccagcctggccaacatggtgaaacctcgtctctactaaaaatactaaaaaattaaccgggcatggtggtgggcgcctgtaatcccagctactcaggaggctgaggcaggagaattactgaaccctggtggcggaggttgcagtgagctgaaatcgcaccattgcattctagcctgggcgacagagggagactccgtctcgggaaaaaaaaaaaaagtaggacaaaactgaaataagacatatatgttcatcagtgatatgagtgacgtctttgctgagtcagatggtaatttttaaatatcagaagaacattttgtgccacatgcaacatcacagttgcagacatgacacgcttttaagtttaatctacatgattaaacatttttctcagctgggcacggtggctcacacctgtaatcccaacactttgggaggccgaggcgggcggatcatgaggtcaggagttcgagaccagcctgaccaacatggtgaaaccccgtctctactaaaaatacaaaaattagcaaggtgtggtgatgtgcgcctgtaatcccagcttctcaggaggctgaggcaggagaatcgcttgaacccaggaggcagaggttgcagtgagccgagatcgcaccattgcactccagcctgggcaacagagtgagactttgtctcaaaaacaaaacaaaacaaaaaaatatttttctcatcactttctcaagcctggacaaacaacagaacaacaaatccagtcctgagttatagcatttgccagtttctgtaatgtaaatattcccaggatgtctaaattcaagctgtagacataatattactgagtgcagtgttagaaagagatacataatagctccccattgaatccaccctatggatacaatatggtgtataaatgatataatgtaaataacctcaactgcattgatcatatttaaatgtagtatgagagttaggaagtgatgagttttgaacatgtattgtctttgcttttaggataatttatttaattgtaagcctctataatttatattttttgttctatttggaaggcattgtacaatttaatctttaatgatgcttgtatttaacaactggctcactagtttcctgaaaatttaataattgtttctcatcagtcgggatgagctcgctctagaacagtactgggtgagtggcttttaagtgttacatggatggccataaattatttaaaaagccagccagagccctgcatggtcgtgcatatctgtagtcccagccgctcgggaggatgaggcaggaggatcacttgagaccaagagttcaagaccagcctgggcaacatagtgagaccctgtctctatgaaattttacaaattagccaggtgtggtggtgagcacctgtattcccagctattcagaaagctgaagtgggaggatctctggagcccagaaggttaagactgcagtgagctatgattataccactgccctccagccacaacagagcaagactgcaactctgaaatgtaaaaacaaaaacaaaaacaaaacaaaaaaaaaaccacccagggagggatgagtgctcccatgttgatgcacttacatacctgtctgatgggcttccattcaaaacataaaggtcccccatccctgccctagactgcatctaggattatggggattctgctggtaagggctgccatttgccttggggagtcttgtatgaaacacctttctgcagagtcccatgagaatctcaagctaacgtgcctcgttttcctcctccaggcagccagatgggccgctgggaccgctttacgcttcttcaaaccctgagtatctcagtgccagtgatggtgagtaccatcccttccctgtgggtggccagaaccctactcatcagcttcctttgccttcaccattgagtgagagtgaaggatgggttccccagggaggccaagaaaagccctcttattcatttgagcttgccaaactgcccttgctgcagaaacctcattactgtgtgcatctggacacatggtatttggcacctgcctgaatgggctcatctagccggtctgggacccttgggcagggtcgaccacttgggctgggctcagctgggcggttcttctggtcttgcctggcttcacccatgtagctacattttgctggtgtgtcagctagcactcggtagtcttagatgatttcactcacatgtctggtggtcagcaggctgggtggtcccaaggtgggggccctaagctgggggaggctgagcctcactctgtccatctagcctcttaggctccagcaggctggctcaggcttcattccatggtcctctgttggttcctagtagcaagctccagggcaagctccagggcaacagtccattccaaatctctgcttggacaattcttgttgattcccattgaccaaaataactcacaaggccatgcccagggccaaggggtggtgagatagactccaccttttcatgggaagagctccaagtatcctggctttttttttccccaacctattacaacctgtcttccatccccttggcactttgcagaaacagtagtctcaggtgggaagtagcatcattccatagcaagggtctgaaatcagacaagaaggatggggatgcaggtttgcctcaggacatattggccaggatcttggaccagttgtggctccttccttgagtctctgccatgccctctccatgggtgcagatgcctgtcctgttctcggccatatgcccagtgcccggcatgggtcctggatcacagaactcatttcatgagtgttttcgagggggtttgggtgagggcttgggtggaaggtggctgcagacccccaagggatcctccaaggatgctgtgtagataagtaagaagtagtgtttccatgctctgtgtacgtgccggacgagtgggaggtgtctcgagagaagatcaccctccttcgagagctggggcagggctccttcggcatggtgtatgagggcaatgccagggacatcatcaagggtgaggcagagacccgcgtggcggtgaagacggtcaacgagtcagccagtctccgagagcggattgagttcctcaatgaggcctcggtcatgaagggcttcacctgccatcacgtggtgagtccagtgggggtgggacatgggctggctttcctgacccttccctttctctgcctcctcctcctgcacagagcgacagaggacacagggtgtaacctcctacccacccctcactccactaagcttcccatcctagaggtgtgaggagggatcattcccttctcaaatcccatcctctcccacttcgcctggaaccagactctatcactgtctcatcactttctggaatgtttcattgctttccagaatctttcatcactttctggaatcttccatcattttctggaatcttccaccactttccggaatcttccatcattttccacaatcttccattgctttttagactcttccatttcttgctttttcctggcacctttgtaacccaggaccacatagaggtccacctgataccacctgccctcgttcctactctcctttgaaggcagcaccaactcttcctgcctttctgctcctttgttcctctttgagtcctatgtgctttcatccttgccacacatatttatggggcatttaaagccctgctcttgtccctgtgatacagtggatacctgcccctgtagagcttccaaaacagcaggcggagacagactccaaaacctttatttttattttatttcatatatatatatatatatatatatatatatatatatatatatatatatattatttttttttttttttttttttttttttttatttttttttttttcctgaaacggagtctcgctttgttgtgcaggctggagtgcagtggcacaatctcagctcactgcaagctccacctcctggattcacactattctcctgcctcagcctcccgagtagctgggactacaggcgcctgctaccacgcctggctgattgttttttttttttttttttgagatggagtctcactctgtcacccaggctggagtgcagtggcatgatctcagctcactgcaacctctgcctgctgggttcaagcaattctcctgcctcagcctcccgagtagctgggactgcaggtgcctgccaccacgcccagctaatgctttttatacttttttttattagagacggggtttcaccatgctggccaggctggtcttgaactcctgacctcgtgatccacccgccttggcctcccaaagtgctgggattacaggcgtgagccaccacgcccagtgcctggctaatttttttgtattttcagtagagacggggtttcactgtgttagccaggatggtctcgatctcctgacctcatgatccgcctgccttggcctcccaaagtgctgggattacaggcgtgagccaccacgcccagcctatttttatatatttttaagacagagtctctctctgtcgcccagagtggagtgcagtggcacaatctcggctcactgcaacctctgcctcccaggttcaagcaattctcctgccgcggcctcctgagtagctgggataacaggagcccaccaccacacccagctaatttttgtatttttagtagagatggggtttcgccatgttggccaggctggtctcgaactcctgaattcaggtgatccaccggcctcagcctcccaaagtgctgggattacaggcataagccaccacccccagctgactccaaaccctttatacattaggagcaaatgctatggaaacatgaagaaagggaggaaaggagggttggacaggggtgtatttgagcaaagacttagaggacatgaggagctgggccctgtggatgtggcagggaacagagagccaggcagagggaatgattaaaatacaaaggcctggctgggtgcagtggctataatcccagcactttgggaggctgaggcaggcggatcaccagaggtcaggagttcaagaccagcctgaccaacatggagaaatcctgtctctactaaaaatacaaaaattagccgggtgtggaggcgggcacctgtaaccccagctactcgggagactgaggcaggagaattgcttgaacccgggaggcaaaggttgcagtgagccgagatcacgccactgcactctagcctgggtaacagcaagattccgtctcgaaaattaaaaaaaaaaaaatacaaaggcctatctgtctgctgtccgggcaggtatgtctgctctcctagaccagggctgagcacgctgcatccaggccacagggtgctgtgtgtgacatagacaccagggagggaggagaaccctggtgagtcgaatcacggaccctcctccaagaaccctggttgcttgctctgcaggtgcgcctcctgggagtggtgtccaagggccagcccacgctggtggtgatggagctgatggctcacggagacctgaagagctacctccgttctctgcggccagaggctgaggtaagctgcttcgggggacccagcggggtactcggtggagcacccgctcctggcctcctcggatcccagtgctgctgaaacaccaaccccgtgtttctgttttagaataatcctggccgccctccccctacccttcaagagatgattcagatggcggcagagattgctgacgggatggcctacctgaacgccaagaagtttgtgcatcgggacctggcagcgagaaactgcatggtcgcccatgattttactgtcaaaattggaggttcgtctggctttctgctttgaaaacataacgacccaggccaggtttgatttcagaaggaagttgtctataatgagccgttaagtcttttctgataatataaaggggcaagatacttcttttttttttgtggggttttttttgttttgttttgtctttttgtttttgagacggagtcttactctgtctgttgcccaggctggagtgcagtggtgtgatctcagctcactgcaacatccacctcccaggttcaagtgattcacctgcctcagccttccaagtagctgggactacaggtgtgcgccaccatgcctggctaatttttgtatttttagtggagatggggtttcatccatgttggccaggatagtcttgatctcctgacctcgtgatcctcctgcctcggcctcccaaagtgctgggattacaggcgtgagccactgcaccggctttttttttttttcttttttctgacatggagtcttgctctgtcgcccaggctggagtgcagtgacaggatctcggctcactgaacctccacctcttgggttcaagcgattctcctgcctcagcctcctgagtagctaggattacaggcgtgcgccaccacacccagctactttttgtatttttagtagagacggagtttcactgtgttggccaagatggtctcaaactcctgacctcatatgatccacctgtgttggcctcccaaagcactgggattacaggcatgagccactgtgcctggctgggcaagattttggatggggaccccccaccagctgtcatttaattgcatgtattgataaactcacttacccattcacttctttaaaagatatgtttgtaggaccgggggtcccgcctgtaatctcagtgctttggaagtccaatgtgtaaagactgcttgagtccaggagtttgagaccagcctgggcaacatagtgagactccatctccttgaaaagattttttaaaaagtggggtgtggtggtgcacacctgtggtcccagctactcaggaggctggggtgggaggattgcttgagcccaggaggtggaggctgcagtgagctgtgacagcatcactgcactccagcctgggtgacagtgagacgctatttcaaaaaacaaataaaaaaggaatatagaggggaccagagcagcgtgagatgtgaggatgaggagagaggcagaaaccagacccagaaggaccttgcgtgtcacagcaagtcatctcgacattatcttacattagcaaggggcagcaggaagtgatatgattctatttatgactcaaaaagacatctcctggccaggtgcggtggctcacccctgtaatcccagcactttgggaggctgaggtgggtagattacctgagatcaggagttcgagaccagcctggtcaacacggtgaaaccctgtctctactcaaaatacaaaacattagctagacatggtggcagacagctgtaatcctagctactcaggaggctgaggcaagagaattgcttgaatcagggaggtagaggttgcagtgagccaagattgcaccactgcactccagcctggaggacagagtgaggctccatatcaaagaaaaaaaaaaagaaaaatgtagcttctttgtgatttggtaccttcttttccctccctttaaacagtagcccatcttcccccttcacttccccatgcgtaccctcagaatccattcttactggatttggccaccacccaggtgagcgcagacgtgggccaggtgaacccctcttagggctctgtgagaggtggggcagtcaaggtggcagatgctaggaccaaggctgaaggttaagagcgtgtgaaccttttgtgttgtcagactttggaatgaccagagacatctatgaaacggattactaccggaaagggggcaagggtctgctccctgtacggtggatggcaccggagtccctgaaggatggggtcttcaccacttcttctgacatgtggtgagttgtgtgtggatgggtggatggacgctgggcttgaattccaggtgctagtgagagccaagagcgggggaaggaagcctgccatcctcctggacgccccatcaaggaaaggaaggcagcgtcctgtcttaggatcttcccacggctactcttatgtcctgactaatcctgtaggcattgtgaaccccgaaaatctgagacaggtctcagttaatttaggaagtttattttgccaaggttgaggacgtgtgcccgtggcacagcctcaggtggtcctgaggacaggtgcccaaggtggtcagagcacagtttggttttatacattttagggagacatgagacatcagtcaacatatataagatgaacattggttcggtctggaaagacgagacaactcgaagtggggagggagcttccaggttgtaggtagataagagacaaatggttgcattcttttgagtttctgatgcgcctctccaaaggagccaatcagatatgcaggtatctcagtgagcagagtggggactctgaatagaatgggaagcaggtttgtccaagcagttcctagctggactttttccttgagtttagtgatttgggagccccaaattgattttcctttcacagcatttatgaactgcagcatgaattgttttattaagtggctaaccatgttctagaaaccaagagatgtgtttgtgtgtgtgtttgtgtgtgtatgtgtgtgcatatgtgtgtttgtgtgtgtttgcatgtgtgtgcgtgtgtgtgtttgggtgtgtgtgtttgtgtgtgtatatgtgtttgtgtgtttgcatatttgtgtgtgcatgtgtgcgcatgcgtgtttgtgtgtatttgcatgtgtgtgcacgtgtatgtgcgtgtgtgtttgcatgtgtgtgtttgcatgtatgtgttggcatgtgtgtttgcgtgtgtgtgtgcgtttgcgtgtgtgtgtttgcgcgcgcgcgtgtgtgtgtgtgtctaaatggcttctttgttactactatcaactgtcatcggcaggtcctttggcgtggtcctttgggaaatcaccagcttggcagaacagccttaccaaggcctgtctaatgaacaggtgttgaaatttgtcatggatggagggtatctggatcaacccgacaactgtccagagagagtgtaagtgtagaaagggtttaaggtgtgtgaggtgttcgttgaaagggtattgccctttacacgtgtgcttggttttgcctttcctatgtctacacgctcaccgtgtttgcatgctgtatgttacaggtgtgtttgtgtttgcatagcttgtctttacatgcatgcttgcatttgcatattgcattgtggtacacacacttgagttcccatatgtgctacatgtacgcttacgtttgcatattatatatttacataggtatttatgtttgcatattatatgtttctgtgtgcatcagcatatcatggcacatgtacacctcatttacatattataagcacacatgtttacatattatgtctttacctgcctgcttgtgttcacaaatcatatgattttcttgcatattgtatctttggaaggttgcacaaaacacctatagcggtagttatcttgggagaagggaactggagacctggggttgggggagagagacctgtttgcctgttaatttttttttttttttttttttttttgagacggaatcttgctctgtcacccaggctggagtgcagtggtgcgagctcggctgacttcaagctccgcctcccgggttcacaccattctcttgcctcagcctcccgagtagctaggactacaggcacccaccaccgcgcctggctaatttttttttttttttgtatttttagtagaaatggggtttcaccgtggtctcgatctcctgacctcgtgatccacccaccttggcttcccaaagtgctgggattacagccgcctgttaattctttatacacttaaaattttgtcaggtagctgggcatgggtggctcacgcctgtaatcccaagcaatttgggagaccgaggtgaacgatcacctaaggtcaggagttcaagaccagcctggccaacatggtgaaaccccgcctctattaaaaatataaaaattacccaggcgcggtcgtgggcgcctgtaatcccagctactcaggaggctgaggcaggagaattgcttgaatcggggaggcagaggttgcagtgagcagagactgcaccattgcactgcagcatgggtgacagagtgagattctgtctcaaaaacaaacacagacacacaaaaattttgtcaggcatacatattatatattcccccctccaaatatatatgcatatgtacatatatatatatttagatgaagtctcgctgtgtcacccaggctggtagagcgcagtggcacaatcacagctcactgcaaccttgaactcctggactcagcctcctggctcaacctcccaaagtgctgggattactcttgagccagttttgaaatgaggaatcccttttcaaaaccatctttcaggctggacaggatggctcatgcctggaacctcagcactttgggaggttgaggcaggaggatggcttgagcccaggagttcaaggctgcaatgagctatgattgcgccactgcactccatcctgggtgacaaagtgagaaaccctgtctcaaaaaaaaaaaaaagcggccaggcatggtggctaacacctgtaatcccagcaccttgggaggccaaggtgggtggatcatttgagcctaggagtttgaggccagcctgggcaacatagcaaaaccctgtctctgcaaaaaatacaaaaattagctaggcatggtggtgcacacctgtggtcccagctacttgggaggccaaggtgagaggattgctcgagcctaggaggcagaggctgcagtgagctatgatcatgccactgcactccagcctgggtgacagaatgagacgctgtgtccaaaataagaagaagaaaagcaaaaagaaaacaccatctctcagcacctctagcaatgctatttctgccttgacaattgtccacacacacagccagcatctgatgtgagcacatgtggtccgtgggtgtcggctgcagggacaagagtgggggtttgggaggatgcgtggcagggcccccagactcacccaggacgtgtccttctgccccgcagcactgacctcatgcgcatgtgctggcaattcaaccccaagatgaggccaaccttcctggagattgtcaacctgctcaaggacgacctgcaccccagctttccagaggtgtcgttcttccacagcgaggagaacaaggctcccgagagtgaggagctggagatggagtttgaggacatggagaatgtgcccctggaccgttcctcgcactgtcagagggaggaggcggggggccgggatggagggtcctcgctgggtttcaagcggagctacgaggaacacatcccttacacacacatgaacggaggcaagaaaaacgggcggattctgaccttgcctcggtccaatccttcctaacagtgcctaccgtggcgggggcgggcaggggttcccattttcgctttcctctggtttgaaagcctctggaaaactcaggattctcacgactctaccatgtccaatggagttcagagatcgttcctatacatttctgttcatcttaaggtggactcgtttggttaccaatttaactagtcctgcagaggatttaactgtgaacctggagggcaaggggtttccacagttgctgctcctttggggcaacgacggtttcaaaccaggattttgtgttttttcgttccccccacccgcccccagcagatggaaagaaagcacctgtttttacaaattctttttttttttttttttttttgctggtgtctgagcttcagtataaaagacaaaacttcctgtttgtggaacaaaagttcgaaagaaaaaacaaaacaaaaacacccagccctgttccaggagaatttcaagttttacaggttgagcttcaagatggtttttttggttttttttttttctctcatccaggctgaaggattttttttttctttacaaaatgagttcctcaaattgaccaatagctgctgctttcatattttggataagggtctgtggtcccggcgtgtgctcacgtgtgtatgcacgtgtgtgtgtccattagacacggctgatgtgtgtgcaaagtatccatgcggagttgatgctttgggaattggctcatgaaggttcttctcaagggtgcgagctcatccccctctctccttccttcttattgactgggagactgtgctctcgacagattcttcttgtgtcagaagtctagcctcaggtttctaccctcccttcacattggtggccaagggaggagcatttcatttggagtgattatgaatcttttcaagaccaaaccaagctaggacattaaaaaaaaaaaaaagaaaaagaaagaaaaaacaaaatggaaaaaggaaaaaaaaaaagaactgagatgacagagttttgagaatatatttgtaccatatttaatttttaaagtctctggtattagcctcataagttattgactattccccggggttggcggggagtggggacatgagttggtctgcctgttgtggggccgggaaggggagggagtcaggcacaagtggcctctttgtttggtcttaaaggcatccatttctgggaatgaagccatgttcgctgctaacacttttggatgttgtgaggccacgtggagtgtgtgagagactaggttttatggatggtctggttcaggtaccaggtctgctggaaggttcctgttcggataagctggtagctacctagctctgagcctgccttcaagaacacctgtgttcatcctctgattctctgtgtgtacctcttgtggcgtttcctctcccgggtgtgaacatcctaaccgttattgtgcaaacccaagaacgtcagatcccaaagcacaacaacctggatggactttgggaacatctaagcaatgtaagagagaggtgcactgagagtacgtcttggtcccctccaccctgagagcatctgacggtcctcagtactgaactcccggaagctgctctgagcccggtgacctcatctgggccaggtgtggtgcctgagctgaatgctcaggtgcttacagtgttgcaatccctaagagagtagagtctggaggagaaaccgtgaaaaagaccttacacaccaccaagaacttccgaatgggcgtgaatccaccgtttcttctctttgcaaaaagaaccaccacagctgctcaaagaacacagtgaactcatcactttggttcatcaaaaaatcatcgcccatgcgttattcctgagtgcattttcttacaactttttgactgcttccttttcttcttctcttaagagttgtgggcttaagaatgggatagagtcataatggcaacctccaagccctctcaattcttgattaagaacacaggtagacatgaatcccaattgtctattgctatcttatttatatgattcgggaaaatacagcatgtaaaaatattgctgaggagcctcagtgattgggtacaagaagcaagagtacagaaattatttttgccaaatttattttgtaaatatgagggtctgtacctaaatttaaaaaaaaaaacacgtagaactaggtattttgttctcttcttagtaaatttgtagtggttgtatactacactagctgcaattttcacatttttctaattcagaaaggtttttcttatattaggggaaaaagtatttattttaatatataaaatcactctgaaaatcactctcataaaaaatggagcgcatgtaaatttttatcaaagaaaaataaacaggtgaatgggggatagtgattttcttttttcagcacagtctacctcagtgtattgttaagatgtgattcaatcatggacatctttgagatttcagaattctacctggaaccggtctgaatcagggaacgtgtgtatcagctgattcgaatgccagggaccagtaagaattttgagggagggagttgggatggagaaggtatggcctttatgcgagcatagatccttttcttcctggctggtaatattcttctctgaatttaatcttcctttaaaaaaaaatcctccatctattgtcactatgttccccaaacataaactaagttccaggctgtcatgatgtatctgatatatggggtaacccagcaaggtgtaccttcctttggtgagagatggctgccggggcaaagacgggctttgattcagagcaagcattcccacctgttccatggaatccccctgaagtgagcacaaaggtgccctgggctccctgatggtttatgcccactcctttcaggctggtgatgcaccttacacacaaacacctaatgcaatgtctttttaaattctccaagtgggatgggagcatgtgagggaaattccaatccaaaacccattaatgtgctgaacgctttttttttttttttttttttttttgcaacaacaccttggacctctgtgttggggtttgactgacctcaagctgatattattggaccttgtgcagctttgataacccatgtgagagtctaggcaggaccagtggggcccaaatcttgctgctcttgtacttttaggcactgcccttgcagactcacctttctccacctgccctggagaaaggtagggtgtgctgggcctgccccttgcaaatgggattcaccagtttcatttatttgactctactgccacagtgaaaagagcaaacagctattgggttgcaaacctcctttgacattaggaaatgttgactttgtaacaataaaactttggtcctagaaagacacggttgtcctgggagtttgtagtgttaagttgcaacaacaacaacaaaaagcaacaaaaccagcttaggataacactttttgttgcttgttcttaaagatgtctcactatgattaaaacccttttcattaatgtagtgaaagccacacaggagttccttcttccaggaggagaataccaagcacatcactttctctctgcatcagtgatgtcaaatacgcatcagaaaatgttcaggttttaggagctgtcctaggtgctgtttcatcattggaagcagtgagaaagagaagcactgctgcttgtctggatataggctgaggatgattgagagaagctgtgggaactgacacaagggtctgcataggtcatcctgtgaccctggggactatgttaccaactgacagacagatctttcactgtatcctagcagggcaggtagtccaccaagaaatgtgcttattggattgggaggtgtttatttgtagtctgctgtaacacgtgtgaaagagcaggagcgtcatcagcatatgacttgcgctggtcatccggtaaatggatgtgctgtagtcccagtgctaatcatttctctccttcacagtgggtggaagtttagggttaaatgtcctttgaatgtcacctggtgagtccttgacaccttaggctcttcagaaacaatggttttgttgaggatggggaacagggaatgccgattttatatacatggtacacagagaggggtgtcacttcagaaaatcttccagcatgttcttcagaatattaatttatatgcgaggtgaggttgggaatgaaaagaacaggtcagcacttttttttttcctagaacatacaaaagaacatggtggactttcagggagtgcaatggaaggtgaatatttccttaagggtccccgagaaatgggagtgaggggaggggacacaatggctttttgagcttacttttaccttctgatactagtcaaggtccagaaccagccaccagccaaatttctatctgggtgcgggccactgaaaatccttgttaaaaaccagatcacaaatctggggctcttggtcccattggagaaggaaggaagagcctcaaaataagtgtgcacccatgcacatattcaggaacagcttgtttagtctttacactttgcctgaaagttgcttctcctcgtccctttgtgtgcctgggtggcctcggccctgtgcgttggcaacgcaggatcaaatgtgctgcagcttttgcagaaaacaactcagaaacacaaaaccccccaacagctcaattattattttttcaatgttttcctacaagagccaagtagcaccatgtacagaagacgcctttttttttggaatattgaaatcgttctgcatgtaaaatatgggataatgacctgtttatattaaaattctgattaaattatctgagaatacgcttgtttttgtgtggtgtcccggtaaggacctgtcgtgtggtcgggggatgtggctatgagttgggctgtgttaaggaaaacctcttggaatatgtaggtgcctttttttagaggagaaaaacacctagattcttccacacatgaaaagggaggttaaatagttgctaccagcagagttgatgactcgtagggacatacttgtatggccaaactggtggtttaaatattgcactatttccataccatttggtaagtaagcgcttccccaagggctcccagacctccccatggtccaaccactaaagggttcactccgagaataccaatgaaccttcaagatcttgctctattctgacatgcgggaaactcatatgttaagtattttcaatgtcatcctgggagtggagacctgtcccaggttgggtggacaggtgagtgaccatgggttagaccatgggattgaaagccttttgaatagtctttcttgagtggcttaaaacagcaactgtttatttattttctttttttgtttgtttgtttttgtttttgttagtttgttttttgaaatggagtctcactctgtcacccaggctggaggacagtggtgcaatctcagctcactgcaacgctgtctccgggttcaagcaattctcctgcctcagcctcccaagtagctgggattacaggcatgtaccaccattcccagctaattttgtatttttagtttcatcatgttggccagactcgtctcaaactcctgacctcaggtgatccgcccgcctcagcctcccaaagtgctgagattacaggtgtgagccaccacacccagccttattattatcattatgatgattatttttgtatttttagtagagacgggttttcgccatgttgcccaggctggtctcgaactactgttctcaagcgatctgcccgcctcggcctcccaaagtgctgggattgcaggcatgagccacggtgcctggcctgtttcttacagttctatgtgttggttgggtggttcttccgggaacagcctcactcctgtgctgaggcctctgctgggagagccaggattgcttgtcttctaggaggttcactcaggcttgttcatatggtggtggttgcagggatacccagtcggaaggaacaaaaagcccccaaatgtaaatattttccaaacttctgctcgtgtggtatttgctactgtcccattgcccaaagtaagtcccatggccaaacccagagtcagctttggagaggactgtccaaggatgcagataaaaggtgatgtgaaccaactagagtccaatcctgcaataatcttccactcctttaccctcctatcattattattatatttttttaataatataaaagtgggccgggcgcggtggctcatgcctgtaatcctagcactttaggaggctgaggcgggccgatcacaaggtcaggagatcgagaccttggccaggagatcacctggccaacatggtgaaaccccgtctctactaaaaacacaaaaattagctgggcgtggtggcgggcgcctgtagtcccagctactcgggaggctgaggcaggagaatcgcttgaacctgggaggcagaggttgcagtgatctgagatcatgccactgtactccagcctgggcaacagagtgagactctgtctcaaaaataaaaaaaaaaatactactactactactaataataataatataaaggtaaagttctcactttaccatcctattattattattattccttgtttttgagatgggagaaatagcagtatggatgatgacagggataatccagtcatcagagggaaaagagatgaaggcaggggatcactagctctatgtccttaagcaaacaagtgacgatgagatctacggcacaggtggaggggttgaccttagctaaagtgcaaagtatgtgggctgtggaatctctctccctcccaaaggcaatggaactcaatccccaacccctccaggcggtctctggatttctccagaccacctacctccagctggcagtgttctgagctgggccatcgaaagttgaggttattgaatgtgtgtgtttccccattatcctgggagctttccagaggctgcatgaaagttgcgtctgaattcttcacattcctccaaactctggcccagagttccgcagtatggggttgttaaattagcctgaagacacacaaagcaactaactggctaagtggctggttttacaaagggcggtggtcctaaccctgggctctggaatcccaatggtcattccagctctctcccctcctcctttctgctcccagttctctgccatccagctagcaggctgatcatggcccacagaggccctaccctcctattattgacgatagaccttaccttatatgaccatggcaaagattaaatgaggtaacattgatctctcatgctcccttcaggatggacattcccatatccccaagtccctccaagttccctgttctccaagaaattgatgctactgcttatcggctgtggtggcagcgtaaattctgcttccctgggtttgtgaaattcaatgtgagtctcttggaaaatggaaaatgtttttcttccaaggaaagctcatcaaggaaggcatcagtctcagggagggtggacggccgtgtggtctctgtgcagaggagccacttggattccttgaaagccctggccaagtgatcacagcaccttttagcagggtagctggcgccctggcctggagtggggagtgtctgcactgggttcctggagcttcctcctgggccttgggtgcttatcagaatcccacttattaaaaacaaaggtgtgtctgtctaagccacacccaggcctcctccatgagcatctatggggcagggcctgggaacttgcattttaacaacttccccttcccccactggactcagctgactcaggacaagaacacgggaactttgcttccattctgcctttgcctgtgtaagggatccaaatatgccactccaaagtatgccacttttggccgggcacagtggctcacacctgtaatcccagcactttgggaggccaaggcaggcggatcacctgcggtcaggagttcgagaccagccaggccaacatggtgaaaccctgtctctaataaaaatacaaatattagctgggtgtggtggtgcacacctgtaatcccagctacttgggaggctgaggcaggagaatcgcttgaactcaggaggaggcaggagaatcacttgaacccgggaggcggaggttgcagtgagccgagatcacgccactgcactcaagcctggatgacagagcgagactctgtctaaaaaaaaaaaaaacacttcacaacaacaaagtatgccactttggcacattggttattttgagttaaaggtgcttgaaaaatagcaaacaagaaggacactctgactttcctttttcttcctgaaagcaggagatgaaactaccatactatattttgtccaacctagtacataagcattcagctccaactgcttctttaggtcttcgtttttcttacaaaatctcccctgcacatgtaaaaattactaaataaagaccaggcatagtgacccaggcctgtaattctaccactttgggaggtcagggcaggaggatcacttgaggccaggagttcacgaccagcctgggcaacatagagagaccctatctctacgaaaaattttacaaattagccaggcacagtggtgcacacctgtagtcccagctgctcagaggactgaagtgggaggactccttgagcccaggaattgcaggctgcagtgagctatgattgtgccactgtcctccagcctgggcgacaaagtgagacactgtccccaaaactaaacaaaaatcctcaactaaatgaaatgtgtatatttatcttgttaatctgtcttatgtcagtcccagtcagagactctaagagggtgagagggaaaggttacttcacctgacccccaaaatattatatttgtcttagtggctcaagtcagctcccggaagccctctgcctcattttgaaccatggctctcctatgattagttgtacgaatctccctgtgtatggggatgacagtggtccctgctccttacgggtgttgcgggatataaaataaatttgtggtgtgtgtaaagcacttacacagggcatggctaaagtaattgatggtgacagaaaccagatcatgggtttcctatggtgggggtaacgggatcttggttgtgaaaggggtacatgggaactttctggggtgatggacatgttctgtaccttgactgaggtagcaaatacatgggtatatgcatttatcagttcactgagctgtacgcttaaaacctatcccttttattgtatgtaaattatacctcagttaaaagaagttgcctggcacacagtaagcacttagtatgtgtcagctgttgcttccaccagcattaacatcatcaccatcataattatcaccatcatcatcatcatcaccatcatgatcgtgatcaccatcaccctcatcattatatcatcattaccatgctccatcactgtatcagcatcaccatatcattatcaccgtatcacatatcgtcagtatatcagggatccttagagtcgctgaagatgcagtggctgctttnnnnnnnnnnnnnnnnnnnnctgtgacgcttaaaacctatcccttttattgtatgtgaattatacctgaggtaaaagtaagttgcctggcacacagtaagcacttaggatgtgtcagctgttgcttccaccagcattaacatcatcaccatcataattatgcaccatcatgcatcatcatcaccatcatgatcgtgatcaccatcaccctgatcattatatcatcattaccatctccatcactgtcatcagcatcaccatcatcattatcaccgtcatcaccatcatcgtcaggatcatcaccatcatcaccataccatcatcatcagtatcatcaccatcatcaccatcatcaccatcctcatcaccttcaccatcatcaccatcaccctcatcatcattatattatcatcaccatatccatcactgtcatcatcatcatcaccatcattatcacggtcatcaccatcgtcaccataccatcatcatcatcatcactatcatcaccgtcaccatcctcatcaccatcgccatcatcacccttatcattatatcatcatcaccatctccatcactgtcatcatcaccatcatcagcactgccatcatcatcatcactatcatcaccatcatcaccatcttcattaccatcatcaccctcatcatcattatagcgtcatcatcatctccatcagctgtcatcatcaccatcatcattaacatcatcaccactatcaccatcatcaccatcaccataccttcatcattatcatcagtatcatcaccatcctcatcaccattaccatcgtcaccatcaccctcatcatcattatatcatcaccatcttcatcaccatcatcatcaccatcgccaccatcatcaccatcatcatcatcaccaccattatcaccatcaccataccatcttcaccatcatcattaccatcaccatcatcaccatcatcaccatcataatcatcacgcatcatcaccatcatcatcaccatcaccatcaccatcactataccatcatcattatctccatcatcaccatctccatcaccatcatcaccatcctatcaccatcaccatcatcatcatcaccatccttaccatcttcatcaccatcatcatcatcaccatctcatcaccatcaccctcattaccatcactatcatcgccatcatggtcattcttatcatcaccatcattatcttcatcattatctgatgcctcaggatcatttccagtgctggctactacccttggatctctgcctccttcttccacccttctagaagaaagaaatacttctctttcttctctttccctcttccctgctctctttcctgtatcttgttcagtgtgggcctcttctttgctgcctccaccctggcttccccttttcacttctccccttaattcccttcctctctctgtatttatctcactgtttctccttgtgttttgatttttttttgtttgcttgattgtttcttcatcaccctgctccctccttgtttctgtcctactttctacttcttgccactcttttatctctgttttatttatttcaagtctgcttcatcctctcctccatctttttctgtatctgccttctgctcttttctcctattctcttaatctttctccttctgtgtgcttccctttgtggtcagccatgtttctgcctctcttcatttgtgcttctcctctttttttcccttctctctccatcctcaccatctactcccctcttgcacccaccatggttccctcactttctttctttctttctttttctttctttcttttttttttttttttttttgagacagagtttcactcttgttgctcaggctggagtgcaatggcacaatctcagcttactgcaacctccccctccagggttcaagtgattctcctgcctcggccttctgagtagctgggattacaggcacctgccactatgcccagctaattgtttatatttttagtagagacggagtttcaccatgttggccaggctggtctcgaactcctgaccacaggtgcgcctgacctactttatttcttttatacattacttctgtatctccttaccccatctttccctctgtctttccttctatgtaggacttttctgtcttcccatttttttctctatttccccctctcctcctcccactcttgtcttatttttcttctctccctttgcttcccttgtgtgtgttccttagtttctctccttcttggtcactctctctgagttatttctccagttttggtctcacttgtttctctttttttgcttgtgtatttctgctacccaatcttcctgtcacactataatttgggctttgcttttctttctctctcatttcaccttcctcctcccactcatatctctgacctcctcccccttttctaccattctgtttctacctctacttctcttggggccttttttttttttatctatctgtatttgtaatttcctatatgtttgtctattgccttctcttcatccacccatccatctatctgtccttctttccttcctttctatccatccacccacccatttgtctgtatatccatcttgtctatccattcatcatctatccacctacctgtccattcatccacccatccatccatttatccatccacctatccatccatccatccattcatccatccatccatcatctatccctcttcttgtctgtccatcaatttatctgtctgcctgtcctttcatccaaggctcctacccagtggtaagaccctgacaggctgagaaagcaaggcacaggctttggtttcatagaccacagcctcacaaccagaggaggaactctggctgggctctgggttagaatggggatgtgggttgctgagacagtcagacttgggagccaggaaatgcaaattctggccttggctctgctccatgtgtgttctgcatgaccacagatgagacagtggtcatcaggatagtacacaagtgagagaaaacatcttcaaagtacttcacaaaagagggaagccataattttaatagggctgacatagttggtgggtggtttagactatgagtccatggtctaatgttctcaactgttgatctccaggctccttagaggttgctgacccatttcctgaagcataaccccaggagtgggaggccactgtgttggagtcactgtagtggattctgtagtggatgctgtagtggatgtggtgattgctgtggtggatccatgatgctgtagtggaggtagcagatgctgtagtggaggtagtggatgctgtagtggaggtagtggatattgaggtggaggtagcggatgctgtagtggatgctgtagtggatgcagcaagagccacggcacatccactgtcgtggatgctgtcatgcaccacccagatcacctcttcagaaccaagtgctcactcttccaacttccaggaaagttgtcttctgggggcggacaactgagtccctcttctggaactttcccaggcttaagggagctattttgtccaaggttattcccccttcccagagagcagccgcatttgatggttgatggggtatgacaggttggtccccgtgcctaaacaatgagatgaattcaactgtgcaaccccaatatattgaactcttagtccccaggacctcagaatgtggccttatttggaaatagggtttttctggggagtatttttgtttgtttgcttttgagatagagtttcgctcttgttgcccaggctggagtgcaatggagcaatctcagctcactgaaacctccgcctcctgggttcaagtgattctcctgcctcagcctcccaagtaggtgggattacaggcatgtgccaccatgcccggctaattttttattttcaatagagacaaggtttctccatgatgggcaggctggtctcgaactcccgacctcaggtgatctgcccgccttggcctcccaaagtgctgggattacaggcatgagccaccgcacccggccttgtattctttttttgtttttgagatggagtctcgcccttgttgcccaggttggagtgcagtggcacgatctcggctcattgcaatctctgcctcctgggttcaagcgattctcctgcctcagcctcccgagtagctgggactactggcatgtgccaccaagcccggctaattttgtttaatttttagcagagacagggttttgccatgttggccaggctggtctcaaactgctgacctcaagtgatcagcccaccttggcctcccaaagtgctgggattacaggtgtgtattcatctttttaaatgttgtgtagtaggactgtttttcaagataattagcctgccatactgcagacaagtctccttgtctcatattgatctttttttcttatgggcttcttcccagctgagtcaactttacattccagagaagaaagtgaaggccatcgattatgaaacttccattgctcactgtaatctgtgatcagaaagggagtggctcccttgtctgtggagttgaagagatttcccttgttcaaagtgagtaattgtaaattgcattctaggagaccaatgtattgttcttaatggaaggagtaaatgctaattggctcacatgtttaattggtgattattgttttcagaagacagacatatgttagccatcagcgcaatcatttggaaaagaggttaaagccattgaggaatgaaaatcattgaggaaaagagttaaagtcattgagcctggttacggccacgctcggtggctcacgcctgtaatcccagcactttgggaggccgaggcgtgtggatcacctgaggtcaggggtttgagaccctcctggccaacatggtgaaaccccatctctactaaaaatacaaaaatttgtggccgggcgcggtggctcatgcctgtaatcccaacactttgggaggccgaggtgggcggatcacctgaggtcgggagtttgagatcagcctgaccaacatggagaaactccatctctactaaaaatacaaaaaaaaaaaaaaaaaaaaagagctgggcgtggtggcacatgcctgtaatcccagctactaagggggcctgaggcaggagagttgtttgaaccggggaggtggagactgcagtgagctgagatcacgccactgcactccagcctgggcgacagaccacgactccatctcaaaacaaacaaaaaacaaagtgaataaattgtatagttgctctctaggagacaattgcattgttcttcatggaaggagttaatgcta

SEQ ID NO: 149 - DNA, 8849 bp, Homo sapiens
gtgtgtcccggcatggatatccggaacaacctcactaggttgcatgagctggagaattgctctgtcatcgaaggacacttgcagatactcttgatgttcaaaacgaggcccgaagatttccgagacctcagtttccccaaactcatcatgatcactgattacttgctgctcttccgggtctatgggctcgagagcctgaaggacctgttccccaacctcacggtcatccggggatcacgactgttctttaactacgcgctggtcatcttcgagatggttcacctcaaggaactcggcctctacaacctgatgaacatcacccggggttctgtccgcatcgagaagaacaatgagctctgttacttggccactatcgactggtcccgtatcctggattccgtggaggataattacatcgtgttgaacaaagatgacaacgaggagtgtggagacatctgtccgggtaccgcgaagggcaagaccaactgccccgccaccgtcatcaacgggcagtttgtcgaacgatgttggactcatagtcactgccagaaagtttgcccgaccatctgtaagtcacacggctgcaccgccgaaggcctctgttgccacagcgagtgcctgggcaactgttctcagcccgacgaccccaccaagtgcgtggcctgccgcaacttctacctggacggcaggtgtgtggagacctgcccgcccccgtactaccacttccaggactggcgctgtgtgaacttcagcttctgccaggacctgcaccacaaatgcaagaactcgcggaggcagggctgccaccagtacgtcattcacaacaacaagtgcatccctgagtgtccctccgggtacacgatgaattccagcaacttgctgtgcaccccatgcctgggtccctgtcccaaggtgtgccacctcctagaaggcgagaagaccatcgactcggtgacgtctgcccaggagctccgaggatgcaccgtcatcaacgggagtctgatcatcaacattcgaggaggcaacaatctggcagctgagctagaagccaacctcggcctcattgaagaaatttcagggtatctaaaaatccgccgatcctacgctctggtgtcactttccttcttccggaagttacgtctgattcgaggagagaccttggaaattgggaactactccttctatgccttggacaaccagaacctaaggcagctctgggactggagcaaacacaacctcaccatcactcaggggaaactcttcttccactataaccccaaactctgcttgtcagaaatccacaagatggaagaagtttcaggaaccaaggggcgccaggagagaaacgacattgccctgaagaccaatggggaccaggcatcctgtgaaaatgagttacttaaattttcttacattcggacatcttttgacaagatcttgctgagatgggagccgtactggccccccgacttccgagacctcttggggttcatgctgttctacaaagaggccccttatcagaatgtgacggagttcgacgggcaggatgcatgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccaacccctctgtgcccctggatccaatctcagtgtctaactcatcatcccagattattctgaagtggaaaccaccctccgaccccaatggcaacatcacccactacctggttttctgggagaggcaggcggaagacagtgagctgttcgagctggattattgcctcaaagggctgaagctgccctcgaggacctggtctccaccattcgagtctgaagattctcagaagcacaaccagagtgagtatgaggattcggccggcgaatgctgctcctgtccaaagacagactctcagatcctgaaggagctggaggagtcctcgtttaggaagacgtttgaggattacctgcacaacgtggttttcgtccccagaaaaacctcttcaggcactggtgccgaggaccctaggccatctcggaaacgcaggtcccttggcgatgttgggaatgtgacggtggccgtgcccacggtggcagctttccccaacacttcctcgaccagcgtgcccacgagtccggaggagcacaggccttttgagaaggtggtgaacaaggagtcgctggtcatctccggcttgcgacacttcacgggctatcgcatcgagctgcaggcttgcaaccaggacacccctgaggaacggtgcagtgtggcagcctacgtcagtgcgaggaccatgcctgaagccaaggctgatgacattgttggccctgtgacgcatgaaatctttgagaacaacgtcgtccacttgatgtggcaggagccgaaggagcccaatggtctgatcgtgctgtatgaagtgagttatcggcgatatggtgatgaggagctgcatctctgcgtctcccgcaagcacttcgctctggaacggggctgcaggctgcgtgggctgtcaccggggaactacagcgtgcgaatccgggccacctcccttgcgggcaacggctcttggacggaacccacctatttctacgtgacagactatttagacgtcccgtcaaatattgcaaaaattatcatcggccccctcatctttgtctttctcttcagtgttgtgattggaagtatttatctattcctgagaaagaggcagccagatgggccgctgggaccgctttacgcttcttcaaaccctgagtatctcagtgccagtgatgtgtttccatgctctgtgtacgtgccggacgagtgggaggtgtctcgagagaagatcaccctccttcgagagctggggcagggctccttcggcatggtgtatgagggcaatgccagggacatcatcaagggtgaggcagagacccgcgtggcggtgaagacggtcaacgagtcagccagtctccgagagcggattgagttcctcaatgaggcctcggtcatgaagggcttcacctgccatcacgtggtgcgcctcctgggagtggtgtccaagggccagcccacgctggtggtgatggagctgatggctcacggagacctgaagagctacctccgttctctgcggccagaggctgagaataatcctggccgccctccccctacccttcaagagatgattcagatggcggcagagattgctgacgggatggcctacctgaacgccaagaagtttgtgcatcgggacctggcagcgagaaactgcatggtcgcccatgattttactgtcaaaattggagactttggaatgaccagagacatctatgaaacggattactaccggaaagggggcaagggtctgctccctgtacggtggatggcaccggagtccctgaaggatggggtcttcaccacttcttctgacatgtggtcctttggcgtggtcctttgggaaatcaccagcttggcagaacagccttaccaaggcctgtctaatgaacaggtgttgaaatttgtcatggatggagggtatctggatcaacccgacaactgtccagagagagtcactgacctcatgcgcatgtgctggcaattcaaccccaagatgaggccaaccttcctggagattgtcaacctgctcaaggacgacctgcaccccagctttccagaggtgtcgttcttccacagcgaggagaacaaggctcccgagagtgaggagctggagatggagtttgaggacatggagaatgtgcccctggaccgttcctcgcactgtcagagggaggaggcggggggccgggatggagggtcctcgctgggtttcaagcggagctacgaggaacacatcccttacacacacatgaacggaggcaagaaaaacgggcggattctgaccttgcctcggtccaatccttcctaacagtgcctaccgtggcgggggcgggcaggggttcccattttcgctttcctctggtttgaaagcctctggaaaactcaggattctcacgactctaccatgtccaatggagttcagagatcgttcctatacatttctgttcatcttaaggtggactcgtttggttaccaatttaactagtcctgcagaggatttaactgtgaacctggagggcaaggggtttccacagttgctgctcctttggggcaacgacggtttcaaaccaggattttgtgttttttcgttccccccacccgcccccagcagatggaaagaaagcacctgtttttacaaattctttttttttttttttttttttgctggtgtctgagcttcagtataaaagacaaaacttcctgtttgtggaacaaaagttcgaaagaaaaaacaaaacaaaaacacccagccctgttccaggagaatttcaagttttacaggttgagcttcaagatggtttttttggttttttttttttctctcatccaggctgaaggattttttttttctttacaaaatgagttcctcaaattgaccaatagctgctgctttcatattttggataagggtctgtggtcccggcgtgtgctcacgtgtgtatgcacgtgtgtgtgtccattagacacggctgatgtgtgtgcaaagtatccatgcggagttgatgctttgggaattggctcatgaaggttcttctcaagggtgcgagctcatccccctctctccttccttcttattgactgggagactgtgctctcgacagattcttcttgtgtcagaagtctagcctcaggtttctaccctcccttcacattggtggccaagggaggagcatttcatttggagtgattatgaatcttttcaagaccaaaccaagctaggacattaaaaaaaaaaaaaagaaaaagaaagaaaaaacaaaatggaaaaaggaaaaaaaaaaagaactgagatgacagagttttgagaatatatttgtaccatatttaatttttaaagtctctggtattagcctcataagttattgactattccccggggttggcggggagtggggacatgagttggtctgcctgttgtggggccgggaaggggagggagtcaggcacaagtggcctctttgtttggtcttaaaggcatccatttctgggaatgaagccatgttcgctgctaacacttttggatgttgtgaggccacgtggagtgtgtgagagactaggttttatggatggtctggttcaggtaccaggtctgctggaaggttcctgttcggataagctggtagctacctagctctgagcctgccttcaagaacacctgtgttcatcctctgattctctgtgtgtacctcttgtggcgtttcctctcccgggtgtgaacatcctaaccgttattgtgcaaacccaagaacgtcagatcccaaagcacaacaacctggatggactttgggaacatctaagcaatgtaagagagaggtgcactgagagtacgtcttggtcccctccaccctgagagcatctgacggtcctcagtactgaactcccggaagctgctctgagcccggtgacctcatctgggccaggtgtggtgcctgagctgaatgctcaggtgcttacagtgttgcaatccctaagagagtagagtctggaggagaaaccgtgaaaaagaccttacacaccaccaagaacttccgaatgggcgtgaatccaccgtttcttctctttgcaaaaagaaccaccacagctgctcaaagaacacagtgaactcatcactttggttcatcaaaaaatcatcgcccatgcgttattcctgagtgcattttcttacaactttttgactgcttccttttcttcttctcttaagagttgtgggcttaagaatgggatagagtcataatggcaacctccaagccctctcaattcttgattaagaacacaggtagacatgaatcccaattgtctattgctatcttatttatatgattcgggaaaatacagcatgtaaaaatattgctgaggagcctcagtgattgggtacaagaagcaagagtacagaaattatttttgccaaatttattttgtaaatatgagggtctgtacctaaatttaaaaaaaaaaacacgtagaactaggtattttgttctcttcttagtaaatttgtagtggttgtatactacactagctgcaattttcacatttttctaattcagaaaggtttttcttatattaggggaaaaagtatttattttaatatataaaatcactctgaaaatcactctcataaaaaatggagcgcatgtaaatttttatcaaagaaaaataaacaggtgaatgggggatagtgattttcttttttcagcacagtctacctcagtgtattgttaagatgtgattcaatcatggacatctttgagatttcagaattctacctggaaccggtctgaatcagggaacgtgtgtatcagctgattcgaatgccagggaccagtaagaattttgagggagggagttgggatggagaaggtatggcctttatgcgagcatagatccttttcttcctggctggtaatattcttctctgaatttaatcttcctttaaaaaaaaatcctccatctattgtcactatgttccccaaacataaactaagttccaggctgtcatgatgtatctgatatatggggtaacccagcaaggtgtaccttcctttggtgagagatggctgccggggcaaagacgggctttgattcagagcaagcattcccacctgttccatggaatccccctgaagtgagcacaaaggtgccctgggctccctgatggtttatgcccactcctttcaggctggtgatgcaccttacacacaaacacctaatgcaatgtctttttaaattctccaagtgggatgggagcatgtgagggaaattccaatccaaaacccattaatgtgctgaacgctttttttttttttttttttttttttgcaacaacaccttggacctctgtgttggggtttgactgacctcaagctgatattattggaccttgtgcagctttgataacccatgtgagagtctaggcaggaccagtggggcccaaatcttgctgctcttgtacttttaggcactgcccttgcagactcacctttctccacctgccctggagaaaggtagggtgtgctgggcctgccccttgcaaatgggattcaccagtttcatttatttgactctactgccacagtgaaaagagcaaacagctattgggttgcaaacctcctttgacattaggaaatgttgactttgtaacaataaaactttggtcctagaaagacacggttgtcctgggagtttgtagtgttaagttgcaacaacaacaacaaaaagcaacaaaaccagcttaggataacactttttgttgcttgttcttaaagatgtctcactatgattaaaacccttttcattaatgtagtgaaagccacacaggagttccttcttccaggaggagaataccaagcacatcactttctctctgcatcagtgatgtcaaatacgcatcagaaaatgttcaggttttaggagctgtcctaggtgctgtttcatcattggaagcagtgagaaagagaagcactgctgcttgtctggatataggctgaggatgattgagagaagctgtgggaactgacacaagggtctgcataggtcatcctgtgaccctggggactatgttaccaactgacagacagatctttcactgtatcctagcagggcaggtagtccaccaagaaatgtgcttattggattgggaggtgtttatttgtagtctgctgtaacacgtgtgaaagagcaggagcgtcatcagcatatgacttgcgctggtcatccggtaaatggatgtgctgtagtcccagtgctaatcatttctctccttcacagtgggtggaagtttagggttaaatgtcctttgaatgtcacctggtgagtccttgacaccttaggctcttcagaaacaatggttttgttgaggatggggaacagggaatgccgattttatatacatggtacacagagaggggtgtcacttcagaaaatcttccagcatgttcttcagaatattaatttatatgcgaggtgaggttgggaatgaaaagaacaggtcagcacttttttttttcctagaacatacaaaagaacatggtggactttcagggagtgcaatggaaggtgaatatttccttaagggtccccgagaaatgggagtgaggggaggggacacaatggctttttgagcttacttttaccttctgatactagtcaaggtccagaaccagccaccagccaaatttctatctgggtgcgggccactgaaaatccttgttaaaaaccagatcacaaatctggggctcttggtcccattggagaaggaaggaagagcctcaaaataagtgtgcacccatgcacatattcaggaacagcttgtttagtctttacactttgcctgaaagttgcttctcctcgtccctttgtgtgcctgggtggcctcggccctgtgcgttggcaacgcaggatcaaatgtgctgcagcttttgcagaaaacaactcagaaacacaaaaccccccaacagctcaattattattttttcaatgttttcctacaagagccaagtagcaccatgtacagaagacgcctttttttttggaatattgaaatcgttctgcatgtaaaatatgggataatgacctgtttatattaaaattctgattaaattatctgag

SEQ ID NO: 150 - protein, 1349 aa, Homo sapiens
VCPGMDIRNNLTRLHELENCSVIEGHLQILLMFKTRPEDFRDLSFPKLIMITDYLLLFRVYGLESLKDLFPNLTVIRGSRLFFNYALVIFEMVHLKELGLYNLMNITRGSVRIEKNNELCYLATIDWSRILDSVEDNYIVLNKDDNEECGDICPGTAKGKTNCPATVINGQFVERCWTHSHCQKVCPTICKSHGCTAEGLCCHSECLGNCSQPDDPTKCVACRNFYLDGRCVETCPPPYYHFQDWRCVNFSFCQDLHHKCKNSRRQGCHQYVIHNNKCIPECPSGYTMNSSNLLCTPCLGPCPKVCHLLEGEKTIDSVTSAQELRGCTVINGSLIINIRGGNNLAAELEANLGLIEEISGYLKIRRSYALVSLSFFRKLRLIRGETLEIGNYSFYALDNQNLRQLWDWSKHNLTITQGKLFFHYNPKLCLSEIHKMEEVSGTKGRQERNDIALKTNGDQASCENELLKFSYIRTSFDKILLRWEPYWPPDFRDLLGFMLFYKEAPYQNVTEFDGQDACGSNSWTVVDIDPPLRSNDPKSQNHPGWLMRGLKPWTQYAIFVKTLVTFSDERRTYGAKSDIIYVQTDATNPSVPLDPISVSNSSSQIILKWKPPSDPNGNITHYLVFWERQAEDSELFELDYCLKGLKLPSRTWSPPFESEDSQKHNQSEYEDSAGECCSCPKTDSQILKELEESSFRKTFEDYLHNVVFVPRKTSSGTGAEDPRPSRKRRSLGDVGNVTVAVPTVAAFPNTSSTSVPTSPEEHRPFEKVVNKESLVISGLRHFTGYRIELQACNQDTPEERCSVAAYVSARTMPEAKADDIVGPVTHEIFENNVVHLMWQEPKEPNGLIVLYEVSYRRYGDEELHLCVSRKHFALERGCRLRGLSPGNYSVRIRATSLAGNGSWTEPTYFYVTDYLDVPSNIAKIIIGPLIFVFLFSVVIGSIYLFLRKRQPDGPLGPLYASSNPEYLSASDVFPCSVYVPDEWEVSREKITLLRELGQGSFGMVYEGNARDIIKGEAETRVAVKTVNESASLRERIEFLNEASVMKGFTCHHVVRLLGVVSKGQPTLVVMELMAHGDLKSYLRSLRPEAENNPGRPPPTLQEMIQMAAEIADGMAYLNAKKFVHRDLAARNCMVAHDFTVKIGDFGMTRDIYETDYYRKGGKGLLPVRWMAPESLKDGVFTTSSDMWSFGVVLWEITSLAEQPYQGLSNEQVLKFVMDGGYLDQPDNCPERVTDLMRMCWQFNPKMRPTFLEIVNLLKDDLHPSFPEVSFFHSEENKAPESEELEMEFEDMENVPLDRSSHCQREEAGGRDGGSSLGFKRSYEEHIPYTHMNGGKKNGRILTLPRSNPS

SEQ ID NO: 151 - DNA, 40233 bp, Mus musculus
  misc_feature (1)...(40233): n = A,T,C or G
cagtacccgctctcggttcccgacattcttagatctcccgttaactgctctctcatagctgtttttgtctcactggctcgggctgcaaacttgtcaaaagtagtgaaaaaaagtatttctttatttcatagactccaccttctctagcactttctgggaagtttctaaacgcccttgatacggtaatgagatatttagttttcccgcgactcctttcccgttctgaaccgcccttacctggaatcactaaagggaaaaagaaggcagcttcttggcagttcccgggagaaacgctccttcgagagtaggaggtgggagtctgtctgactcttcttgctcaggaaaataaacctcaaatttccagcaacagcgggctggcagttgttgctaggacgcgtccgttgctaagattaaaaaaaaaaagtctcctgttgagattgacagaacgccttcaccaataccttatccgctccccaacattgtctctcatagaaggctagtgattggttgttgtgttgtgacgtcacctaacgtaatcccagagaagcccagtttcccactagcaaggaaagcactagttctctgttcgatttaggtctctgttctttgcagtggcccctcttgacttaggtccatgccttgccttgcgtccacttcagccttagtcaaagggaagttctcgtggggtgcggatgggcagctcctaggccagccacctgacctcccttgtagggagcaggatgcatctagggacctgtgtaaaattggagcgtggagtggaggttgcattcaggttgccttggacgtccttgactactgcagcacattttttgttttgttttgttttttgtttttttgtcaaagaattttgtatagagtttgagtcaagccggaactacaagtctccgagggaaagctgcctggtggttgttggttattgtaaggatcctttcatccgactgtgggccctccgggattattagagtgaagctcatctcgccagctttctgtcttttctttaaaagtacaaattaaaactgctaatttgtgatctagcaaaatttagcaaagtaatgcagttgaccacaacaatatttaaagagttttgtttaagacaggatcttactgccgtagaactccctctgtaggatggatagatggatggatcgatgtcaccacagcttaactgagccaagattaacttagtgtctttatatatcttttcaaatttctctctcccattctgttttcttattctccttccccctctctgtgtgtggatctgtgtgtgtgtgtgtgtgtgtgtgtgtctttgtgtgtgttatgtaggcaagtgccaccatgtatatttggaggtcagaagaaaacctctggtattggtctttgccttacacttggctgttgtttttatgtgtagcaacactgggattacagatatgcactaccacacccagctttacatgggtcctggggattgcaacacagttcctaacacttgcaaggcgctaaggcatctcacagtcccatctttcatatgtctttcaggttcctcccctaggtggtagcatctcagtccttttgttggcaaaactagaagtctgagagccaccccggattcctgttgccctgcccagagccaacctattactgagttttaccattttcttccttgaatatgtcactggtaatgcatctataagctgccttctgccttttcctcatttctgatggactcgtctgtcccctagctagtaacaacagtgtctggtcatgctccaccttctctctaattctacgttaccatggagcgttctgaatcaggggttcaagtctgagatcactctttttgcacatgttagggttgtgcataaaaagttgtgcaaaaccttgagcacaacctgagagactgacagctggcaggtgccaggtacctttttcttcctcagtttcccacaacccctactcgctagatgagagaagacagaggccttgaagtcctctggtctgcgcgtgagcacttggtctatgatccattctcacaaagggttattttttttttgagagtttgacttcttttccacaatatattcatgttgatgtcgatttttaaaatgtgaaaagtcactgttgactaagatagacataaacttaatgaaaatgaaacacaggcagccatgacaggctcatccattttctgcagccttaacatcctgactcaggagacagcatatccccagtggcccctgctggctccccaaggatgcctcttcctcttgaaaccaagatattgcttctttttctgcctcagtctgtgtacttttctccaccttcgttggaccttaagggcttcatctctccttgctcagcccaagtgccatcccttctgcaaagccacataaacaagcacacagcattactctcccttgcttttccatttgactatcccactgtgtctctaaagtcactttacagggcatctctgctctcggctttaaggctggggtaatacctcattagcttaaattgataccatccaacactgttcctgatacagtcacacacacacacacacacacacacacacattatatatattatatatgtatgttaaatacataatagatacataaatacaaatacataatatattacatatcatagacagtgtacatatatatgcattatgtgtaaatatataattgcttaattgcttatttcggataaaaaagcaagagaaattaacaaaggcttttttgtattcctcaaatgatatatttttctttgaaaaaatcccccacaatcctgttagatttcaggatgaccataatcttgtgacttggctgagacacagggtttgttgtcatctttcctttagacacaccccaagggatgagtcataagtcacaataccaagaaagttaaaaaaaagaaagaaagaaagaaatgggaagttgagtgatttcttcatgctgcagattcatgattgacacctttggtggtagtggccagaggaccgggttaggatgactagtgagtacctatgcactctcatggattaaatttgccttaaacttgaatgtattcaagcttagttttagttttgatagttaaggaacaaggtagtgagtcacagaataacaatgggaaataacagagaaatttcaaattgagtttacagcagaaaatctggtaagtcagagataagggtgattttttactaattttgttttttaaagagcttggggtggagggctgtgaatagacgactctgtaccattcttcccataggtttgcttaggagcgagggcaggggagaaggagaggaggggccttgtatgagctctgagatcacttctaggttcctgggaaactgtcttagcctgtgccagagggaacaggggaacgtcccccagtgaattcgcagcctcatttctcagcaatgaggaaatcagccagagaggcctgacttggtggcaaagctgtagctattaatgggaagagccaattctaatgtataaacacccacatgtgcaagcaagttcctgtgtgtgaggcgcatgtgtgtgtgcatgcatacacatacacgtgcgcatgcctgtgtgtatgcgtagagtcagagggcaatcttggatcgtgttcctcacaagccaatcatagaggcatctgagacagcctggcctgaagctcactaaataaactacacaggctggctgtaatgctccaggaatctgctcatctctgcctcctcaactctctctctctctctctctctctccctctctctctctctctctctctctctctctctctctctctctcacacacacacacacacacacacacagacacacacacacacagacacacacagacacacacacacacacacacacacacacacacacacagaggcctgcttgcatgccacatgcctgacctttttttttaggtgtggtgattataacaagtaaaactaaaataaccaaaacggaggcattctcgctgcctttgcagagtagctgagcccaggggggactcagaatgacgatgccctgtctgcccctgagcgtgggatctatactgtatggatggcaggtgtctccagagaggacggctcgagagcccagaagcaaagaacagcttcgtctggaaatggggtgcactgtgctgtataggtcatcacactctcggaaacagctgagaggaagagagccacggcatgccggtgtgtgcaaagacctacggtgtttgcagacactgtgcagtagcgcactatcaccagattagcctatttttttaacctttagggcatcttgaatgtttttaaagtaataatactacctctaaagaaagaaaattatgcttaagccaaaatttgttattgtttgaaccagtgccattgacaagctaaattttccagatctcagtgtgggggtgatggtgcttccctcagggaaaaccagaagaagacaggggtgggccttccttgcagatcacaggcaggcttctcagcccgccctggctcccacagagaactttctatgggagaaaggaaggggagaagagggagaatagactgattcttctctcccccaagtagacagcttcgaatttaaaatacaatccgtgttaaatagttttgtcatgggagggaacaagtcataaggtgcaaccaaaagatgattgctcatccccgaggctagccagtgttgctctcccacctttgagcagtttggtgtgctgtccccaaagttacctagtttggaaaattatctttttaattatttgaaatgtaaccaagaacatctatattagcaatagaaaccattcctcctccctgaatctgttgattttccctgtttctgtgattaaaaaaaaaatactcttacaaaatcagtttgtgagtgaaggtgtttaatctcggtcacagttggagggtacaccggggctggggagggatgcaggcagccaggttgttacgccttcattcaggaaggaaacagagaggatgctgctcctcggctcacgtctccctttttcctcagcccaggacccaggtccagagaatgatgccaccgacagccaggatggatcttcccatctcaattaacctaatctagttcatctctcaaggcatgcctagtggtgccttctaggtcttctagatctttccaggccattctagatcaggttgacaatatcaatcaccacatcccttattcctatatatcgtgaatgtgtttttatagtattaggaagaccagatgccaagttattagcctttctagacttctggtagaccttcatctgcctcttcttgcttgacacggccatgggaagctcagaacagcacccctctgtggcttttcacagtgaatgtgctgctcaatcataatcccaaattctgttcaaagtgagttctttgatgatgattaaatgaaaatctgaatgtcaaacctttgctagtcgttcctccaagataacaaacacttatccaaaatatgtcctttagatcagtgccatccgaggagatttgtctctagtccgtgaaatatttgttactcatgccacacaggaagtattgaaattgaaagtggtaaagatacatttatagaaatttgagagaaactatatttgaacaaagtcggggctcctttaccaaatgccggtatcctagctccttaggggagaggcgttctcattacctttgcagagtggctgagccctgtggggactcagaaggactcatgccctgtctgccccctgtgtgtgatctgtactatatggatagcagtttgtatcacagttagcataacccacttgtgaaggaaatgaaaacaagcccttaagcaacaggaggaggccacaatagcatctcaagcgcacactcaaactggacctcctgagtttgctgactgcttctcttcctgaggttctcagcccctcttccttgacgatcaggataagctaagagttattgctcataatttacattatgannnnnnnnnnnnnnnnnnnnttgctcataatttacattatgagcatcctacagtggtctcaaactccaaatcttttagcttcccatttctcaggactgcaggtgtgtggtcccatggagaaggggcgggctcagtggccccgtccaactggggagctctggttccttgatggttgtggagggaaagtatgtttctttgtgtgcatggccactgtaggctgtctatgctccagtgcatggccccacacctatagatagcactaattaggctctgtgagttataaagataaaaaggaagagaacatgaaatggtaggggcagggtggggggttaaggaggaaatggagggatggatatgatgcaaatatattgtatacatagaatattgtcaaaaaataaataaaaatatacaaaacactgtatttcaatcacatataataatcactattttgcagtcattttgtaataataattaaaagaagggatcaatgggagatacattttcaatagttgtaaaataaacacaccagtagactgtgtagttgtagaagataaatatttatattttttacatccttgttctaaaagacatttcattgttgttgtctttgtttattgttttttttaagaaaacaaaaccaaacacgaacccaagaccatacaaagtcaagattgtcattttcttctactctacttgaaaaccttgtcctactagagggtttgcaagggtgatgcccttgcacagagctgctgtctcctgtggtattgatgctctctttgtaaacccttccaaaagggttcctcccaagtctacgttacagttacctcttcttcacaaatataatacacttgaaaatacagcaatagcacaagaaatgctatcatttgtcactctcagatattctattagctgctttcctgttgctgtgataaagacaccatgaccgaggagacttgtagaagaatttactttttcttacggccccagagggctagattccataatggctgggtggaggcagcagttagacatggtagctgcggtaggcatgtagccgagaactcacgtctgaactgcgaatgtgaagcagaaggagcagactggaagtggttaaagctttaactcttaaagctccgccccccaaccccagccccccaccccccaccccggggcacactttcttcagcaaggctaaatcacaaatctcactagacagtgcttgctaccagctggggtccgagtgttcaaacacaggagcttctgtggacgttctcataagccgtgtattgttatgtgtactacccatgagtgtgatgatgtatcggtaacacagctaaggtgtttgtacctgggtcaatcattccaaagacgcatgcgtaagaactgtttctggtcctgctccagtgtctaggtgcagccttttgtatgttgtgcaactgttttgctcgtttgtattcggtttgacaaatgctctagttttttgttttttgtttttttttttttttttttttggttttcgagacaaggtttctctgtagccctggctgtcctggaactcactctgtacaccaggctggcctcgaactcagaaatccgcctgcctctgcctcccaagtgctgggattaaaggcgtgcaccaccacgcccggcttctagttttgttcttatagaaattgtcctgttactcaaggttctttgcattaccgcgtgagttctaagaacggagtgttggaattcccactcagattggatcccacctataaatgaactgagccaaaaccgacatcctaacgataccgaaccttaacaattcatgaacatggccgatttttccattccctttgattgtccaaggctgaacacccctaagcacataaaacatgagcgcttcccatgtgtcctactaatcaatggccaccgtccctttcattagggagattaggcacgaaaggaggtggcgagcgggagagagtaatgattcttacaaataagttagtaagccacatagaagaatttgggccctcactggactgactctaaaacctgtttcttgttccctagtagacagctcagttgcactagggctcagggaaagccatcgcttatttctgcaaacctctctgaaactcagattgcttctgaacaattgtacattttgaatacttgctacaaggataacttcagctgtagtaagaagacagtgttaatctgtgcagggacagaggggcatcagaggttaaattattcttccaaattgcactcgagaatacagtgtgctaattatatcctctgagtatctagcttgtctatacatcacacttgggattcaggctaatgaacagaataaactttttgcacaccattgcaaaacaaatctaaaaaaaaaaaaaaaccactgcacacataaaaagacacagaagaggacagttctatttataaattgcctgtgcgaactgatctaggagttgaaaaaaaaagtttgcaaaatggtctgtctgctctggatatagtttgtagactactccattagaaaagtctacttattttacaataaaaaactatttatggtttttaggggaaagcttgcccaccaccacaaattctgcactttcccacatttgagaaagtcacaagggtcagaatatctgaaatgcagtggatagacctcaccctgggaaaactaccatcttgattatgaatgctatcttcccttccaagtaagtattcacgtcccaagataataaaaataaaacaataaactaaaacaaatctcaagtgattgtaattaagattagccaaagtctttgctggtcctaatgtgtcgtcgagccaatattaaacgtttcaaaagaattcatgaagaaaaggtttcagtttaaagtctgctcccatgcacttgcatcgaggatttacttttactttgcgtgtgtaagtgttttgactttatgtttggatgtgcacctgagtgcctacttgatgtcttcagaggtcagactcaggcacctggtaccctggaactggagttacagaggttgtaagctactaccggattctaggaaccaaacttggatccctctgctggagcagcaagtactcctaatggctgagccgttcctctagccaggcacttaaaaatagcatgtgtgagtgtatgtcagttcgtgtgtgtcagttcgtgtgaggtgcacctatgtacggccatgctggtgcgcacacatgactgagagccacaggaggcttatggtgtgccatttggaagaattcagaaagacagcgcttctcattggcccagagctcaccaattagactaggaatgctggccaatgaactcagagatccctctgacctaccccagaacagagattgtgggtgccacatggacttcggggattgactcttcctccagggcacaaggcaagggcttttctgactaagcatccttgtagtcctgcctgacacatttagatttacattgcatcacaggactccccagggctctttctgtgcctgtgtccaggcagtccagggagagtcaacagcattcatttcccatcctttgactgatggttcaagactatggacggatgcctacgtttgctgagttcaccttgtctgcaaaggtcaacatggcaggcctgggagccaagtagacgctagtgggtgagcatcagcgtgtatctgacatcgagtttacagctccatgccatccgttggaatggtctctgagtggtccacctcacctgtcgttttccagcgcagagtaagccagtggggacgttcggtggaagcgcagggaatgggctgctgggggtgtgggagggaagacaaagccacagcaacactccttcagacggagtcccctccctacctgtctctgagaacggccgccccataaagggcgtggcagggaacccgagccttggggaggagggtcacgaggctggggccggaggaaggaggatggccagagcctgtgggacttggagcacagggtgggtgctgatgtgtcgtgtccttcagcggctaacaggacctgaagcctccccacagttccccgctgtttccgtcggtgccccctcggtgtgacttgggcctcaggtgagcctagccaggcgccgccccggggcatcaggtgtcctcggaaagtcgcctgttgcgctccgggagggagccttgtgtctccagccgtggatggcacaaagagggagggtaggggaccaggacatctgagccatggagggcacacagaggggaacggagtgcgagatgcaccggtttggcacaatcggggctctgccacggacctcaggtcagtggggcgcctggtggggtgggaacactctgtgtcacctcggcaaggtttggaggtgaccgaagagccctacctgtctgtgccagtttagtttcccagactgtgagaatccaatgccggatgccacccccagcccagaaacccccagcccagagcgtccgttatctctgggaagcctgtgatcctggaggctcactggactgcttcccactagcgtctgagataactctcaatggctctgtgtctgctctaaacttggactcaatttttattacaggccctcggccagaggtagaaatggggcagtagcctgggttctgtgcttgtcagactgactccagtagcagaccggacagaccttactttctggctaggagccagcaccatagaggtagtcccatggcatgggagaaaaagaggaaggaggcacgcattgcagagagatgagcactgttctcattctgtaggagcaaagccggaggttccatgtgggcctagtgggttgcccgaagttaaagacttatcaaattgtagaggaaactagggaggagagaaaggtatcgtctggtgaaatgggacaatgcggaagaggccggttgtggccgtttctctctccaattacacctcccctttctgcagctcaacccaatttagcttctggttgctttaagtaactgtgtctgactagggcctgcaccctgacccctgaggtagacttctgcagaactccttgacttcaaagagcagctgtcaatcaatacctggtcagttcagtgagggaggcaaatttcacagtcagccccggaatgagagccagccctctggaacaacctgagcaacgttttgaataaattaatggtcgttggctgttctctctttgtttctctaggttacggttacatagtgtctgtctatcttgtgtgcttaaagtttaattttcctctgtaatataatggaaagggggttgttgggatttcaagtagttcacaaacactttattcagacaaataaaacacacactatctcaacaaattcgatattgcagttattcatatgtagcaaccaacagaacttgttttttaaattggacgtagtagggtttctattgctgtgataaaacacatgaccaaaagcaactgggcaagaaagtttatttcagcttgcgatgttcaggtcacagtccatcactaggaagtggcacaggggcacaggacaggcacctgacaagccaggctctgaagcagaagccacgaagaaacggtgcttgctggcttgcctcttggtgcttgctcagcttgctgtcttattctacttaagcccacctacccagggatggctccactacctacagtgggctgagccctcccacattaaccttaatcaagggaaggccctacacatttgcccacaggtcaaccttacagaggtcttttctcagttaagagtccctcttccaagatgtgtctagtttgtgtcaagttgacaaaaaccaaaccagcacaaagtctcaaacatagcctcctcaaatgctgtctctaatatcccactactttattttagttcgtgtgagacaagctctctgtccctcatatacctagcctttcaggttctattcttgatagagataagacgttgagcaaaccccctgagaattaatggctttccccctttcctttacgcctttcccttaaggagatttgagatgcacttcggaaccaggaccattaatgtccgccatgacagttctatttggaaggaacccagtgcattttttacatagtaacatgcgttgtgcattattttcttcactcagcagtggtcttattaatctttttattaatcaggaatttagaatgtctcccatggctgacttttatagcccaaatctacattgcaggaatgctgggtttgccgggaatgtggcaatctatatcaaatgtgtgattctggacttagaaagctgtagatacgatttctcagatgttgtataattgtaggctaaatttttctccctttgctgttgagtataattctttatgaaaacattaaactcaggagggctttcctgtgtgtgtggaaggactctattgtcttggtgagtgtggggtattttatttaaatgggtttccatattatcaatgctagcctaagggaaactcctggataactgccactctctggagagacttcttccttagtctgaaaaagcctactatttggtatacccctttcaaagaggtattccaaatagtagggacacgtgcctcaaagggtgaaatgagttagtaagtataaggaagttcaagtggggggtcacttgggaactggactgcagttgagagcctgccctcgatgatgtagcagagtccagttctggaggctcgctcacactgcccctcgacgtaacagtggtatcagaaagcattcctgaccactgaagggagagggtgaggctgccagcttacactctacacaaaggccttatttgtatttggttgaatgtttcttacagtcttatgaggatagatattattaccattttgcaggactgaggctcgatgtaggctgagtgagatgattcaagtcatcgatgtatcaagatccaaactggttcttggttctgtataaaacctacttacggattaataagtacatggaagtttttgtttctcccatgagaaggagttgaatgaccatatccacataaaaatctgcatatcatttcagggtctgtttactctctgaagtcctttctcaacctctcaggcctccgatcttggccgtgactgtatctgttacccattgagctggaaagcacacatatattgtatacagctgtatgtgtaaacatgtctttttttttttttttttttttttttttttttttttttttttttactgattggagcagtccttggatttgttaactttcacctaggtgagaattcacttaagtagtcgaaacaagtgaggaactgaccctctgtcctagtctgtgcctacctagtatggtataggaatacaggacaccctatgtatggacactggagcagccatgcaggatttcttgggcatagtaactaacagcccataaagtagtttttatgtctagggagcacagctgggcctcggtcacctgcaacaatctaaggagcactcataatctttcagggacttccattccggtaaaaacgagatccgtagacttaaatacagaaaaagaattccgagactagtcaacatgaggtagaggttaggtttattaatgatgtttaaacacagcttctgagcatgagggttaaaagagaaagagaggggacccaggagaaagaataatacattctcatgtgtgggcatggacttctcaagagagggacctgagtacccgcctagtgccttagtattagcttcaggtaccagcttggtggatttcaagtcacattgcaaagcgctgctaagaaacttctttttctctcatctgataaggacgatgctagatggctccagagatatcttagatggaattataatctaattaagcaaaaccaacagccaccacgggttgcccaaggggttcgtaacacggccttttccgttaagaggatttcctagtcagacttctagaaaacagcaggttggaaagggagaaaggccttaagcaaaggttaattgtggctgaatatttaattctctgctggtgggaggcttgaaccgcagactctgccagcgcgaaacgaagagcgcatcacattcttttcctcctggccccgcccccacccaccctcccattccccacctccccacttcctcctgtctttctgctctacctcgcggtctgtgaccctttgttcaggcttctgagcctctgcagtagcaaacaccgcgggcctgggcctctcccagctgagtggaagtgtttgcttccttccctagagatggcaaatcccgaggtgctggttagcagctgcagcgctcgccaagatgaaagtccctgcactttccacccgagctcgtccccgtcagagcagcttctcttagaagaccagatgaggcggaaactcaagttcttttttatgaatccttgtgagaagttctgggctcggggtaggaagccatggaaacttgccatacagattctgaaaatcgcgatggtgactatccaggtaagcatcctcctgcaggagttaggcggagcctctttgcatagcagagaaggtggcactggttcctcaaacaacttttaactgcacctgtaaggacagacaataaataaagatttaaaaatttaaacccttctcccttcgactttgtttctttgtttgtcctctctttctttctcttgattctttttttaaaaagttttttttttttttttttttttttttttttttgagacaggctcactatttaggcccaattggccctgaacttccatgtagaccagacaggccttgaattcacaagagacctccgtcttcccagtgttggtaaagtgtgtaccacgacacccagctctttctcatttttttttattatgataattttaatgccatagtatttttcaggaataaacatttttagcagttggatcctcatgaaggcctttcttgagagttatctacatctctcacagatatcatctgattcccaacatgagttctttcttttattcctaatatggtgggcatttctttctctagaaactgcatggtgttttgccacaggcaacttcttggattccttagactccatgattcctccagccccaatcctgaaaaccgtggtgcagaagattacggggttggcagcagggaccgtgcattgcctgtggaatgtgcgccttcattttcgttagaaaggaaaatctcagtctgccttccataacttctttacatatttttgaggaatcatgtttttgtgagagttgcccacgctggtggtgtttattattaaaacatgtttggggctgacaaggtggctgtgctggtaaagggtgcttgccaccaagcctggcaacctgtgtgtgatttctagaacccacatggtagaaggtgtgagctgactcttgccaattgtcctctgacctctgtacacgtgtgtaatcgcaaagaaaaaaaaagggtaaaaaatagtttctttttctgctggtgagaggaaatacctcttgtaaaaagcagaaaggaaaaaatgaagacaaggtttagatttgcatatttattttccattcttggtgaacacctgctattgaaagagagggtattttttgtttttgttttttaatattgagattgataatcttaattgcttactggaagcaagcacttaggactagcagaccaaggcagtttctagagtcatctgaagttggtagaattcttatctgaactggggtaacccctcatcccagtagagcagttcatgtcattgtgaccaccctcccactggggaaatcccagtctccgccttacagagtgggacacggatgcttacgggtttaaaaggctgcgtggctcatacatagtaacatggaagcaggcacagtttttctttaatatatcaccaagaaaacatgctcggttcccagtaaatacttggcaacccgcacttgaaatccttaatttccaggtgataatgcaatatgtcacagcactgaaaagcttatttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacacacagtgtgtatctctgtgtgtccatctttgtgtaagcggtgtgtgtgcacacacgtgagctcgtgcacatacaaaatgacatgcatgtggagatctgaggacagccaaatctcctttaccttctaacaggatctgccgttccccactgtgtacaccaggctacctagtgggcttctggatatcttctctcctgtgtccccatagtcatactggactgctggcttgtctgtggttctagggatttgaactcaggtcctcatacttgtaagaaaagtgctctcattcacggaatcatctcccggcccccaagtcgagagccttctgggtatcctgcccagtccctcacagatgcttgccagtcaggcctctatttcttttctgttcaaagtttttcatcctcacggtgtttcttttcttctttaagctggttctgtttggactaagtaaccagatggtagtagctttcaaagaggagaacactatagccttcaaacacctcttcctaaagggctacatggatcgaatggacgacacctatgcagtgtacactcagagtgaagtgtatgaccagatcatctttgcagtgacccaggtaagtcaactgtgcttcacgtgttgattttgtctgtctgttttaggtatcaagggttaaactctgggccttacacgagctaggcaagtgttttaatagtgagatatccagacagtgtgtgcattcttgggagaaagaacaggctggagaaatggactatatagaaacccacactcaagcacgtgtgctcgtgagcatgcaaatgacatgcatgtcatttctgcttggagataacttatgaataaactatttaaatacagtttaagggctgaagggatggcttagcagttaagagcacttgttgctctttgagaggacttgagtttgcttctcagcatctttattgggcagctcagaactgcctataatctcagcttcaggggaatctattgtgtttttggccttggctggtatcccttcacacacacacacacacacacacacacacacacacacacacacacgtgtaaaataaaacagatatttaaaaattgatagaaaaatattgctatactcatatacaagtaaaaactgatttaaaaaaaggatatgattcctaccgacagaaaggtaggatttcaatgagtcatttaaaagaatcagggataggacttgatgtgagagcttcaatattcaaaattactaacaggatataggtagtcattaagtcttcaaagcttatacttttggagacgtataataactaacaagaatattaattttgcagtttgggtaacaagcaaggccttcaagctcatgtaaaagagaggcttttatgccaggcctggtgatggttgttctgtgatactgagtaactgactgcctggcagaaaataagcttgtttttcatcctccagactcaagttttcattctgggttattcttgctataattagtactttctcaaggtaccaaatcacttcttttgaagggataattaaaagtgcttttgagggcagtgtttttggcctaggttagcctcagaccacattccaaaatcattaaatcccttctttaaacacgtcccggagcagccatgactcctcatttctggaagcagcttattcaaacagaggccatgagccactagcatggagcaccagcagcggctcagatgaagctcatctttctggaggcaggactcctgctagccttgtggacaggaagcctagtgtgtgtatgtgtgtgagagtgtgtgtttatgtgtgtgtatgagtgtgtgtgagtatattttccacctgaggtcagagtcctctgtgtgtgtgtgtgtgtgtgtgtgtgtgtgtgtgtgtgtgtgtgtgtgtatgagtgtgtgtgagtatattttccacctgaggtcagagtcctctgtgtgtgtgtgtgtgtgtgtgtgtgtgtgtgtgtgtgagagagagagagagagagagagagagagagagagagagaatgtatgtgcatgagagaaatagagtatatgtcttaattaggattttattgctgtgaacagacaccatgaccaaggcaactctaacaaagacaatatttagttaaggctggcttacaggttcagaggtttagtccattatcatcaaggcaggagcatggcaatgtccaggcatggtgcaggaggaaatgagagttctacatcttcatttaggaaaagactggctcccaagtggttaggaggagggtcttaaaggcaatacccacagtgacacacttcctccagcaaggctacccctactctaacaggctaatggtgctgctccctggaccaagcacattcaaaccaccacagtatttatttgtgtgtgtgagagaatatgtgtatatatatatgtgtgtgtgtgtgtgtgtatggtgtttgtgcaggacatgacatttgagtgaagcacagaggacaaccttagtttccagtcctcaacttctatcttgtctgaggtcagagtcgttttcatcattacatatactaagctaggtggcctgtgagcttctagagaatgctcctgtcactgagccctgtcttattgcagggacactggaattacagaggcatgcgactgtgcctggtttcccatgggtgtaggggatttgaactcaggtccttatggtctggtggtaagtactttacacagtgagccatctctcagccctagatttaacttttaaatgtattaactatctgtaaaacgttgtactagatttgtttgtgtcctagagggtatgcagagacaagaactaaaccatccactactttttgttgttttgagttggggcctgatgtaacccaaagtgacttcaaactcttggaagcagaggctggctttgatctcttgatcctgctgcctccacttctgaaaagcaatccctatgcctgactaaaggccaggtaaattctttgtaaccctttcttagctttatcaggagggccacactcagccttcagaacactgtgtctggcactggaaccactctccttgctagatctccgtgtcctctccaccaggagtccttatcttagctgccacacttctttctgctactataggaaaatatctgtagtcgatatgtgaagccgtttcctcctcacagttctgagaggctaagatcaaggcgtctgcatgcttagctcttgtatctccctgctgtggcctccgtgatgaaagggatgcagatgggtgaaggatcccctagtccctccggccctgttatgtcagaactgtgtgggctaccagatcaaacatagcgtggtaatccctgcatctggctgttttttcttagtccccactcagtggcctcagcacctctgctttctaaagaatccacacacacacacacacacacacacacacacacacacacacaaatcatagctcgtattacaaaatactgctcatgcgatagagagattcatggtctgttggtgtccatacatacatctaagagagacatgtgttctgtctgtattcacaaatgcatctacacctctctcagtgctcactgccaggcatttcctcggactcagcaactggcccttctgatctccatcactcttctttagagcctctccctccgatgcagcatccgagggtgtatttactgaatgtctgcaccccgaagggagacatggccagcaagggctatcatggctttgcttctgccctggctggcacccctttggccctggttggtgttccatttctgtctctcttttcctgtgaagtacttgcagcttcagaacatctccgtgggcaatcacgcttatgagaacaaggggactaagcagtcggcgatggcaatctgtcagcacttctacaggcaaggaaccatctgccccgggaacgacacctttgacatcgatccagaagttgaaacaggtgatgatcccctataacctccaactcctgtttttaaccccttgatttatacctaagccctgtgataccttcatctctgtaaacatcgatggacagtaccctcatggcataggaagaactatacaaaagttcttacgtgccaacttctatagtgaaccgtttgttataaaacttaggccagacagtggtgccgcatgcctttaatccctgcacttgggaggcagaggcaggcggatttctgagttcgaggccagcctggtctacagaatgagttccaggacagccaaggctacacagagaaaccctgtctcgaaaaaaaacctaaaaaaccaaaaacaaacaaacaaaaaaacctcatgaattcaaaaggaaaaacaaatagggaaagcatcagggaactagaggcagggagagcaatgatgttctgagacagagcttgagtctttctaaatcgtcaaccactccagaaatgtcctacatcttaaagacagtagacacaggacaagggcagcgatactgagttcttacagtcttgattctaaaaggaatcgatatgagcagctgatcttgaccgctgtcctctggaaatgcagtcatatctatggctttgtccctttctgtggcagaatgtttccttgtagagccagatgaagcttcccaccttggaacgcctggagaaaataaactcaacctgagcctggacttccacaggtgaggaaaatggaggggcacacagctcagctctgtgtgtgaccccctcatctcaagcatgctctggaggggcacacagctcagctctgtgtgtgaccccctcatctcaagcatgctctgctttccagacttctgacggtggagctccagtttaagctcaaagccatcaatctgcagacagttcgacaccaggagcttcctgactgttacgactttacgctgactgtaagtgtgggttgtgctccatgtggctcctacctagagaaaaattattttaaccaggtgtatggttcatttactggtgctaaggcattgtcaaaaatataggaagtgccactcgaatgtgccggggacattgctctgaccagctctagtctctgcatgttgctaacttgctgtttgtcttctggcccttggtgcatgttctgtaagtcagggactcgcctgcgtgttactgtctccagtgtggcacctgctgcacagcggatgaccaagtaccaaaggatcacgatcatgaagggcataacaaacacatatgtcttcaaatgtcgtaacttttgtccccctgtgatattcttctaaaaaccctacccagcatacttctgtcttggggagagccatcatctgctgaggcttattgaaatgtgactcatatatctgctgagtccctatctgtccttgaggctctttatgtggaaaaagaataatttctcattggtgaggacttttcactccaccaaatgacactggcatctcctcgtgtggggtgtgggctgtgttcttcagccactgtgggcagcatagccaatggcagtggcttcatttgtgtagggagaggggctgatactccatctcaagggcacgcagagtgactggactctttgaagttacttagaacctcatacttgaagctctgtctgccttctctgtgtggagaaacttcaacaaaacccaacggcagaggattttgagcacttttaaaagtccttcgagaatttcatagacaagtacaatgtattttgatcatattcaccagcactgccccccctccaaatcctcccagaacctgttgtacagtcttcccacttagtccagtcgtcgatgcctcagtacgcacaggtaggagttatctccagagcatggataacgtatcagaggccacatatcccaacaaaatgaatgactctctcccagtagccatcagatgccaacagctcctcagctaagggcgtggtctcatgtgtctatgatgtaaagtcagctgacttgattttgtgctgctgtgagttgatgaaaacagttgcctgttacgtcctccccacattccgtcttacagtctttctgccccatcccttctgtgatattccctgagcatgggatgggggtggggcacagtaaggtagatattcatttaggactaagctgtaaatgaaggactttcaagtgaaccttttccattttttgttgggaaaggggaagaaaaatatagatggattttcttgcctttccttctttctctctgcatggaggaagcaagagagttagatggagacacaggaggatcacgcaaagttttgtgctgtagctttgtgctgtttgtactgagcatcttcaactagttatctcagaagcaagaatgctagcaactctgtcaccaagccctttgtaatatgtgggatgtcagagtgatggagaaatataagcctagaatgaaaaaaaataaagcaaaacacctctccacttggagtgtctaaggacgatgtccctctgtgcttgtgtttctgtatttgcataatttgcctgaacaccaaaagctatctgttgctaaggtcggttgggaaggtgtacagaggaaacctgtacaaattcagcaagtcaagtgtctggaacagaagagagagcactcttgtttgctaaggtgtccagggctagaatgcatcctagaaacacgtggtttagatgctaaaatctctctactgcagatctaattcagtgttatcacctcacagagaaatgaaggggcacactcagggattagcagagaccggtaccagctggtcagaagcgaggatcagcatgtcctgtgtcctctgaagaactgcttcctggtggatttacagacctatcttgactctcaaacctagtcacgcatcctggaccccttttcctgtttttacagataacattcgacaacaaggctcacagtggaagaatcaaaataagcttagacaacgacatttctatcaaagaatgcaaagactggcatgtgtctggatcaagtaagttgtaagctctactcattctcaggatgctaattaagtcattaagcatcacattactacccgcaggatgtagggaccacgaagtaaaagactgggccagtcccaggcccttgaccttctgaaggcagattgggttgctgtagatgtctggtgattcagtcagtacataggagcatccaacatctccttaccttctctacagtccttactgactacatactcaccgttctgcactaaaagaacacgcatacctattttcctcactcaatatctttaaatatctcaatgggcagcagaatctgtacattcacagatgaagaaaccaagggtcaggagcgatgtgtcttacatcgagggagaagggaagacttgaccttgaagctatgacattgtagttatctttcatctggcttaaaaagcagagtgatgtgggaagaaaaacctgttctagaaacacaaacaaaagatcagattagaatgagtcctgtctggaacaggaaaacactgccaggaaagaatttccctgagctgttatctaggtaggtcctctgatgtagcccagatcgtaggttgtgctgcctttcggtcatgactagataacacaagagattaattacatgggctctacggagaacaagaggaagaatctttgatacctgctgagatgtgctttccacaagagagttggtagagctgagctgggtctggactgtgtgagtgtcagaccaacatgatggtagtcaccgatgtacagtttgtgtatgagtgtatggcgctctggaaccacaagcctcactactgtcatagacctacctgggtggaatacaaacttggagcagcatctcacatgggataaatgggagcatccaaagtgcctggcatagaggctgcctctcaaacgcttgcttttggtttttaagtctgtctaatgcagtgttagacatttgggcagccattagaagcctctgggcaaacatcagaagtatggtttattactgctctttctgaaattgcttcctcacagtagcctggtagagataaactcggaggactcggtggctgctgccctcttttgatggcacctgcttgtgggccacgatggcatttatgactctccaggatttcaatgtctgaaaaaaatggtcttctctcctcccccaactccccttcctcctccattctctctctcttcttttatttattttttctttcttttattcctctcacttcttttcttcctcctcctccattgcttagacagggtctcttatatagcctaggctatcctataactcatgatctttctgccttgttctccaagtgctgggactttaagtgtgggccaccaagcctggcagaaacggctcatttcttgcttcccaaggctcagttaaagccttgatgaggcctcttttctggctaccttctccagtgtggagcaatggctctgaaacatagccttgtacctggagggttcagggacattatgacttctgattcagcagttttatggcaagagctgaggatatcttctaacaaaactaaaaacaaacagaacaacctgatgcacagtggtggtgctgtgaacgtttaaacgccaaccgtgctgcttatttatcatgtggccttggcacatgatgggacctccttgtgcttcagttttctcaagttcaaagtgggctaagcatggcagtttcgtgggggctgttgtgaggatcctgtacacacaaagtgcgtggaatagagtcaggtgggaagtgtgctgagcaccatctgtgtttgtgacttaatgtctcttgtacccctccatctatgcctattgtccatgtacctgctcacttctttgcttgtctcacgtcacagatgctcctgttaggttcagggtcttgtctgttttgttttctactgtgttccaacacctggaaaagtgccaggtacatgaggatgccgaatgggtattttatacccagctaagtatcttatcaagcaatgtaggagttggaaggcttaattactgattgattgactttttttttttttttggagaggatttcactatgtgtagcccaggttgaccgaaaacttagtatataatccaagctagcctagacttcatggtattccttctgctgcttgcttccgactgctgggataataggtgtgcatatcacacccacaaggagaacctattcagtataaagactaaaggctgataatgaaagatctttgatttgtttttggttttcttggaaggaccttcagcttttaaaaaaatactaatggaaagagtgctcgcaggacttcctgtccttgtcattctgaaatgtttgaattatctgaattatttgagaaagaagtcacatcatcgtgttaatgtttccatggccctctgtcttccagttcagaagaacacacactacatgatgatctttgatgcctttgtcattctgacctgcttggcctcactggtgctgtgtgccaggtctgtgattaggggtcttcagcttcagcaggtaagtgctgctccccaagacaccgctgacgcactcagccacactgaagctcacggtgtctctcctcttcccaataggagtttgtcaacttcttccttcttcactacaagaaggaagtttcggcctctgatcagatggagttcatcaacgggtggtacattatgatcatcattagtgacatattgacaatcgttggatcagttctgaaaatggaaatccaagccaaggtaatactgttcttcccaactgtgcagtcacaatggtaaaatgtatttttccaaactgtgaaaaaattcttctgggctttgtattcagttaacttgaaattgacaacagcagttttcttaactctagttaagtcttatatctagaagtctctctctctttctttctctctctctctctctctctctccctctctctctctctctctctctctctctctctctctctctctctctctctgtgtgtgtgtatgtgtgtgtgtgtgtctttgagatagtgtctctgtggagccttgactgtctaggagctctttctcacagctctgcctgcctctgcctcctgggtggtaggattaaaggcatacaccaccaccactcagctactagaagtctctcaagcagagttttaaaaagcataatccacaaacggataggccagttaatctgagtggttagatcgagagagttcaaagtctccaggtcacatacaccaaaagtcatatacacaccagggaaattctgctaagagttgttaagaggtctcacagaaaatgttaaagttaagatattagaccaaaaaataagaggaggaggaggaggaggaggaggaagaagaagagaaggaagaggaggaggaagagaaggaggagggtgggaagaggggaatgaggtcaacttctgtgtgagtttctaccttatttcctttgctctttcaatgtaaaaatatgctcatgttcttttcccattgatattattctcccaaaataagattaatctagtctagaattagtctttcttgccatacaaacaaaaattaacaatgttcaagtgaaccttgtcagcgttatactttgctagtcttgtcatccaggacctggtcgtaaaccgaggcagactccaaacacaggggctgggtcaaagggcaacttgcttctcatctctgaagcagccagggtggggctttaggttgcaggtcgttcagggacctaagctctctgcatttcgttccttgccagatgctaagggctcatcctgacttcacgattgacacagggttgcctcatgagctggctccagcctgtgggaagtgaaaataccagatggtggcagccttccggtgtcacgtggccatggctcaggagtagcagatttcattcctgttcacacgctctagagtgacattagtcaaacccacctgcacggggctgtggggaagaaggacacagatgcctgagaagaacaggggcaagaagaggcccaccatgggccagctgataccataacatggctgtattttcgtgtagtttagctttacggaaccaaaaaaaaataatcatggtggatttatagttaatatttatttattttattagttttaagggagtatcatatgcagaccaggttctcttcaaactcaccatgtagctgaggctggccttgaactctgatcttcctgcctccacctccccggttctggtgttaaagggatgctccgtgcatgacatcttttttctttttatcaactaccatttccttccttgagccttcatagtgtccagcatggtcttcatttttctggaccatcctcttcccttctgaaacctctggcacttcctcctgccctcacctcacttcctgtttcatagcagtaagagacaccccttccttgtctccagtgtctgtccattctgatactgtggatgatttaggctgctgtccaaggctagctccttcacttgcctctcaggagctggccccaggttctttcttctctctggcagctctttcctcctgtaactccctcatactatgtttttgcttcttctgcaaaattaaattcccagatcctttatccagctatttcccatgtctctgctccagtttataggataaaagatatcaaagtagtacctaaccttgctgattctaatcccactactaactgctcttccaggatgtcttccaatctggctgtgtcatgtagccatggaaattcctatctgctgtcggccgtggatcgctgctctctgtcctgacctgccggtagcttcccactgctggtttggttagcgtgtgttgcctttccgctgaggtgactcttaccaggttttctccagatcccggtctgtcagagttttcctagctgcttcccctccgggcggccagccctcagtgtgaggatgttttaaggcatcctgtttgagcagcccttttctgtcactgccttggtattgtcgtcctgacccagatagatattttggtaccactgtaccaacatgtgtcaaatctgcaccttaaagtctctatgttgcagcctgcatagccaagtgtcaaccttccatcttgaccgtctgcttatcttctcagatttaagtatccaactcagaannnnnnnnnnnnnnnnnnnntccagatcctttctcacactgcctttccagcccttgaacggcacctctcagtgtgttcattacctcaaacctcgcgttcactgacgctcccctcctttagaaaactcctctctcctatgcctaatcttagcgggaatttatgtgttctgcctctgagaaggagccggtcacctttacaggctgcacccagtcgtcacctgctctcacattactccaagccctctgctggcagtctgttcgccatgcacccgaaactcccatgcctctcctcttctaggctctcaaatctccctgaccctttttgacaaaaacaaccttagatgtctgtgtgttgcagcctgagtgcccgtgagggcttacactacccccccccttacctccctccactctatctgcttctcacttcttgtcaggctccctgctgcctccggttctttgtatttgctgctctacgagcccaaggctcttcgaggttttgggttaactttctccctcatttctttgcttccatgtcacttgttcattgaggttgttactgctcatcctgttccatgctgcaagctcacacccattccttacctctccccacacccgtggtcatcttcctcagcattcaccatcactgaatctactggaggctgtgttaatctattgctgggttttgttccgtatattccactagagtgtaagctttatgaaggttaaaacaaacaaacaaacaaacaaacaaacaaacaaccccaaactatctgttgctttattcttcacatctagaacagctcctggcacatagctatttaatatttcttgcctaactgacatattgcaatttaaccagttttccctattctatctagagtctcacaagctatgatgtctgcagcatacttctcgggacgtcaactatgctcgtgtggcttggagttatccgatacctgggtttctttgcgaagtacaatgtaaggaatcctacagagtccacttgagctacttcactactttgactaaagggtggagggatctaacaccctctcttacttccgcagctccttattctgaccctccaggcagcgctgcccaacgtcatgaggttctgttgctgcgctgctatgatctatctaggctattgcttttgcggatggattgtgctgggcccttaccatgagaaggtaccgtattagttaagtttctgtttctgtgaagagacaccataactatggcaactcttatgaaggaaaacattgaactggggctggctcacagtttcagaggtttggtccattattgtcatggcaagaagcctgtcagtgtacaggcggacatggtgctggagaagaagctgagagttctatatctggatccacgggcagcaagaattgtgtaccactgagcctgggcttgagcttctgagacatcaaagtctgtcctgacagtgacacacttccaccaacaaggacatacctactctaacagggtcacacccccaatagtgccactccctatgggccaaccattcaaacacatgcgttaatgaggctgtttctattcaaaccaccataggtactgataatagccagctctcttcccgacattgttaagctcatatgacaaggccaatggcttctatttttatgactactattggttattcatttctatttttgtttgtgttcaggttggccttgaactcatgtatgtagtcaaggatggccttgaagtcctggtccctcctgcctctaccacccaagtgctgggatggcaggtgtgtactaacacacctaatatgctgttttacccttttttaaatatgaatacttttatttattctttgagaaatttacacatgcacatattttgatcatattcatctattattcctcccaatgccttccagatcccccctacattccccctaacttaatgttctcttttttataacccattgggtgtaattaatgctgcccatatccacatgggctgggggccgtccattggcgtgtgatcaccttagcaagaacacactgactacccccaaccagcagccatcaaacgctgacagtgttgatctttcttacatggactcctttgatctggtaattcagcctgaaaatatggacagtcgtgtatctatatccacatatagatccaataacgagtgtatcaatttataaatcagtcaaatgtgaacacctcatgagaattattgatctgctccgttgcctgacctcctgtttggaatacgttagataagtatgttcctttttaccaccagtgaagttgttcagtctgtttgaattcactcaaacacatctgtaaaactgtacaaaaaaacctgtaggaatatttgaaaagtttgctgtgagaactctcttgactgttagatgttatcatgagttggatgagcttcaaggtgagatgagggaccattcgagtctggaacctgggtgtctctgcagaagcattcatttcaagggtctctttctgcaaaagggaaagggtgggaagggcaggaaggaaagggaagtggagggaagggaaaggaaggggaagggagggaaggtgagggaaagggagcggaggggagagagggagaaggaggaaagggaaaggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccagggcctggcacgtgtgaggcaatccctgagcctttgaactttatgtcttcgactgttaagtacattttctaatctcttattagactaatacatgtcagtaggtattgcatgtataaagtagatgacatatgagagaggcaatgttctgtgagagtacctgtaggagatgagggatgctcgctgggagcacctgtgggagatgagggatgctcactgcttggatcccagccaaactctgctaatctaaattggattggattctagctgcctgaaccaggtttcacccaaggaacttccttcacattggctgggaattcatggggttataggcagcctaggagtagacatcataggatttaagctgcatcttggccacgtgtttcccaagtgagggttacggacaggattcacatgactatgggtacaggcagactgggaggagtgagcacaggactactgcagagtctcaggaccatttaacttccatttagcctgggtggctccagaagtgacaggtcctaaaatgcctgggagcgcccagctctccctggagacaccccttccactgccagagctcctctctgagtctggaaggctactggagaggccctagtaatgaagactttcctattcttctgtgtagcactaccagcaagatggcttcccagagacggaacttcgaaagtttatagcggaatgcaaagacctccccaactccggaaaatacagattagaagatgaccctccgggttctttactctgctgctgcaaaaagtaactgttgggcttctctgtgcttgggaggaaaatacagtgtgtggctgagccagagattatttgtgatcacgcaacagtatatgtccagatactagtattctgagttaacaaacagctatgacttagcaggacctgttcatagtttttgaaactatttaatatcttttctgcttacattagcatttttaaaatgactgatttgatgagggaagctaatgggtcttagtcgctgtaggtcttgggtatgttctctttaccacacagcaagccttgtgcctgcactggaaataagctttcgcttctcagaaactttggatgacccagttcccctctctgagagttgggataattattacacatcagacaccatggagtctctccttaaatgaagacagaacaatagagagccccatcacagctgtgtgtgggatgcttggctctgaaggacagtctttgattctcctattcatttagaagctttctgcccttcagtgttaaggtacaagattggaagagagtctatacacggatgaagtccaaatgcacaccaaggaggcatttgattaaacagtgatggctttattagcatccaagcagcattgggggaattggtgatacaatgtgtgttccatgggcctgtgcagtctcaggaaacccatttggggtcaggatttgtggctctgtggtttgaagttctagaacccatgttcaaaattttaaaatgaatatatgtagcttgaaaaggcacagaattaggctctacattttgtagttctctaatgggaaattatggggatttttttgtggtataacatttattttgtgtactatttatccatgtggcatcaattcaattatgtataataatgactttacaagggctcctttaaaaacacaataaaaattttaactctttagtgttgcattagggacataataaagatacctgcttattttgtaatttattaggatacaacataaattttaaaactgtgttgattatctgagaagtccttaatgttattctttttgcgatgttttaagactaataattgtatttcattggaaacacaaaaccactgatccagggctgggcctggagttgcttccctgtgcatgcagagaagagaaagctagctatagactaacaggattggagagctctgggtttaatggagagaacctgcctcaataaattaagtggagagcaattgtggaagactcttgacatcaactgctggcctctacacatgtgtgcacatgcatacacacatgtacacatgccagatatatatctcagaaactgaaaaaaaaatgttaggagaagttaaaagttctgtggagtcaatactaggacatccagggatacacaaagtgactctgttgccaagcaaacagactaaaggaaaagaagcagggtagtgcataaaggctgatctatggggtggggtggactataaggttagatgtgtctgttagaagagaggaaatgtctaaatttcattatccaaatatcttctgggaaattagagaagcatgagaacatggaaaactctggtaagaaaaaaaccaaatcagagagtcaaacaagaaagagtaagtcaatagaaagtcaaccaactcccaaatatagttttgttttaaagatcagtaaagtaaataagccactaactaaggaaagcaatgcagacacaggtattcagaattgacggaaggatctcaatggattccatgcatcgaacactcaagtacccttcagtttgacaaactgcacagctcgacaaactacacagcatggatcaattcttccatgttttgggtgggttccctaaaagttctcctgttagagactgaattcgtcagtgttaccacagtgggtgctggacgtctcatgagaggtgttggggtcacaggcgttgagcccccaggaacagactgatttttctcatggcatgggtgagtgtcctgatttctctcacgagcccccaccagaagctaataataatttatccgaggcaaaacaaatgcttctcctttatgagttactcagcctcaggcattctgtcatagcaactggaaatgagggaagaacaagtagtagactgttgctatggcaacacttgactatgttgaaaccgcagtccaacccactgtaggcccagactgcatcggttttgaagcaagtgttgggaaaggagctggttgtgagagttactcagggtaattctgctgagagctcaggaaaacacggagctaaggacggtatgggagcaaaatggttgaggctgtcacaccaacagaactgtgggaaatgaaggccgaggtgagaaggttgtgtgtagaaatgagaatgtcttccagggaaacagagtgaaagtcgtcctattacatcgatacaagcacagaggccatgtaagctctttctgtctgtaactgaaattagaccaatgtatgccgcagagctcctcagatactcccagtcactcttaaccacttggggaatgtaacagagaagggagagctaaccctggaagtcacaggtaagaaggaaacatggcactgaaaatgggagaattagtagccttttttaactcatggaagagttaaaaaagcatggtcaacagatatcaccaagtatatggctaagctgatgcttgtaaggcaggtctcactcaccagaacaatggagaaaggccccgatgctatttcagaaatcttagagtctgtctgcctctctcatcaaagtccagaatcctagagagggaggaggggctccaggactggctggggtatcttttggggccttatcactctggtggcccaaggattctgctccctgcatcccactgtgggctctgctcagcctcaaccagctgtgcctcgggtgtatccaggtgtgcctctgttccaatccaaagcatccaatcagtaagcctgggctgcatgctgggtcttaagtgggtccagccaccgccggtcactgctgtatctgccgcagcaaacggcacattagacaaatgctggcactgcccactcggcaggtgagtggaatgcaggggctatgaaggtgtggagccccccacttaaacttcagaaggactatctgggagctgcatggggacctgccagcacaggagatggcaaaccctgcaacaggtccttgtctgggagttgggctgggggctgcagttgtgattcctaccatgacaagctacttacagtgctgtgaagacaactctgctccacagagagcagccatgttaattgagccccaacaaactgtgtgagtggagctgcctggagtcttgggggcccactctctaccctgtacttggagtgaaagatgattctcgaggtttaagatgtcatgtctaatctgttgggtgcccgttcatcatcttattctgtggtccactcttctcattgggaacgagagtgtcttctctaaggctgtcctgctttttcctcccagaggcgatgacttctcttgattttacagcttcatgtttgacaggcatttgtcttgatgtcttgtctcagatgacacaagggactttgaagctgattctggagccagttgagacttggaggttattgggacaaatatattccataacgagaagtccatgactggggaagggtataggggagaggctgtttgagtgtgtctccccaagatccatgtgctgggagccttggcctgtgagcgacgtttgggccctggggatggagggaggctttgtgagtggataaatgtcccctgttccttttcctttgtgtatgtcccccctttcccttctgttttctcacatgctaaagtgttcacttaaagccaaacagatgctggtagcagtcgtctggactttcaaaacctgagccaaatgtaattctttcctttatgaattacccagtgataggcattcctgttagagcaacagaagatgaacatacaagacatacaaagaataaattcacacaagggattttagttagtttgacatttcttttctttctttctttctttctttctttctttctttctctttcttttttttttttttgcttgcttgcttccttccttctcttgcttcttatcttctttccttttcttcctttctttcctttttttttcttttttctttttttttttgagagagagtttagctatataggcctgttgcctggaacttgatctgtgactagcctggcctcaaactcacagagctctgcctgcctctgcctagcaaatgctgggttaaaggtctgtgtcagcacagctacaaaaggatttgagagtttgagtaaggccatatttattacgtagattgaatcagcaacaatcttttaaaaaaagaagtgtgtgctctgcaaaaggcgccaacaggagaataagacaagtaggagaaaatacttggaaaaaaaacaagctaatgaaagcaaatataatatacacataactcaaaattcaacagtaaggaaacaaactgctcttttaaagtggatacagtaactgggagaaagtgccttactaaggatgacatacaaatggcaatgatatgaggcagatgctcaacatcacatgtcaccagggaactgcaaatgaaatcaactcctgcacaccactgtcacagtcagatttcaaaacaccgaaaatcccaaatggtggtgagggcatgaagtgaaatgatcttgtttattactgaggagaattcaaaacggactgtaggtggtgccttacaagctatatttgcatatattagtagttagtcctagcgcttctcagcacttatccaaaggatttggacacatgcccacattaaacgacaaacaaaaatagtggtcacacagatgcttaaaggagccctcttcaaaatttacaagtgcaagcaaccaaggtgctcttggagtgagtggatcaatgcctgtggtatgtccattcaagaggacattatcagcgctaaaaggtagtgagttagcaggttatgaagggacatggaagaagcttaattgggtaccgtgaagcaaaagaagtcactgtgaagatgctacacacggtagcatttcaactgtatggtgttctggaaaaggtaaaagcagagacaaaagaaaaacctgcaattcctaaaggctacagtaggtgtactgcctggtctcagcgaggcagcttgggagccagtgggtgcccatgaggattggtacccaagaccctcctttaggaagcttctcctctatgctactctctgagaatttacagggctggagagatggttaagtcctgttcccatcgtccacattagaaggactcaagactccctgcaactcttgatccaggggatccaacatcccctcctggtccatccagacacctgcactcaggtatacattctcacacatagacacaccggcattatacatgtaactaaaaataaaataaagcccccttaaaaaaaagattttgctttctggttatatatctacatttacttttattaaaatttgagactgtgtggtgttgtgcaggtcagactggcctgtacttacgttgtgatccaagctcttctccaactcactgcgatccccctgactcagcctccaaaatgccaggaccatagtgcaccacacccaagcttattttaaatagatctcaaatatacttatttgagatacaagtttcattagtaacagctatttagataaatgtatctttaaattttatttagagtttttaattaaaatataataacattacttttccctttcttgttgcttctccaacccctcctgtgtctctctcactccctctcaagtaggtgaccttttgattattatatatcttgttgagtacactttagtatggcttttgtatataggatttcagggctgaccacttgacattggatattggatacatctgcactgactgctcaggggatgccttggaagaggggacagaatgctaaacatcagttatgagacccccatctcctagaaatgacagggacctcatacctagataaatgtatcttttacaactacctaggaaaagacatattttctccaccggtgagactgtttctagattgtcacaggtgggaatctgtttagagaaacatttgccaatgaagaaagttactggacaccagcaactgtttaatgacctgtcttgtcagtgggtagatatagtaagaagaaaggttttggagtgtcagagacctaaatagaaagagttcgtctgctagtggctgtttatgtgacttgggagtagtaacaaatgtctgtgaacacatacacactctctctctctctctctctctctctctctctctctctctctctctctctctcgtgtgtgtgtgtgtgtgtgtgtgtgtgtgtgtgtgtgtgtgtgtaccccacacataggtatcactcatgacttgcagagaccagaggacttgctggaatggattctctctgtccaccccatgattctggggtcaaacccaggactggctacactggggggagggggcagtgtacagaatcctgagcatgaaggtacggtgggcactgtgacttttcagacagactttctcagactttccatacccagtaagcgtatttcctaaaagaaatttggaaaaacaaaaacaaacaaaactcaagcatttttacccagtagtttttggaaagtgactttttaaaacagagtagatttggaagggtgggggtggggcagaatattcctcaacaccaacagcccttgtgaggtgcagacaggaggaccaggttcaaggccagcgtcagcttcatagcaagttggaggccagtctcagttatatgaggttgtctcaaaaagcaaaaaacaaaacaaaacaaaaaacaaaaaccttacacaaagggtccaaaaggctctgtccagctctttctacataatcctctacaaactgtcctttgccctagctaaacatggggacctttcgaacacttcctaacgc

SEQ ID NO: 152 - DNA, 1014 bp, Mus musculus
gatgtgtcgtgtccttcagcggctaacaggacctgaagcctccccacagttccccgctgtttccgtcggtgccccctcggtgtgacttgggcctcagagatggcaaatcccgaggtgctggttagcagctgcagcgctcgccaagatgaaagtccctgcactttccacccgagctcgtccccgtcagagcagcttctcttagaagaccagatgaggcggaaactcaagttcttttttatgaatccttgtgagaagttctgggctcggggtaggaagccatggaaacttgccatacagattctgaaaatcgcgatggtgactatccagctggttctgtttggactaagtaaccagatggtagtagctttcaaagaggagaacactatagccttcaaacacctcttcctaaagggctacatggatcgaatggacgacacctatgcagtgtacactcagagtgaagtgtatgaccagatcatctttgcagtgacccagtacttgcagcttcagaacatctccgtgggcaatcacgcttatgagaacaaggggactaagcagtcggcgatggcaatctgtcagcacttctacaggcaaggaaccatctgccccgggaacgacacctttgacatcgatccagaagagtttgtcaacttcttccttcttcactacaagaaggaagtttcggcctctgatcagatggagttcatcaacgggtggtacattatgatcatcattagtgacatattgacaatcgttggatcagttctgaaaatggaaatccaagccaagagtctcacaagctatgatgtctgcagcatacttctcgggacgtcaactatgctcgtgtggcttggagttatccgatacctgggtttctttgcgaagtacaatctccttattctgaccctccaggcagcgctgcccaacgtcatgaggttctgttgctgcgctgctatgatctatctaggctattgcttttgcggatggattgtgctgggcccttaccatgagaag

SEQ ID NO: 153 - protein, 326 aa, Mus musculus
SLPTVPRCFRRCPLGVTWASEMANPEVLVSSCSARQDESPCTFHPSSSPSEQLLLEDQMRRKLKFFFMNPCEKFWARGRKPWKLAIQILKIAMVTIQLVLFGLSNQMVVAFKEENTIAFKHLFLKGYMDRMDDTYAVYTQSEVYDQIIFAVTQYLQLQNISVGNHAYENKGTKQSAMAICQHFYRQGTICPGNDTFDIDPEEFVNFFLLHYKKEVSASDQMEFINGWYIMIIISDILTIVGSVLKMEIQAKSLTSYDVCSILLGTSTMLVWLGVIRYLGFFAKYNLLILTLQAALPNVMRFCCCAAMIYLGYCFCGWIVLGPYHEK

SEQ ID NO: 154 - DNA, 49536 bp, Homo sapiens
atctgaagagtactcagcttcagaaaggagaaaaagagacaaaaaagcctgaccctgggacaaagatttagctgttggaagaaagggccaattttggcaattctagaaaaaaaaatggactagaacatcaatgagaaattaggatctatacaacattaaagtcaggagaaaggcattcttaactgcacagaatagcttgagtctactggggactaaggaggacacaggccccatgtggctccagaattgctggcccttcccataagagaaggcagggctctagcactcatctgcagtcttcaggcagtagatatctccagaagggccaaagcaagagctgtggaggtaaaaacagggccatgtggtagcagagtggacttacttgtcagtatggctgagacttaactctctacacccagaaatagttggtggtgggagagtcattgtatggtagtgacagtcctacaatatcataaagcattaaaagccagtgaatatcagttctacatgtataatttttattgtcattagagcacttaaatattttttaaagtgaagtcactcaaatattgtatttaaagtaaggaaattatgttgaagcctaaatttgtcactttctgcataggtggcattagacaagttattaaactctctaaatctcatctgcaaaatttgggatgataatgctttcatcagagccaggccagataaagggcaagagcaaccacattgaacaactaagggtgagggcaaccaatgctgccctaaggggcattcttcaaaagataccaaacttccctgtagtgaattgtgaataggttgtcagttagtttgggtttccatagggaaatttttacatgccaggagagacataaatgtattcttctctcaaccaaatagcttcagatatgaaataaaatctatgttgaaaaattttgccatgtaaaagtaccaatcatgagggtcaaccaaaaggcaatactcccattcctgagttcagcctgcgttgatacctacattttgatttaattttttcaagatggagtcttgctttgtcacccaggctggagagcagtggcatgatcttggctcactgcaacctcagcctcccaagttcaagcgattcttgtgcctcagcctcctgagtagctgggattataggtgtgtgccaccacgtccagctaatttttttgtatttttagtagagatggggtttcaccattttggccagcctggtcttgaactcctgacctcaagtgatctgcctggcttggcttcccaaagtgatgggattatgggcatgagccactgtgcccggcctgatacttatattttgaatagttcagcactctccccaaaagttgtctagtttggaaaagtgtgtttttaataagttgtttcaaatgtaaagaaagaatatatatgtttattaacaaaaatcagtttttccctatttccactagaaaaacagtgaacacatttttaaggggtattagtatgaacagataccaaattactagcctgtccagattgcccacagattttaatctgtcccttcctcatagcattgccatgaaaaaccagatagtgcttcaaatgtggcatattctcaatgaatagctgtggaaccagaattaatcaaaattctgttcaaaatgaatgtatagacattacttctgtcctttggtgactattaaaagtagatttgagtatccaactgtctacgagacatttccacttggatgtttaatacatagttatctaaagcctggcctttccttcaatgccagccaggaaatatttgctactagaccactagtttatgaaataattgttacccagctgcaataaaagtagtactgaaattgggtgtttaaaaactttttagcaaattgacacagtaactttatgttatgtatgaacaaaattgaggttcgtattacaaacgtccttatttcattcttttagcaatttatttatgttgtaattttacagaattattagtctgtgaaagaaatgaaaacaaaaccaagtcaactaaccctttaacagatagtctgagaagcactttacagacatctcaaaaacacactaaaaactgaactgctggttctccccagatacctgctcctcctgccatctttttcatcttagctgatggcaatttcatcttcagggtcactttgcacaaacttaagagtcatacttcacacctcttcttccatccttcatacttttaggatatattttcaacattgcagtcagagggatgcacttttaaaacaagtcatatcatgtcagtcttctgctcaataccctccaacagctccaatttcattccatttaaaagccaaggtcctcacaatggccaaggtccagcataacctggttcctgttacaagcttcatttcctaccattactccctgcagctcacaccactgcagacacactggtgtccttgaggttactcaaacacactaggtaggcatctcctcttttgcattggctgttccctctgcctggagaacttaaacaagatatccttcaagtttttgctaagatgttaacttctcagtgaggcctactctccactctttttaaaatgccaacttctcagccttcctcattctcctttctccgttttatttttactcataatatttatcaccttctaacacactatgtacttatgtttgactgtttttgtccactaaaatgtgaactctacaagggcagggatttttgccgtgcttactcctcctgtcccagtgtctaagtctatgttggcatatagaaggtatgccacaaatgttcattaaaggatttggaacaaccaccttggagagtaatttggcagtatatattaactaaaaatgaatacctcctataatctagcaattctacttctggatatttaccctagagaaaattttacacacgtgcataaggaaatgattcatggatgttcactgctgaattttttttgttttttgtaatggcaaaagatggcagaaacctaaatgtccatcagcagtaaaatgcatagaatgatatggtataatcaataaaatggcatacagctgctaaaataaacttggatggatatagcttaagacaaactggtaaggtaagtgataaagattaggtacagagcaatgctatctttgtaaacaaaaacatgcatgaatgattcctatatataatgggaacatatattcaagaaaagtattacaaatggactgaaatgattcacaccaattcatgatagaaggttgcacttgcggagggttggtgtattagtccattctcacactgctacaaagatactacctgagactgggtaatttataaacaaagtaagtttaattgactcacagtttcacatagctggggaggcctcaggaaacttataatcatggcagaagaagcaggcatcttcttcacaaggcggcaggagagtgtgagtgtgtgaaggaggaactgtcaaaaacttataaaaacatcagatctcctgagaactcactcactatcatgagaacagcctgggggaaaccgcccacatggtccaatcacctcccacagggtctctccgttgacatgtggggattatggggattacaattcaagatgagatctgggtggagacacagccaaaccgtatcagttggttaactttataatgctttattcctcataaattaggaaggccaaaaacaaaagaaaatataaaatttgttcaatttggggggttgtgggtattgaatggcattaatgtattgttatttttgtacttttctgtatttgaaattttctcaaaattaaaaaatcatcttctagactgtaagatccttaagaacagcaactatattttattaatattttcattggcagtatctaataccattactgaaaaataggagtcctcaataaatactcgctaaatatgtatgtgttaaataaataaaaattttgttgagagaaaaagaagaaattaaggggagaaagatgaatggtacggatgtaagaagacagaaacgtaaaaagtattttgggtttacaaatgtgtgatttaatacccaggctacctgacattttcagctgagctgttattctaaaacagataggaattttgaatgcgaagataaggagtgaaaaaagctccctttcacccagcagatatgaagaatgtcatagagatctattggcttgagattcaggagcaaaaaattggaattcttgaaatcataagttattttgtagttttcataacactttacatgttttaaaaacataatgagtaaccataacaataaactgaatcttttctgtgctaggattatactaaaagtttcagaggtttattttggtttaaaaaagataataaaagcatgattattattatcagccaacatactgaagaacagtatatatttgattatatatgataatgatcactacctgtcatagatatttcatagtaaaaatcattaaaggaaggaagcatcaatgcaaaataaattctaaataaaaaattctaaattttaattaaaaaataattcttcaagtgacaatttaaaacacataaaacaatttccttatctgatagatttcatctttgctttgtgacagatattccagatgagagaaaatttctctcattttgcacttcatgtcagttcacttgttaaacgtgcttccaaagtattatcagattggacgttggggtatctgttgctttatataagctcgtttacttttttaacaaaaaaaatattttgttttacaaagaactaaacccttcagtgaatattcaaactatggaaaatgcagaaaacaagattgggtattcaaatacagttatgcatagcttaatgatggggatatgtcgtaacaagtgcattgttaggtaattttgtcgttgtatgaacatcatagagtgtacttacacaaacgtagatgggatagctttctatacaccgaggctatatagcgtagcctattattcccaggctacaaacctgtacagcatgctaccttactgaatactgtaggcatctggaacacagtgtttagtatttgtgtatgtaaacatatctaaatatagaaaaggtacagtcaaaatatgatataaaagattaaaaatgggggccgggcgcggtggctcacgcctgtaatcccagcactttgggaggctgagacgggtggatcacaaggtcaggagatcaagaccatcctggctaacacggtgaaaccccgtctctactaaaaatacaaaaaattagccaggcgtggtggcaggtggctgtaatcccagctacttgggaggctgaggcaggagaatggcgtgaacctgggaggcggagcttgcagagctgagatcgtgccactgcactccagcgtgggcaacagagcgagactctgtctcaaaaaaaaaaaaaaaaagattaaaaatggtacacctgtataggagacttaccatgaatgaagcttgcaggagtggaagttgctctgggtgagtcagtaggtaagcagtgagtgaacgtgaaggcctaggtcattactgtacactaccataaattataaacatgtacacttagactacactaaatttattttaaacatttttcttcctttaataataaattaatgttagcttactgtaagttttttactttataaactttttatttttgagacagggtcttgctctgtcgcccaggctagagtgcagtggcacaatcatggctcactgcagcctcgacctcctggacacagtgattctcccacctcagcctccagagtagctgggactacaggcacatgccatcatccttggatatttttaaaaatttttgtagagatggggtctcccaatgttgctcaggctggtctcgatctcctggactcaagcaggcctcccaccttggcctctcaagtgctgggataaacagggataagccacctctcctggcctaaaattttaaattatttattcatttatttatttttcattgcacaatggaaatggtatgaacttttatttattttatttttattttatttttgtttgagacggagtctccctctgtcacccaggttggagtacagtggtgcaatcttggctcactgcaacctccgcctcctgggttcaagtgattctcctgcctcagcctccagagtagctggaactacaggcacccaccaccaagcccggctaatttttgtatttttagtagagacagggtttcgccatattggccaggctggtcttgaactcctgaccttgtgatccacccaccttggcctcccaaagtgctgggattacaggcgtgagccaccgtgcctggccaaacttttaaaatgagtaaactttcttttgtaataacacagcttaaaacacaaacatattgtacagctatacaaaaatattttatttatatccttattctacaagcttctttctatttttcaatgttttaaaacttttttttgttaaaaactaagacaaaaacacagacattagcataggcttacacaaggtcaggattaacaatatcactgtcttctacctccacatcttatctcactggaagatgtccaggggtaataacaggcatggaagtgtcatctcctatgataacacaatcttcttctggaaatcatcctgaggctatttgacagctggcttttttttttcaagcagaagtatactctaaaataatgataatagtatagtaaatatgtaagccaatcacatggttgcttattatcattgtcaagtattatgtactgcacataactgtatgttctacacttttatagactggcagtgcagtagtagtttatttacaccagcatccccacaaataggtggataacgcattgctctacaacgttattgcggtgacattattacatcactaggtgataggagtttttcaactctgttataatcttatgagaagtgttgtatacgtagtcagtcgtccaccaaaatgtgttataatagtaagataccatttggatattctagcaacaacaaaagcattacatagaaacatatgttgaggccaggtggggtggctcatgcctataatcccagcacttcgggaggccgacgtgggtggatcacctaaggtcaggagttcaagaccagcctggccaacatggtgaaactgcatctctactaaaaatacaaaaattaggtgggcatggtggcatgtgcctgtaatcccagctactcgggaggctgaggcaggagaatcacttgagcccgggacgcagaggttgcagtgagctgagatcgagcaactgtactccagcctgggcaatagagctagaccctgtttcaaaaaacaaaaacaaaaacaaatgtattctatgactataaatgtattgatgtttatttacaagaatgactcactgacaagtccagaaacacaaacttataacattgtaaaagttaaaagcaagattgactgataagatctttaccgcttctcttttatgcactcctctcttgctttccaggaatgtttatgtaaacctttgatgtcagcgtttcctgtctttcttttgatttggtttcaatatattcctttaagccagtaacatcattatgttgattgttaaggtttaatattcccctttacattgttttaacatctttgtcagaaatcaattgaccatatatgtgtgaatctatttctggattctattttgttccattgcctatgtgtagtctatatgtctgtcttcaccagtaccaagttgtttagcttaaatagctttatagatataggtaggataaatcctccagttttatctttcttttaaaaaattgctttggttattctggattctttgcatttgcttccataggaattttagaatcaggttgtcaatttctacaaaacagtttgctagaattttcattgagattgggttgaatctataaatgaacttggtgaaaactgacatcttaataatactgagtcttgtaatttatgaacatggttgatattttcattaagttttccaaataaaagggggaatcagcatttataagcacatcacatatgcctcatatagtaatgggtgctttacatgtatcatattaattaaaaatcaccattccttttattagctagattgtgttagggacaagctaccccaaaaaagcttcttggtactgccaacacccccgccccccacccccgcaaacctctccgtaccacccctcctcttcccccaaacctttttacatttctaagcccctatctaggcaccgcggtgaagccaggagacttttacctatcaggtcttgctgctataaagcaaacccaattacaaaccatccggactgcacagtgggaggtcgtgggaagtataaacaaactttacctacaccctccggtaccataaacgtcacaaggtgatatgtggcagagttaaccaacaaacaactccagggtctctctcccccacataaaaccctcattttgtaagctcagggctgcctcctctgtctgtaatggagcagccggcaggttgaataaaggcttgcctgaacttgggtctcggtctctctcggtctctctctccctctctctctctctctctcgtcctttctctcggctaacttcacagattgcacataaaaaagaaaaggggttcagagaaggtaagtaactccctagagaccaataagtggcacagaagggaatttgggccctcatctgtctgactccaaaacctggctttatctattcaccggtccttataactcagctaaaacgagggttaagcaagtgccatcatttatgactgtgaacctcttcaaagttcagattgttcctgaacaatcaagcatttcaaactcttaccatcaagtaaggagatagcgttacatcgtgtgtaggcatatggggattaaagattacattatattttccaaattgcacttgagaattgactgtgccaattatatcctttctgggtatctaccttgttcacagtatgtgggatccaggttgaggaacagcataaaattcttgtaccctgttgcaaaaatttattagtaatccatgcatactggtttaggatttgaaaacaggttttataaaaggtttgctaggtatcgatctaatttcaggaataccctagtagggaaattcagtgacctttacaaatttacccgtggccaaaaaaaaaaaaataagtaaaaattaaaaatcagaacacatccaaagtaattataattaaaattaaccaaagttcctgatccaatcctgataaggggtattaggtttaatatttacagataatttatgaagaaaaagattacggttcaaagtctacttcaggtatttctatttacatttcttggaaaagtttcccagggctctttctgccccagccgccaatctacagaagagtctagtcgactgtccactcatttcacagcacttgtctgaaactagaagacccagggagggaacaaggttcaggcttgaaacgctaagacattcaagatttcaccttgtatgcaaaaatcagaatgggaggctgcagcggggcctcacactcaccggagctaggcgctatagatcccgcacccgcggagcccggcaaccacctgaggggccttggccaggagggggtggccccccggcgccggcggcagctccggagcaaacctggcaaacccgagcagggcggtgcgggttgctcagggagaaaatgaagggagtgatagggtgggggtggcagggaacgggcacaacgccggcttcctccggacggcctcctgcgtcccacctgtgctcctgaaaagcggcccccgacagggcgcggcgggaacccgagccgggagtagggtcacgagttaaagcggcgggggcgggaggatgcgcgggcggcggacggggcgctctcctcccgtctgactctgggcggagcggggctcgaggctgctggagtcgctcgctgactcgccctgcgccctcgccgcggacaccggagctgcggccgctccccgctgtcccccaggtgagcccgcggggcgctgccccggggcgtcgggtgtcgcgggaacggcgcccgcggcgcacagggagggccggggaggccgggaggcagcgagctgtcggggacgccgcgggaaggccgggccgggcagtcggcgccatggagggcaggcgggctggagctgggcgcgagatgcagctgttccgcgccgcccccaagccgcccgcaggtcagtggaggagcgcgcctgccgggcctgcccggggctgggcgggtgggggtgctctgctcctcggtccccctccaagccgccgcccacctgtggccagggctcagagggctggaagccacccccgcccggagcccctgggctggaaggcttggatgccggccggggctccagatggccttgacgcggctcggctggcccctttcaaggcggactgtccccctgttagaggtgggggcggctggaagtgggggctcaggcccgggtcgctgcgctggctgaaagcagccgccagccgggctgcggccgtctgagctccacggcagtgcccggggatggcagcgaccgctctgggacatcgctgcaaccctgcagatctttctcgcacacactacccaacaaaagtgtcaacccttgttgtttgtttgtttgaaaaaaaaagaagactggagagactaaagttttgtgtctggtgaagtgggaaagcgcttctgaaaaaacgaggttgcataactttgtcgccaactgggaggcctttgctatttatacactcccgggctttctccaattttctacagcttactccaatcaagcctctgcccgccaggaacaggtaacctgtgtgtgtccgtttgctccttctaagagcatgcctgatagatacttcggtagcctctccggatggccccttcgtcgggtagcctctcctgatggggtccttcgcccaccctgcctcccgcgccggcgctccgggtgaatgtcaagggtggctggctgcgaatacctccttcagctgctggggttcccgacagtttgcagtttttaaaagtgcaccctcggaagggcttttcagactgggtaaacctgacttttccaaggtcagcatctggtcctggtgaatgaaatgtctaccgggacaactcgttgtgatgtgctgaatatatgctggttggcttgttttctctttgttcctgtggattactgtacatggtgtgtggctagtttgtttaaaatttaattttccctgtatcaaagtggaaagcgcttagtgtcaatatacaactcaccaacatgcttattaacagcttcatcattatgttggtgttcatatgcgagctttggtcaacatgaaatcatctgcgttttaagtcctatagataaagtctccttaaatgctggttaaaatatcctgcctttttgaaggaagtaaaactgttaagtgaaaatcctaatttattaataactttttctttcctttatgcctttacctaagaattactgcatttatgctttgacaggcattttaacacgcacacaggagccacactttaatgagttatataataattatttcattttgaaggtactgcatttgccatacagtaaatatgttttatggtttattcatccagcagtatccttattaatcttttcattaacaagagtttaagaaccttccccatgctattctttatagccagtatctattgttcggagatgttgggcttcctaagaatgcttgaattggaatcaaaagtggggttctagacttggaaagcagcatggtatctaaccagtgacttgtaagatattgtatgaatgcaggttacaattttccttcttcattgctgagtacaagttattattaaaatgtcaaataaagcctgcctttctattccgtatggaaggacgctactcattgtttggggtattttactttgaacaggtttccatagtataatatcaatcttagtctgagggaaaatccaagatccatcccagtctctagagtgacttctccgtcactttgaaaaaactgattctgaagacaataaaaccagcccgacccaacccttttcaaacgtacctgcccccccccaaatagatatgaagtactttgaaaatatgctataaatataaggccttcaataaaaagtcattacaagcgatgccacagactgggaattaggcttaaattgagggcccattttcccctttgtacaacagttatgtttcctgaggctcatactgccccttaagaaccttactggctttctaggaagccaccctgtctgctgtgggtgttaggtaggtgagtctgcttagcgctagaccctatgcaaaggctttgtttactgttttatttaatgctctctacactcataactatttaattctggctacaatcatagaagggtaggtgtagttattcccattttgctggagaggaaactgaggctcagaagggctaagtgatttccctgagattgcagaaacgtcaagtcatggaaccaggattagaaaccaaactgaatcttgttctttacactacaccctgctatctttaactcggtggttttaaacattttttgataatctgtgaaagttttagttacctcccaggaaaaagtgtccacagccacatatatgaaagttttcatataacttcaaggcccacctaccctctgaagtccttcccccaggtcctcaggtctctgatcctctaactatactgagtgaggcagaaaacatatacatcctatatatatgtacatataatcttttactaatgggagcagcccttgaatttggtaactttgaactaggtgaaaattcactttgtaattaaaacaaataaaaaagtgacgtcctacattggaactgattctgtaaacatctaaaatgcagtttagagcaatggtgcttatttgaaaccaggacttctgtatgggcttctccttgcaatattaaagaatatggacttgtgtctttactcactaaatggaaatgttggttgttgttgttgttgtttttttcctctagagatggcagatcctgaggtagttgtgagtagctgcagctctcatgaagaggaaaatcgctgcaattttaaccagcaaacatctccatctgaggagcttctattagaagaccagatgaggcgaaaactcaaattttttttcatgaatccctgtgagaagttctgggctcgaggtagaaaaccatggaaacttgccatacaaattctaaaaattgcaatggtgactatccaggtaagcatctcagatcatgagtttggtgaaagcctcttttaattacaaagataactatggacagtggttttttttttaaataacttttaactatatgcaaaatgttgaagagtaacagataagaaaacatacaatcttagacccttctgtcttcaacatttgtgaaagagtttgtcttcttttttcttagtttttttcttgtatcgttcgctaagttataattttagtcacataatctaattaattttcaggaaaagaaaactaatatttggcttccaatgaagaggttcagctggtttctaaataagccatggaaactagtgttgtccaacattaggactttcttttccttcctagttagtttcctgggaatttctctcttcagaaacttaaagggttcctgctacaggcaaattcttagattctcacaaccctgtgatcatgagaaccatgcaatggaagaatgtgaagttaactaacagaagaggagtggcaggagctagtgaaacacaggacctctttttagttcaaagggagcttttaaatcacatttccttggctgcttttaatatttttttgggggaaagggggaaccatattttgtgattcttaatatatactggttgtgatttattcttatgaaaatatgttttcctgttggtcaaattatctcttgctaaaagcaaagggcaaaatagaagcagattttagtgagaaaaatagatgtgataggtttatttttattattacttactcttcctaagttggtgaaaaatgcctaagtaaataaacaattggtattgaaggagagattaaaaaaaacaggatattactaattttaactgcttattgagaacaaacacttatgattgttagggaaccaaggcaatttttacaatcatatgaagttggtagaattcttgcttgtttctaatgctaggtgttgtatcaagggaaacaaacatttagtgactaccctgttccagtacattatttcatttaattctaacattcttactggctcattttacagaagaggaaactgatgtttgtagagctcttttaaagtcacatggcttggccaggcagggtggctcatgcctgtaattccagcactttgggatgctgaggtgggtggattgcttgagctcaagagttccagaccagcctgggtaacatggtgaaaacctgtttctgtaaaacatacaaaaataagccaggtgtggtgatcacaccactgcactccagcctgggtgacagagcgacaccttgtctcaaaaaaaaaaaaaaagtcacatggctagtcagtggcaatatcaagactttgaaggcaggcattctctctattatattaccctgaaaatggatgttcagttctcagccaaatacttggcaagttgaaattgaaattcttaacttctgagtgataatatggtgtgtctcaatagtgaaaagtttagtttcttataaaggagaaaagcctgtatcaattgaacatgaatattttctacttagaataataataggtaccacttgagtgtttgctgtataccaggctaaacattttatagatgtcatcatgttcaattctttttttttttttgagatggagtcccactctgtcacccaggctagagtacagtggcgccatctcagctcactgcaacctccgcctcccgggttcaagcgattctcctgcctcagcctcctcagtagctgggattacaggcacacaccaccatgcccggctaatttttgtattttcagtggagatggggtttcaccatgttggccaggctgctcttgaacttctgacctcaggtgatccatccacctaggcctcccaaagtgctgggattacaggcgtgagctacagtgcccggcccatactcaattcttaaaacaagttggagggtaggtagtggtatcctcatttcacagaggagaacaatgagggtcttggtaaggaaaaggaccctgtcatagtcaggaaactagaagagtagaactgatattcaaactcagatttattttctctaagatttatgttcgtaattacttcttaatttttagggagctcatctaccttcctatgtttactaaggtggtcaagggaaaactgaacaatggtttaagatattaaggctgctagtaataagcatgtaaaaggtgtttaggtaagtttttaaaaggaactgagggtttcttaattgtgatgtttccttaatttatatcagagcaatcaaacaaatattagataaagacagctttgtaattgagcaaatgaagtgagcaaatggtgacagattatctcagggaaaatgaggtggtccttctgttaaactggagattttgtgtctgcagcagcaaaagaaagatgtttacaatgatagacaccctactaaaaatttctcttttcccactacctggcttactctctgaattacagcagttttctctcagccattgttattcctgtctgccactaaacctttgagggcagggaccaattgtcttctcattgtatcctcagtccctagctcactgctgacacaggagaggtactcatgtatttgaatgactggtaagaatatctttgggaattctttggggctgtttggtcatcagcttcaacagatgcaaaatccctagaatatcaagatgtcatcttattgaggacaattaaagaagctctgcagaaaagagagttaggtgcagagtgatgatatgtgtggggtgcagaccatatatcatatgtggaagggagaggggaaaagatttgtctgctgtattttttctgatcaaaccctggattactttgtgtagcatgacagggtggatagaacctagatttagtgtgtcagacatgggtttcagttttcactgtatcaacactggctagtgatgtgacttgaaaaaactatgtaacttctctgagcctcatctctaaaattggtgtattaggaatacaccgcaggattagtatgaggaaagttcctggaatagtgtatggcacataggtgctcaacattgttcccgccttccatataaaatatactctgcctcactctgggatttaagtaagggtgtagtttctcaatttacagcatgtacagcatgtggtgtgtgtgtgtgtgtgtgcctgtgtgtgctgtgtgtgcatttgtgtgtgtgagagagagagagaggtttggatgagagggaagagaagacaaaagagagacttaagagtatggtaagctttttttttttttttttttttgagacgtagtttcgctcttattgcccaggctggagtacaatggcacaatctcagctcatagcaacctctgcctcccgggttcaagcaattctcctgcctcagcctcctgagtagctgggattacaggcatgcgccaccatgcctggctaacttttttatttgtagtagagatggggtttcaccatgttggtcaggctggtctcaaactcctgacctaaggtaatccacctgccttggcctcccaaagtgctgggattacaggcgtgaaccaccacgcccggctgtatagtaagcttttaggtataattgaaaggccttaggttaatatgacaacagtgcagtgaaaccttttgtgtgtgtcaacaactgagtttcacgtaaaatgctgaggtcaatcctgcgtgactattaaggacacattatgttaatatactttaatttaaacatgagttgaaagggtattttctatttttggtcttactgtcatggttttggtgattagacctaggaatatagtttggtcataggacttggactttcttaatttattatccacctgctgcaaaaccttcttgatgtcccagagaattcattttaaactcttctatttgttgttcaagcccctgtaccttctgctctgctttttctgcccacattttccaccctcttaccttttcttttttttcttttaagctggtcttatttgggctaagtaaccagatggtggtagctttcaaggaagagaatactatagcattcaaacaccttttcctaaaaggatatatggaccgaatggatgacacatatgcagtgtacacacaaagtgacgtgtatgatcagttaatcttcgcagtaaaccaggtaaatcaagtgtgtgcattatttacttgggaaaaagaacagactggaaaaatggtggcaatgtacataatagaaactgacattcaagtggagaagggtgaacatttctgcttggaaatgacacatacaaaattatttttaattttttaaaaatattgtcaacaaatttttataaaaccagaagttgagaaaagcttttgtttagtaacagaaaggcagaaactttgaagatttaattaaaagaatcagagttagggcttggcatgggagtctcaaagattgaaattactaactatgaccctgggtataagtagtcattaagtcctcagagctgaaagtatactttcagggcctcttaacaaataatgagaatattaacttttcatagtttgtacagcaaccaagacctaaaaattcacttgaaagtaaggcctttatgtcatacatgacaatgattttattgtgacattgactaactgccaaacaaaaaacaagcttgtttttcatatagatgaatgctgtattttattctgagtttgtaatatatatttttgccagaaataatatatttttctcaagaccccaaatttttaaatctctaggtgtcattgaaagcgtccttgaagtcagcattcccagactgggttagtttgaaggacacatttcaaaattattacaatttttcttcagaaaattattatcgtataatcatggctattcattttctagagacagtctatgcacagtaagatgtaaactgctaggataaaatacatatttatggcatgaagtctttctgttagcactggggttgggaaaatgagccagaaatctaaagtaatagaaataagttacataaactgttcaacagaactatgtcctacagcttgtagggggaagaaggcataatgatggagatactccgtttttagaattttaagtatattacgtttctctaaagctagtctgatctaaactggtagtttggtgtttttcgaggggtggcggggagtgggatagaggcaagaggtaaacagttcattaaatttttttttttttgagacaggatctcactctgtcacccaggctgcagtgcagtggtgcagtcacagctctctgcagactcaacctcctgggcacaagtgatcttcccaccttagcctcccaagcagctggggccacaggcatgcaccaccatgcttggctaattaaaaaaaaattttttttatagagacagggtctccctatgttgcccaggttgctcaaactcctggcctcaagtgatcctcccatctcagcctcccaaagtgcattaaattccttataaatcatcttaacctttattcgtagacctagactcagtcttcaaaatgtagtatttggcacttaggccattctgctttttcagatttccacattccttctggaaatgcaggtacctgctttattctagttgtcttggtctgttccttctgctgcaacaaaatacctgagactagataacagacaaacaacagaaatttctgcctaataattccggagccggggaagtccaagatcacttaccttaccactggtaatggcttgcaccttcttgctgtattcttacatgatggaaggcagaaggacaaaatggcctggctaatttctcccagccttttataaggccagtagtcctattcatgattgttgacctcctaaagactccacctcttaagactatcatattggggtttaatttccaccataagaactttggagggacacatacattccatgtatgactccctactgttgattccctactgttttctaagatgatttactgtttttctaagcaccagtaggtacttttagctgaagataaaaagtgtcttgatcaaaatttttatgaataagtagggttttgagtgttaatgaggtctaatgaggtcagttctctttcaggcttctgagaaatgaatagaaaaaatgtgagttaatattttttattttttattttattttttatttttgagacagggtctcaccatgtcacccaggctgaagtgcagtggcgcaatcttggctcactgcaacctctgcctcctgcgctcaagcaattctcccatctcagcctcctgagtagctgggattacaggctcccgtcactacccccagctaatttttttttgtatttttagtagaagcagggtttcgccatattagccagactggtcttgaactcctgacctcaagtgatctgcccgccttggcctcccaaagtgctggaattacaggtgtgagccactgcacctggccaaaatgtaaattgttattaaaacaggaaggatctttgttttctgtgaagaaagcatttctttacttaatagttgaggtgattgttactgagaggaactgacaaatagggcagtggcatctcagttcttagaagcatatccatgactattagttatccccaagggtttagccccaagatgtcatcctactggataatctccagggctcattctgatccaatactgtgattataacagcactactgtttattatatatgtttctatatttgaatgtgagagaccttattttctttttaggctgtctcctggctttcctcttatttctttaataatttttgggtcagctttattggctccttttctttcatctgcctcttaaatttgagcagtcctcaaagcttggtcgttttcctacagaaatgtcctccactacccagcctcagccatcagtatgatgaagggactcctaagcagttgcccacactgccagacacctacctcacaagcacctcagaactgcccatccaagagcagcttcatattctcctcccacccactccctaggctgtttcttccttctggtcttctggcttaggttgaaaggcctcagggtcttccgggaatcatttattcttgcagctcaaacatagtttataaattcctgtttctggatggcttcctttctttcctacccaccctgccctaccacctcttgcttttggtgccacagcatttagctaaggacatttaatgtgtttttatattaccactcaaaggctgacctgggacccatgaatctgactgaaaactccttctctcaaggcagagctgcagagaccaggagggacggatgcccagactaattaaagctcctccaaggcctcagccacttggctgctctgtgccgtctcaccattgttagttccaccagttagttccaaccatcatctcataccacatttctgtcccgtaaccctctgtcttgggctctagagctgccctctagctggacacagccctgctgcttccctagattacccagttcttgccagatgctcagacctgcacaaagagccatatgaagagctcaaggaagtctggctatagcgtatatagttaatgtatatattatataacgtaactatgtggtgtatgtaggtataatgtgaacaggtacctgcagccgtgggtctcagatctttcacagttcaagaacttaaaaggtttaagacacaagattctgtggtcaggaggttcagacctttaggtgattcttgtggggactgccccacaattacacctggactctgggagagttgtaggccccatcacagctatgactgtgcgtcgtgacccctgcttgcctttcccagtttacctcccattacacatcatatgttctaggcacactggtctactgggtaccttaaatggaaaacaaaaatctcaaaactgagtatctccagcattattctactttatccctatatgccaagcataatgttgtttactagcttaggaagcttgcttctgttaccatagatttctggctcactttcccaatcctaatgctaacagaaagcttggtgccataatcacctatcttatcctaacagtttaccaactcactgtgcacagattagctctagtaatgaagagctccatcgcattattataatttttcacctcaccattaatctgacaaatatttgagcacctactgtgtgcctgcagggctggtgttagagcagtgaattgataaattccctgtcctgtggaacttgcattctaatgggggagatagattttaaacaagtttaactaaaatcttttggtttagggtaatgataagtgctatgaagaaaaataaactagcataaggcaataacagtagtctcggagtggtcagaaaatgcctttctgaagacttgaaatcttggggagaatatttcaagctgaaggcgtggcaacagaaggccctgaagctggaaagcgtttggtatgtttgagaaaatgcgagggaggcaagtatgagggggcagagttagggccaggggagctgggggccaggtctctcaggacatggaaaggagccttgaatgttattctgagagagacaggaagccatggaagggcttttgataggggagagacaatgataatatacataagcaaaatctaacatgtattcactcaaatatttattaaatagtatctattggttgggtacggtggctcatgcctgtaatcccagcactttgggaggttgaggtgggcagatcacgaggtcaggagatcgagaacttcctggctaacatggtgaaaccctgtctctacttctacaaaaaaattagccgggtgtggtagcatgagcctgtactcccagctactcaggaggctgaggcaggagaattgcttgaacccaggaggcagaggttgcagtgagccgagatcatgccactgcactccagcctgggtgacagagcgagactccctctcaaaaacaaaaacaaacaaaaatagtatctattatgtatcaggcactttttgtgtgtgcaagggtactgcagtgaacaaataaagtcaaggaggtcatattctcattggaagagccaggtagtaaataagtatagaagagcatcatctgtcagtttgttataagtactgtgaaatacaaaacaaagccagcaaagtgaatagctggaggtggttggagaaggtctctctgacaaggtgacatgtaagcagacagcagactaaagagagagcatgcagcctgtgtctatctcaaggaagaaccttccagataggaagaacagtaaaaacaagagtcttgagcaggtgtattttggatatcactgttctaagagctgtacatgcatgaattcattcactctttatagcaatcctatgagttctagatggagactagactaaggtgagagggaggattggagaggcagaggcttaattttttaggggagagaggatggtggtttggactgaggccatatcagtgaaggtgatgagagacagtcctatttgtggtgaagaggctcagatttttaagtgattcttttgcagagataatttgaaagtcatgcatgactttcagatggactggaagtggagtataagaggaattgacaaaaggatctttcctaagttttggcctgaacaactgactgacttacagaataatttattgagaagggaattactatggaagaagcaggtgtttctgtttgcccatttactagagattcctcttagacaccataggcatcatgtaggcagattgtcatccatgtgtggtattcagtggaaaggtcagagctggagatgcaaatttggaagctgtcagcatagaggtggtatttgaaatatgggactggttgaagtcagctgtggagagaatgtggatagaggtcaaggcctgaacccaaagataggccaaaatatagaggttggcagtgggaggatttcagcaaaggagaccaagaagaaacaatcagtgtcccagaagtcaagtaaagaaagtattccgtgtaggaggagcattcaactgcatcaaataccatggagatgtcaagttataggaggactgagaactaggcatcagatttggtaatacactgctcattagtgaccttgacaaggtccaactcaaaatccatcccatattagaaattattttattcatttgtcatagcatgcttcactcatatcttttagcagaattattttctatgtgtcgatcacacaaagttgttcatttcaagagtgacagaatgaccaactgtaccagacatattgctccaaaaacactttgttttggaaacatgtctgcagacatccattaagaatttaagatgacagttattccaaggcaccgtaagattcttacttgtaaaagtaatttttttaaatgtagaggacccactaggataggcaatattggtataaaggtgattaaattataatcttgcaaagataaaggttaaaccaatactttctttaaaaaaggttttgctggctagcctataataattgtatcccacttcttatactacagtgttaaagtagaactctgaccttacaggagatagtttaaagataaatatgtatttacattgaatatcacctgaattaaacataattctttaagggaggaaagaaatgcaaagagtatgtggcttcagactttaattttacagatcaggaactagaaggtcagaaagtttgtcacagaaatgaggcttgaatctagaactctaatttgtgagtgccctttgccttcctagtgcacagcagcaagtcacttaccctgtttatcaaagtgaatgtctctatcccaagggaacctgccaggatcagaggtggggagggaggggagttatggcttcactcctgccctggctggcattcccattttctgtttctcattttggttgaagtacttgcagctatacaatgtctccgttgggaatcatgcttatgagaacaaaggtaccaagcaatctgctatggcaatctgtcagcacttctacaagcgaggaaacatctaccctggaaatgatacctttgacatcgatccagaaattgaaactggtgatgttcttctataacctagaacctcaatttttaacacctcaatttatatttaaaattagtaatttcatctttgaaaacattgatttggtctgtgatattaggacatagtaagaatgatatacgagttattatgtgtcaggtactgttctgagccctttactataactcaagaatcctcaaggaaacccagcaagtcaaggattattattatccccttttatagaagactaaattatggctcagagagttaaatgatctgccaaagatggagctagaagaggcagtgctgaaattgggctcaggctgtttgtgttcttagctatcgtattccaccatctcttgtgcaggatatgccagtgaagtattaatagatagatataatgtttgtaaaacattatgcttgcaaactcttggtatatataaaactctcctgccccaataccacttcactatcatgcatctttgggggtagattgaaggggaggaatgaaaatcagaacatggaatagcatggcgtattcttcttagcaaagttctatttgcaattatgcctaaaatattagcttaggtcattgagttaaaaaataagtattgaaatacttttaacaacagccactaggatttttttttctagagataatactgataacagtactgaaagggaaaactttctaaaatgctgtcttccttttttggtgtgtgtgtgggatgtctattgaagaaacattgttagtgcataatattttaaaaatagatccctcaaactgcttagaaaatattactgtaattactgcaagtgcttcaaatcctatgcttaggatacaaaaagggggagggactcaaagtttatctaggcttaaaaacgaagacagcatttatataacattaatgaaatagagttcagatctttgtctagcctccatccactccagaaatgtagccacttaggtcttaaaaacacatgagtcacggtaaccatgtggtatcaatgtttatttagcttttaaaattttaattcagaaaaataatagaatctgaaaaataatagaatctgaataactggtcttaaatgtatcagcctttcaaaatgcagtcttatttaagtactgtatcatgtttttgttcctttctatggcagagtgtttctttgtggagccagatgaaccttttcacattgggacaccagcagaaaataaactgaacttaacactggacttccacaggtgaggggagcagacaggagtgtaacttacgtttgcacgtatatattgccacagaactaaaatcacctctgttttctagactcctaacagtggagcttcagtttaaactgaaagccattaatctgcagacagttcgtcatcaagaactccctgactgttatgactttactctgactgtaagtgtgggccaggctgaatttggttccagtctggagaaaaattgttttatctggtaatgtttcatatccttggattacggtgtgataaaaaaatataggatgttttcacttgaatgtgcataagggaagcattgatacatctagctctattttgctataataacaagtttacttgttagttatgtcttctacacctctgtataagttctagaaaagcagggaccttgttttgttcactactatttccagtaccacgaacagtgcctggtatagattttcaaacccaaaaggaataggtgtttttaggttctgtgtggttggctctcagcaatctatggctggctgtcagctaaaggttactgccaagggttcttgttacttagtgtcttcaccatggatgtttccatgtttggggtttgtagtatacatctttaacttattacagtctaccttcaagttataccactgcacacagtgtaagaaccttacgacaatgtacttccatttctcccatcttggccctcatgctattgtggccatataatgtatttctacatgtgttataaacccacaatatatgttattaatctctctctctctctctctcttctttttttgagacagagtctcgctctgtcacctaggctggagtgcagtggcgcgatctcggctcactgcaagctccgcctcccgggttcacgccattctcctgcctcagcctcctgagtagctgggaccacaggcgtccgccaccatgcccggctaattttttgtatttttttttagcagagacggggtttcaccgcgttagccaggatggtctcgatcttctgacttcgtgatccacctgcctcagcctcccgaagtgctgggattacaggcgtgagccaccgtgcccagcctattttttctttaaacagtcaattatcttttaaagtgatttaaataataataaaaacatttttttatttgcccatgtagctaccatttccagtgtgcttcattctgtgtgtagctcccagtttgtatctggtattattttccttctgcctgaagggcttcctgcaacatttcttacagtgcaggtctgcactttcagcttttgtatgtttaaaaaagtattttgccttcctttttaaagttcttattagcatcttttaaataaaaattttacgaatacgtatttatggggtacaggtgatattttgatgccagcattcagtgtgtaatgatgaaataagggtaattgggacaacattcaccacctcaaatatttaccacttttttatgttgagaatattctaaatctactcctctatttatattgaaatataaaataaattattaactatagttgccatattgtgctactaaacactagatcttatttctcccatctcactgtatttttttttttttttttgagatggattctcgctccattgccaggctggagtgcagtggtgtgatcttggctcactgcaacctctgcctcccgggttcaagcgattctcctgcctcagcctccggagtagctgggactacaggcacacgttaccacgcccagctagtttttgtatttttagtagagatggggtttcaccatgttggccaggatggtcttgatctcttgacctcgtgatccacccacctcggcctcccaaagtgctggaattacaggcatgagccaccgtgcccggccctcactgtatctctatacctattaacgaactcttatttatcccccacgcctccccaataccctttctagcctctggtaaccattattctattccaagccttcctttgctaaaggtagtttccttggctatagaattgtaggttgactgtttttttctttagcactttaaagatgttgcttctagcttgcattatttctaatgagaaatctgctgtcatctttatctttgttcttatctatgggatgttatttcccatctgttggcttttaaatttttcctttatctcttactttaaaacaatttgattgtgaaatgctttgatggtgttttcttaatgtttcctgtgtttaaggttcattgagcatcttggatctgtaggtttatagttgtcattatatttgatatttattcagcatgattttcttaaaatatatttgtcacttccccccaccttttcagagattcagagacaaaaacgtctgtatttggttacttggagttgtcccatagttcagtaatgatctgtttgttttatgtctcagtttttttcagtgtgtttcattttggatattttctgttgctatattttcaaattcactgttttttcttctgtgctatctaatgttttctaatcccatccattatttttcttctttctttgggattcagtttactgagatgtgattgacattaagtcccagttttttactcaatagatatttagtgagcacctattatttgtacaagttggaggccctttgtgtaggaaaagcatggcttctccgtagcaaggatttctgactcaatcaagtaacactgagcgtcctccttgcacgaggccataggctgggtcttgcagccgttagggatatgggcagacactgactgtgccctcagttgcttgtcaaagaaagaagcttacaatccctcatgaggagaaatacagtggttgaacttttaaaagtcatttgaaatcttatatttgaagtgtttctgattaccccatatggagaagcttcaatacaatttatttaaatgacaaagttttcaaagaactttttttcttcaggacttgagagaaagagaagaggcagaaatgaaacggattgattttcttgccttgccttccctgtccttgcataaggaagacagtaggaaaactatggaaggtgttctggcctagctttgtcctgcttggcccctggtgtcctgaagtggttattcttgaagcaagatgtgactgttgactccctgtcaccaaaccctttataatacatgtagtgccaacgtgactaagaaatctaggcccagaataaaaatcaaaaaagctccacttgaaatgtctcaaagcagaaataatgagcctttgtattagtaagaattatagcagcactaaaaatctacccctaactgaggtcctgccggaatttgggagaaagcacagttgtaccagttcttgctcacatgaagaaggtatctggaggtacttagaacagagagcaagaggaagtgctcttgttatataagttctttggagtggaaatgctgccctagacatataatgttttagagactacagggtctctgtagaagatctagttcatcgttctcatttcacagagaaatgaagagaacttcccatggttgaacagaattagcaacagatcagagttgagaatctgggtctcctgtccccttgaaagaattgtttcctaattaatgtgtagaggtttcttggctccaaaactataagtatgtttttgactgttttcctgtcttcacagataacatttgacaacaaggcccatagtggaagaattaaaataagtttagataatgacatttccatcagagaatgtaaagactggcatgtatctggatcaagtaagtgatgcgcattactagttttcagaatggttattaaataatgtaaaatggttattaaaatagcaccctctggatatctagaacaacaaatagaagattagaccattttcaagtccctaaacctctacaagtagatcaactctgatgtttcaggcaatatgtgagtcatgaataactgaaatggccttcctctccttgtgccctcacttgcccactcctgaccaagaatgtactcacagtcccccgccaccaaaaccctacatacatcttcccagaccaacacttaccgagtgcatgctgtgtacctacttccaccttagttttcttcattttaatatttttaaatgcccttaagatagggagaatccttatttttacagatgaagaaactaaggctcagaagccaggggcaagtcaggtaggatgtgaccctgcagcatcccacatattatgattgtcttcagtccatttaaaagtgtactgaaagaggaaaggatctactcttagaaatatggacaaaaattcaggtgtagaccaaatactgtcaagaattttggagctgaactggagagaattgcctggaaagaatttatctaattttctagtctctcataagtgacataatggtacatcgtactggacttaatggtcgctagatgaggagttctcagattctaatcagcagaagaatcatcctgggtacctgctatgatgcagtttccccagctctatgcaagccagtaggtctggggtggggcctagaaatgtgtaaatagtccttactcagactatacttggataatcacagttctaaagtttcttactaattgatttgccaagttcagacgtaataatgagatagagtaaataaaatgaaattttgccatgatagtatttttttcactaataggtaacttcaaatatatgaggctcttgagtcacatttgaaacataagcctgttttgtcatctgtatactttataatcattctccacaaacaccagaatgaggaaaatgagagcatacacaagtgtctggcacctaggcattctctcaaatgtttgtttcttaatttgtaagtttctctaaagtcaatttagacatttatgtagtaattatgctccttggcagatactaatgggatgcttcatcacagagctagttttaagtactttcttttttttgtcagcagagagcagtctaacttgttaaatagagacaagctctgtggcagtgtacaatggctgacacctctgcccacctctctccattggctccacgcatggtggccaggacttcgcactttcgattctccaaaatctccataagggtggctctttcttatcactcaggtttcagctaaaaccccctgctccctcagtgaggccttcctttactatgcaatataaatcaacctctctgcttccacattgcccgacactaacctccctcatatagagcagtaggtctcaaactttagcatcacctggagggcttgcagaaacccagtttctgattcagtgggtctggagtaggacctgagaatgtgcatctctaacaagctcccaaaaaatgccaagaaccactgacatagagtgatggacactggaaacaaactgcacagattttcccccagctctttcactgactagccctgcaactgtggggaaatcatgtgacctctctgtgcttcaggtttctcgcctgcaaagtggggataatcatgcttacctcattggagttgctgtgaagatcaaataggttaacacatataaagtgtttagagctatgtttggcaagaaatgtgctcaatacatgttagctattgtgatttatcttctttctattacttactcctatctgaaagtattttgttatgtgtttgtttacttctttgtagtagaatagaagttccacagatcaagggccttgtctatcttgttcaccactgtatcctaacatctagaaaaatgcctgacacatagtgaatgcataataaatattttatacctagataagtacattttaatagaatatgcagggagatgggcctgggcatggtggctcatgtctgtaatctcagcactttgggaggctgaggtgagaggatcacttgagaccaggagttcaagaccaaccatggcaacaaagtgaaaccctgtctctacaaaaaaattaaaaattagcccggtatggtggcatacctatagttccagctacgagggaggctgaggaaaaaaaaaaagaatatgcagggaggtaattgtattaagaacaaaagactacaggcttataattaaagatcttggaatgatagttgtggtgatttttcttttttttttttttgagatggagtctcgctctgtcacccagcctggagtacagtggcatgatcttggctcactgcaaactccaccttccaggtccacgccattctgctgcctcagcctcccaagtagctgggactacaggcgctcaccaccatgcccggctaatttttttgtatttttagtagagacagggtttcaccgcattggccaggatggtcttgatctcctgaccttgtgatccgcctgcctcggcctcccaaagtgctgggattacaggcatgagccaccacacccagcctcagttgtggtgattttttaaaagaaagacttttgcccttcttcaaatactaattggaagaccgtttatcagggcttctttgttgtcttaccagaaagaatgcttgaattatttaaatgattctaaaaagaagatgtcaccatattaatgtcccactacataagcactatgtaatcctctttgctttcagttcagaagaacactcattacatgatgatctttgatgcctttgtcattctgacttgcttggtttcattaatcctctgcattagatctgtgattagaggacttcagcttcagcaggtagggaacgttgctttctaggaatgctactgacattttgattgacagagacattcactgtgcctcccctcttttccctaaaggagtttgtcaattttttcctcctccattataagaaggaagtttctgtttctgatcaaatggaatttgtcaatggatggtacattatgattattattagtgacatattgacaatcattggatcaattctaaaaatggaaatccaagctaaggtaatttttttcctaatcatgctattgttagtgtcagatttgcactaatggtaatgtatttttccagaatgtaagaattttcagaatgaattgtttcttccaaactgtatatcaagtagacttgaaattggtaatggtaattttcttaaatctagtcaggaggtctcttaggcagagtttttcaaagtgtgatccacaaaccattgcatcagaatcattgggtgcctggtaaagtgtaccatgttagacctactgaattcagactcttcggcggggcctgtgaattcttacacacaccaaaattcatacacaaccaaggtaactaaggtaagagtttttttttttttttaatcttacaagaaatgctcgaatctttaacaaaaatgagtggggctataggggaaagtgaggtcaaggcactatggtgtgcatgcttgcatttgtttcctccgtccattcaaagtgagaatgctcccattttcttactttaccattgatgtgctacaagcttatttattttaagactaacctagcctaaaaatcaactgtccccacaaaataaaaatcacattaaaaaaactaatagtgttcagactaatcttgctcaaacttatgtttccctagtcttgatgcaactgattgagtcacctggggagttggttataaacctgggcagagaccccaaatgcaatggctcagagaagataggagcttatttctgtcttatgcaatagtcagaatgggttttacagactggtgagtagctcaacatctcacagtcattcaggcacccatgttcctcccattttgtttctctgccaccccttaaggacttgccctgactgcatgattattgccgtgttgcctcaaacaggttgcagcttatgggaagcaaaaacacggtatggtagaagctctcccatagactgatggcttggctcaagagtggccgactttatttctgtacatatcccactggatagaatttagtcaatcctaactgcagagggagccagggaacacagcccaggcatgtgcctaggaaggggagaatgggtttaggttgacacttagcagctgccactatatgtggctatagtatgtatcattggaatagatgtttaactttagggacaaataaaaaaccaaaacaaaaaaaggagtaaggggagagatttgcagcaaatctttatttttaccaacctcaactatcattaatttcagtgaaccctaaatggtatccaacaaaatatctttctagaccattcaccgtctctgcctcatagatgatcatatcatgttttcttctcttctgaaacctctaatacccttgtcctatcctcattctaagctgatgaccttacttcctatttcacaaaaataatagaaaaaaaaaacagaatttccacaaacccccacctaatttatctgcctcctgccatcagtgccaatatactgtgcttttcttctgtggatacattatttaggccactattcagggccaacccctccacctgcctactagaggccatcaccacttgtttattcaagggcacagctccaggtagttttccttctcttggggatcatcagtttccttctgtctaccaggtcattcccattagcatgtttttgccgcttttcttaagagataatatctcaaccctaattcctcccgctaacttactaccatcatttatttagtaaaatatctcaaaaaagtagttaatcttgttgtttctgattctgctcctcccctcccccacctgttttttttaagagacaggatttcactctattgcccaggctggagtgcagtggcgcgattatagctcactgcagcctcaaactcccgggctcaagcaatcctcccacctcacagccccccaaaatctcattctttcggtgtctgttccaatcaggctgccctgccactccaaggaaagtgttcttttcagtgtcctctcatgctgataagtccaataaccaactatgtaccctcatgctgacctagcagcagctttgaatactgccaagcactccctttttgttgacatgctttcaatggactatcacctggttttcctcctaagtcactggctggtcttctgactttgctggttccctcacatctcaccaacctattaaggtgataatgcttcaaggcatagtgcttggacatcttctcttttctgccactgtcttggtaatctcatcctgtcccacagcttagtatctatatgccaatgattcccaaatctatacccccacttagaattcttccctgaactccagattcgcatatccaccatttagtctatatctccacttggatgtctgcttttcctctcaaatttaacacacctaaaacagaacatctaaagcccccacctctgcagtcaaaacctgcttttcccatagcctttcaaatttcggttaatggtaactctcatcagttactcaagccaaaaatcttggattcatcacagactcctctctttcactaatctcttctttcccacatctaatccaagaggaaatcctattgttctaccttcattggccaggcactgtgactcatataatcccagcacattgggaggctgaggcgggaggatggcttgagcccaggagttccagaccagcctgggaaacatagtgagaccccatctctacaaaaaattaaaaaaattagcagtcaaggtggcatgtgtctgtaatccaagctacttgggaggctaaggtgggaggatttcttgagcccaggaagtcgaggctgcattgagccacaattgtgccacggcactccagcctgggtgacagagtgagacccctgtttccaaaaaaaaaaaaaaaaaaaaaagaataaaaatcacctggtcaactccactattaccagcctggtccaagctactatctctcatttatattattgcaatagcatcctcactcctccaacaacctgctgtcaaccacagcagccaacatctgatcatatcacttctgtttgtggttctcaaatctccccaattgagttacagtaaaagacaaacttggtgagtgccaccttatctctataactgtataccctttctattgctcactccagccagatgcaatatccttgccaagcaccctcctgtctcagggcctttgcacttgccagtccctgtgcctggaaggcttctcccctagatttttgcatgacttctccctccctcccttcagatctttgctcaaatgccttctttttagtgtatgtaaaatgacaaacccatacccattccttatcccctcctctgaattttctcttcagcaattatcagcagcaagtgtcccaaagtttctattaacttatttctgttgtctctttcttccctccactagaatgtaagctttatgagagcagagacttttgtttgttcactgctttatccttagcacctaaaacagtgccttactcatagttacctcaatatttattgccaaatgaatttctgctttataatctgattatatttttccactctctcttagagtctaactagttatgatgtctgtagcatacttcttgggacttctaccatgcttgtgtggcttggagtcatccgatacctcggtttctttgcaaagtacaacgtaaggaattccacggatctccatgctgttggtatttctctcaaagttattgcactgctttggctaaaggacaaaaccattctaatggcctctcttactttcccagctcctcattttgacccttcaggcagcgctgcccaatgtcatcaggttctgctgctgtgcagctatgatttacttaggttactgcttctgtggatggatcgtgctggggccttaccatgacaaggtactgataaacaacttttttcctgttactattaagcttttagcatagtgccagtggcttgttatcctttttcaatgaactccttttattttgtgattcagccttaaaatgttgaaggtagtatatctagtgccatatttataaagtgaaagggtgtgaccagcttgagagaatatttgatgtactcaactgtctcacattctttcttgcaatatatcaggtaattaagtcccgtttaccaccagtgaagtcaagtttagtcaatttgattcatcgatatatccaaaagcagtctcttcagataagccttctcaaaatgtgacattatttaaaaagtagcatagggggaaacttgtagaaatatttgaaaattttattactagagctatagtctggaatattatgctcttatcttaaatgaaatgaactttaaaatgagatgtatgagcatgcatggttgggacctgggtatctctgcacaggcatttcaaggtctctttaaggtaaagggcagatgcaaggcttgattcaaaaaagcactgagggtgcagagcagctcctacatttgatttaggctagtttaagagaaagctgcttgtctcaggaaaaaatagtaggcttatttatgttatatgcatcacaaagcaaatgtgtgtggttacctcaggttatttgtttgaaaatggtagcttgggttatctggtccctttatgtttaatacaatgtcatgaacaaaggtctccaatgggaaggaacatggaataaagtgaacttttctcttttctttttccagtttcgttctctgaacatggtctctgagtgccttttctctctgataaatggagatgatatgtttgccacgtttgcaaaaatgcagcaaaaaagttacttagtctggctgtttagtagaatttacctctactcattcatcagcctctttatatatatgattttaagtcttttcattgcactgatcactgatacatacgaaacaattaaggtaggtttatcaagagccataagtagtagcattgtcctataacttgtagagtagcagtaaaattcagtacctaatggtagaagaaaagttgatggaatgttaatttcttcaggatagagaaaaaggaccttatttttagaaattgataaatagaactagtggaaaaattgaatgttgaaagtcttagtctctaagtagttatactttctcacacaagctttctaaccttttattagaattataagggtcattagaagtctggggggcaaagagtaaaaaactaaataaagaattataagggttagtagatattgtgtgaataaaacatatggcatttcagaaagccaaaatattgtggggaacataaaaactccaattttcataaagaaaaattgacccctttgttttgagtgtactgtaactgagcccattttctttgcaaggccctgcagggcacaagcccaggggcccagcctccagaatagcaaaaggattaatgggtccagtactagcatgtagctttatacagtcagatacctgaactgaaaagctattgtcattcatataaaatcttttaaaaatcaatttgagcctgttgaaatatggaaaggcagaataaatatccatatatgtttcaatttccataacttatactgttaggtgtatttgtggcatagacacttccacttggggacttttctttctgggtatgagagggataaagaaacatgaagccatgtgattggccctagggataaagagaacgccttggtttgaagctgataatgatgaatactttgctcatgaagccagggctgtgacttcatcctcactgaacaagatttcagggaccgaatgtcctctttgctctcatctgcttagcagatgtgtccttaggatcaccaaggcaactgggaaagaatgtagttgtaacttcagatccctccaaatggtgctctaaaagttcactgcctccaactctgcgtgcagagaactgtgtgttattcgagggtgacatctgagagctctaaggataacatgggttttcacctttgatgacataagcctgaaactcgtattttagacgctaacctctttccgtgggctcagagcacttgccaaatgggcaagctaagttacttctgatcctttctaatcatggcatgtcctagaaattttaggtcccaaaccgatataaatatgaggcccttaaacaaacttgcctggctggaagactgactccaaaagggtgtgcagattggaaaggtcccttacagcattcagacctttgtccagacacttgggccaactcgagagagtccaagactgtgctgaggtgttctgggcaaggccagggatttccatccctcggcctactagaaaaccttgttaatttagatccactgggcttcttgtggcctgaaccatgttccttcaaaaatgcctgcatcacactggtctggaagtcacaggcctgcagggcagagtagtgacagaggttctcggacttgggatggggctagctcaattctccctggaaggacgactcagacttcgactcagtgtgcccatttgggtttcagtggacccagaaagagagctcaggtaggcagctgcagaatcccaggcccactttacctccgccaaacctgagtgactctagaggctacatctcctttgcaggtactcaggagtaacgatactatctctctagaaaaccccctcccttgccaaatgatccattttgaatttggaatgaagctgttttcaaggagcttattaataaaagctttttaacattcttctgtttagcaataccaacaagatggcttcccagagactgaacttcgtacatttatatcagaatgcaaagatctacccaactctggaaaatacagattagaagatgaccctccagtatctttattctgctgttgtaaaaagtagctatcaggtttatctgtactttagaggaaaatataatgtgtagctgagttggaacactgtggatattctgagatcagatgtagtatgtttgaagactgttattttgagctaattgagacctataattcaccaataactgtttatatttttaaaagcaatatttaatgtctttgcaactttatgctgggattgtttttaaaaaaactttaatgaggaaagctattggattattattatttcttgtttattttgccatggctttagaatgtattctgtatgcctctcttttgctctgatactgttgctcctgctattctgattgtgcagactgtataattagtggaaaacaatccttggtctgactgtgactttggacaactcagtaaccctggcttggaccactctcaggagtccatccttgagagagtgggtgtagttaccatttatacagtaatcattgcattttaaaatcttctcttgaaaggaagaataagagtgcaccagaataagagcgcaccagaataagagcgcaccagctaacaatgtgatacggccatatgtcacttaaggatggagatatgttctgagaaatgtgtcattaggcgattttgtcattaaacatcatagcatgtacttccacaaacctagatggtatagcctactacacacctaggctatttggtatagcctgttggtcctggggtacaaatctgtacaacatgttactgtattgaatacagtaggcaattgtaacacaatggtaagtatctaaacatagaaaagggacagtaaaaatatggttttataatcttctgggaccaccattgtatatgcggtacatcattgaccaaaacatcgttatccagcatatgactgtatttggttatgaaagccaactgttacttgattctgcttttagttcttaagaggatcaggcttttaaatactcatttacaagttttctatcctccttcagtgttaaagtagaaagtaaaaagagtatcttatacatgcatgaaattaaagcatataccaaatgcatttttgatgaagtaattattattttattagtacttgagcagcctgttaaaactagtgatgtactatacctttcataggcacattatgtctcacagcgaagtgttttggggtgagaggctgtggttttatggggcaaggttctataactcacattaaaaatatttcggggctatgcacagtggctcatgcctgtaatacctcactttgggaggccaaggcaggaggattgcgagagcccaggagtttgagaccagcctaggcaacatagtgagactcatatctacaaaaaaaacagaaaaaactaaccgggcgtggtggtacacgcctatagtcgcagctacttgggaggctaaggcaggaggattgcttgagcccaggaagtcaacagcagtgagctgtgatcatgccactgcactctggcctgggtgacagagtgagactctgtctcaaatatgtacacacatatatatatgtgaaaataattatgcttaaaattttaagataagataaatgtgtgctgtaaaaagacataatagtctctaccccttatagactgctaattgagaattgcagggactttcaacacatgaatatttattgtgtttactatttattcaaatagaagtgaattcagttatgtgcagtaaagatcttctcaaagcaaactttttttaaaaaaactgatttttaaatttctaattttgttttactgagatttttattatttaattataatgacagtcataataatgactccaggtgttgaaatgggaggttttataacaggtataagctgtttctgaagtacctgaggctttaaaaaaaaaatctaaatatctaagtgactattttgggggcagttctaatatttataatactatcacttttagaaattactagaattctatgtgagttttgaaatcatgtttattatctgataagtccttttctttacatcttttgagatttttagactaacagtacttcaatggaaacatgaaaacactgacgcagtgttgggcctggagttttgctttgctctgaagtcattatatttcttctgtagaatcacagccaatgacttgctgccttcacatctctctcctatttctccaggctctcttattgtggcaggagtccctgataaattccaaggcttaatttttagtaatgatgtccatgagagaatagctcttctgtctactgaaagaaatagcactgactgacttttttgaactgtcctcaaaccagtacaatggcttgatctgggtaggcagataaattatgggccattttagagctctccttacatgtatatatgtatcatagagaatgtcaaggcagttgtaagaaagaacatagaatggaagtcacttttcttccaggcttctagtcttcttatcccaggaaatcagggctggatttttgtcgatgataccccctttttctggaagtcagattctctgtcccctcctcctgccataatgattttcagggttgtaagcataaggggatttttttttttttttcttgagatagagtcttgctgtgtttcccaggctggaggctggagtatagtggagcaatctcacctcacttcaacctccgcctcccaggttcaagcgattcttgtgccttagcctccagagtagctgaaactacaagcacacaccaccatgcctggctattttttttgtatttttagtagagacagggtttcgctatgtgggccaggctggtcttgaactcctgtcctcaagtgatctgcccacatcagcctcccaaagtgctggaattataggtgtgagccaccatgcccggcccactgggggatcttgttaaaatcatgaatgtacaggtaataccagcagagatattcatattctctctctctcctctttctttctttctttctctcttttctttatctttctctttctctttttgtctttctctttatcaaagcctaagcacagattcttattcatcatgtcctgggggaggccaggaatctgccatttttagccagcacacaaagtgattctgacacaagtggtttgtggtggctgcagggcccagagctcaaccaggaacagataaatccctttgttgggctacaaataagttgtttataagtctcagtattcagaatggtcttctatcactcaagagagaaaccacagtagtcaagagagaaacaccaagaaaatgggcttatagatatcaacgtggatattttagtatttgtgtctgtaaaaatcatttttgtgcagacattgattttgctgttacatttttttaaacaattcagatgccattttcttttttcactcaataaagttttaaattatctaatacatattgagttttaatttttttatcccaccacactattttcaaattaaattaatacatacaaataggtgtatggattagaacaaaaaaggtaaaactcattatttgcagatattataatctacatagaaagtctaatagaatctaaaaaacacatgggtcaaagaagaaatatccagaggctgaggcaggaggatcacttgagcccaggaagtcgaggctgcagtaagccatgattgtgccactgcactctggcctgagcaacagagtgagaccttgtctcaaaaaaagaaagaaagaaatcttgagaaattaaaaattattttgaactaaatacaaatgcaaacacaaatgatcaagaattatgggaaacagtaaaagcagtgcctagaggaaaatttatagcattgaatgcatatattagaaaagaagaaagatgtaaaaatcaatctcctaagcttctaccttagaaaatggacaaagaagagcaagttaaatccaaaggaagtagaaaaaaataaaaattatagcagaaattaatgaaattgaaaacaggaaatcagtggagaaaatcaacaaaaccaaaagctggttctttgaaaagacagataaaatcagtaagcctatagccaagctaactaagaaaaaagagggaagatgcaaatgactaatactagacatgaaagagggagcatcactacctatcccatgggcattcaatggataataaaagaatatatgaacaaatctatgcctgcaaatttgaaaacctggatgatatggaccaattccttcaaagacacaattgccaattgacaaaactaacacaagaataaacaaacaatctgaataagattctagtaaataaatggaatcaataatgaataaccttccaaaacagcactgggcccagatggttttacgggtgaattctactaaacatttaaggaacaaataccaattctgtataatttcttccagaagacagaattagaatacatcctaatcattctgtgagaccagcattaacttaatatcaaaaccagagagagattataagaaaagaaaactaaagatgttgatctcttatgaacatagatgcaaaaatcctcaacaaaaatattagcaaatcaaattcaacaatgtatgaaaaaaattatatactacaagcaagtgggatttattctaggtagcaaggctgattcaacattcaaacctgaattaatgtaatccctcacatcaacaggctgaagaaaaaatatcacatgatcatgtcaatacatacacaaaaagcatttaaaaaaaatctaacatccattcatgaaaaagccctcagcaaactaggaaaaagggggaacatcttcaacttcataaagaacatctacaaaaaaaacctagagttaacatcacacttaatgatgagaaacttagaagtttttatgctaagatcagcgacaaggcaaggatgtcccctcttaacactccttttcaacatcatactagaagttctagctaatgcaataaaatacaaaaaggaaataaaaggtgttcaggttgggaaagaagaaataaaactgtctttgagatgacatgattgtctatgtaggaaatctgagagaattaaaaactcctggaactaataagtataacaagattataggatacaaggttaatacacaaaagtcaatcactttcttgtatatcagcaatgaacaattataatttgaaattaaaaacacaataccatttgtagaaatatcccccaaaatgaaacacttggctataaatctaacaatatgtagaaattctatatgaagaaaactgtaaaactctgatgaaagaaatcaaagaactaaataggtggagagatatttcatgtttatgaataagaaggctcaatattgtcaagatgtcagttcttccaaacttgatctataaatcaacacgaccccaatgaagacccaagggagttattctgtggatataaaaaaactgattttaaagtttatatggagagtcaaaagaccagaatagacaacacaattttgaaggagaggaacaaaacaaaaaacaaacaaaaaaaccaaaaaaacactgcctgatgtgaagacttactataaaactacagtaatcggctgggcacagtggctcacgcctgtaatcccaggactttgggaggccgaggtgggtggatcacctgaggtcaggagttcaagaccaacctggccaacatggtgaaacccataacccattttgtctctactaaaaatacaaaaaaaattagctgggcatggtggcaggtgcttataatcccagctactcgggaggctgagacaggagaatcacttgaacctgggaggcagaggttgcagtgagctgagatcgtgccattgctctccagtctaggtgacaagagtgaaactccatctcaaaaaaacaaacaaacaaacaactacactaatcaaggtattggtgaaagaatagataagaagatcaatgcaacagaatagagaacccaggggccagcgcagtggcccatgcctgtaatcccaacactttgggatgccaaggtgggtggattgctttgagcccaggagtttgagaccagtctgggcaacatggcaaaacctcatctctataaaaaatacaaaaattagccgggtgtggtggtgtgtgcttgtagtcccagctacttgagaggttgaggtgggagggttgcttgagcccaggagatccaggctgcagtgagtcgaggtcatgccactgcactccagcctccagcctgggcatcagagtgagatcctgtttttaaaacaagaatagagggcccagaaatatacccacattaatatagtccactgatctttgacaaaggagtaaagagaatacaatggagaagatagtctgtttaataaatagtatggtaataactggacatccacacgtaaaaacacgaacctagacacagacctttcactctttacaaatattaagtcaaaataaatcatagatgtaaatgaaagttggaaagtaaaaactcctagataataacacaggaggaaatctatatgaccttgggtttggcaattaccttttttttctttttcttttttttttgagacggagtcttgctctgtcacccaggctggagtgcagtggcgcaatcttggttcactgcaagctctgcctcccggattcatgccattctcctgcctcagcctcccgagtagctgggactacaggtgcctgtcaccacgcccagctaattttttttttttgtatttttagtagagacagggtttcaccgtgttagccaggatggtcttgatctcctgacctcgtgatctgtctgccttggcctcccaaagtgctgggattacaggcatgagccaccgcgcccagcccccaccttttttttttcttaaaaacagtttattcaagccactatttgaatatttcttttttttcaccttttaatatttcaataggcttttggggaacagatagtgtttggttacatggataatttctttagtggtgatttctgagattgggtgcacccaccactcgagcagtgtacactgtacccaatgtgtagtctttcatccctcaccacctcccaccctttctcctgagtccccaaacccattgtatcattcttatgcctttgtgccctcatagcttagctcccacttatgagagagaacatacaacgttctgttttccattcctgagttacttcacttagaataatggtctccaactccatccaggttgctggaaatgccattatttctttcctttttatggctgagtagtattctattgtatatatatcacatttttttatccactcgttgattgatgggcatttgagctggttccatatttttgcaattgtgaattgttctgctataaacatgcatgtacaagtgcctttttcgtataatgacttcttttcctctggttagatacccagtaatgggattgctgaatcaaatggtagatctacttttagttctttaaggaattcagactgggtgcagtgactcacacactttgggaggctgaggtgggtggatcacttgaggtcaggagttcaagaccagcctggtcaaaatggcagaaccccatctctactaaaaatacaaaaaaaaaaaaaaatagcggggcatggtggcatgtgcctgtaaatccagctacttgggaggctgaggtggaagaatagcttgaaactgggaagcagaggttgcagtgagctgagatcacactactgcactgcagcctgggtggcagagcaagaccctgtctcagaaaagaaaaaaaaaaaaaaaaaaggaatccccatactgtttttccatagtggttgtactagtttacattcagcaccagcagtgtaaaagtgttcccttttcaccaaatccacgccaacatctattatttttttattatggccatttttgcaggaataaggtggtattgcattgtggttttgatttgtatttccctaatcattcgtgatgttcagcattttttcatatgtttgttggccatttgtatatcttcttttgagaattgtctgttcatgtccttagcccaatttttgacaggattatttgttttcttcttgctgatctgtttgagtttcttgtagagtctgggtattagtcctttgtcagatgcacagattgcaaagattttctcccactctgtgggttgtctgtttgctctgctgattgtttctttcactgtgcagaaactttttagtttaattaagtcccatctatttatctttgtttttgttgcttttgttttgggttcttggtcatgaagtctttgcctaagccaatgtctagtagcatttttccaatgttatcttctgtaatttttacggtttcaagtcttagatttaagcctttgatccaccttgagttgattttttgtataaggtgagagatgagaatccagtttcattcttttacatgtggcttgccaattatcccagcactatttgttgagtagagtattctttcctcactttatggttttgtttgctttgttgaagatcagctggctataactatttggctttatttcggggttctctattctgttccattagtctatgtacctatttttataccagtaccatgttgttttggtgactatagccttatagtatagtttgaagtcgggtaataagatgctttcagatttgttctttttgcttagtcttgctttggctatgtaggatcttttttggttccatattaattttaggattttttttctagttctgtgaagaatgatgctggtattttgacgggaataacattgaatctgtagattgcttttggcagtatggtcattttcacaatattgattctacccatccatgagcatgggatgtggttccatttgtttgtgtcatctatgatttctttcagcagtgttttgtagttttccttgtagaggtctttcaccttcttggttaagtatattcctaattttaaaaaattttttgcagctattgtaaaagaggttgagttcttgatttgattctcagcatggtcactgttgtatagcagggctactgatttgtgtacattgattttgtatcctgaaactttactgaattcatttattagatcttggagctttttggatgagtctttagggttttctaagtatatgatcatatcatcagtgaacagtgacagtttgacttcctctttaccgatttggatgccctttatttctttctcttgtctgactgctctggtcaggaattccagaactatgttgaatagaaatggtgaaagtgggcatccttgtattgctccagttctgtcaactttccccattcagtataatgttggctgtgggtttgtcatacatggtttttataagcttaaggtttgtcccttgtatgctgattctgctgagggttttaatcctaaagggatgctggattttgtcaaatgctttttctttatctattgagatgatcatttgatttttgtttttaattctgtttatgtggtgtatcacatttattgacttgcgtatgttaaaccatccctgcatccctggtatgaaacccacttgatgatggtggattatattttgatatgctatttgatatggtttaactgtgtccccaaccaaatctcatcttgaattcccatgtgttgtgggagggacctggttgggggtagttgaatcatgggggcaggtctttcccatgctgttctggtgatagtaaataagtctcatgaggtcggacacatttataaggggaagtttccctgcacaagctgtctctgtgcctggtgccatccatgtaagatgggacttgcttctccttgccttctgccatgattttaaggcttccccagccacatggaactgtaagtccattaaacctcttttttttttttttttttttgagacagagtttcactcttgtcacttaggctggaatgcagtgatcttggctcaccacaacctctgcctcctgggttcaagtgattctcctgcttcagcctcccaggtagctggggttacaggcacccaccactatgcctggctaattttttgtattttttctttatagtagagatggggtttcaccatgttggccaggctggtctaaaactcctaacctcaggtgatccacctgccttggcctccaaaagtgttggaattacaggcgtgagccactatgtctggcccattaaacctcttccttttgtaaattgcccagtctcagttatgtctttgtcagcagcatgaaaacagactaatacagtaaattgg

SEQ ID NO: 155 - DNA, 1762 bp, Homo sapiens
gcgccctcgccgcggacaccggagctgcggccgctccccgctgtcccccagagatggcagatcctgaggtagttgtgagtagctgcagctctcatgaagaggaaaatcgctgcaattttaaccagcaaacatctccatctgaggagcttctattagaagaccagatgaggcgaaaactcaaattttttttcatgaatccctgtgagaagttctgggctcgaggtagaaaaccatggaaacttgccatacaaattctaaaaattgcaatggtgactatccagtacttgcagctatacaatgtctccgttgggaatcatgcttatgagaacaaaggtaccaagcaatctgctatggcaatctgtcagcacttctacaagcgaggaaacatctaccctggaaatgatacctttgacatcgatccagaaattgaaactgagtgtttctttgtggagccagatgaaccttttcacattgggacaccagcagaaaataaactgaacttaacactggacttccacagactcctaacagtggagcttcagtttaaactgaaagccattaatctgcagacagttcgtcatcaagaactccctgactgttatgactttactctgactataacatttgacaacaaggcccatagtggaagaattaaaataagtttagataatgacatttccatcagagaatgtaaagactggcatgtatctggatcaattcagaagaacactcattacatgatgatctttgatgcctttgtcattctgacttgcttggtttcattaatcctctgcattagatctgtgattagaggacttcagcttcagcaggagtttgtcaattttttcctcctccattataagaaggaagtttctgtttctgatcaaatggaatttgtcaatggatggtacattatgattattattagtgacatattgacaatcattggatcaattctaaaaatggaaatccaagctaagagtctaactagttatgatgtctgtagcatacttcttgggacttctaccatgcttgtgtggcttggagtcatccgatacctcggtttctttgcaaagtacaacctcctcattttgacccttcaggcagcgctgcccaatgtcatcaggttctgctgctgtgcagctatgatttacttaggttactgcttctgtggatggatcgtgctggggccttaccatgacaagtttcgttctctgaacatggtctctgagtgccttttctctctgataaatggagatgatatgtttgccacgtttgcaaaaatgcagcaaaaaagttacttagtctggctgtttagtagaatttacctctactcattcatcagcctctttatatatatgattttaagtcttttcattgcactgatcactgatacatacgaaacaattaagcaataccaacaagatggcttcccagagactgaacttcgtacatttatatcagaatgcaaagatctacccaactctggaaaatacagattagaagatgaccctccagtatctttattctgctgttgtaaaaagtagctatcaggtttatctgtactttagaggaaaatataatgtgtagctgagttggaacactgtggatattctgagatcagatgtagtatgtttgaagactgttattttgagctaattgagacctataattcaccaataactgtttatatttttaaaagcaatatttaatgtctttgcaactttatgctgggattgtttttaaaaaaactttaatgagg

SEQ ID NO: 156 - protein, 497 aa, Homo sapiens
MADPEVVVSSCSSHEEENRCNFNQQTSPSEELLLEDQMRRKLKFFFMNPCEKFWARGRKPWKLAIQILKIAMVTIQYLQLYNVSVGNHAYENKGTKQSAMAICQHFYKRGNIYPGNDTFDIDPEIETECFFVEPDEPFHIGTPAENKLNLTLDFHRLLTVELQFKLKAINLQTVRHQELPDCYDFTLTITFDNKAHSGRIKISLDNDISIRECKDWHVSGSIQKNTHYMMIFDAFVILTCLVSLILCIRSVIRGLQLQQEFVNFFLLHYKKEVSVSDQMEFVNGWYIMIIISDILTIIGSILKMEIQAKSLTSYDVCSILLGTSTMLVWLGVIRYLGFFAKYNLLILTLQAALPNVIRFCCCAAMIYLGYCFCGWIVLGPYHDKFRSLNMVSECLFSLINGDDMFATFAKMQQKSYLVWLFSRIYLYSFISLFIYMILSLFIALITDTYETIKQYQQDGFPETELRTFISECKDLPNSGKYRLEDDPPVSLFCCCKK

SEQ ID NO: 157 - DNA, 47856 bp, Mus musculus
  misc_feature (1)...(47856): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgagagagcttgacaccctcattacacatcagtttcccatagatacatagggttgtttctgaacacatttatcattgcaattttaaaaatcctgtcttgagcatcagccaagggaacattatgatggagtaattaataaccaaaacatcgttttggttatttgtattgtttatggttttgtgatggattctaggcatctggaattagactattggtggtgtttcttggggtggatatttggtcttgctttgttgagtagaggcttggaactttgctgttacccaagcttgtcagatggtgggccagataaatggcacttgaggttcagtcttcgagccaatctgtattgatgtgaaaaaggtgtcaaaagtggtcttaactcagtataggcacatcttctgaacccaggagcaaccctcagtaggcttagaaggtttgtgtgtgtgtgtgtgtgtgtgtgtgtgtgtgtgtgtgtgtgtgtgtgtatgtgtgtatgtgtgtatgttttgagacagagtttctctctgtagccctagctgtcctagaacttgctctgtagaccaggctgacccctaactcacagagagtcacctgcctctgcctcctaatgccaggagtgcatcactacccagaatgcttagaaggctcttgctgtcaatcttcaggaatgtgtggaaggctcattagtggtctttaggtggcagaggctggagtcacagtgaatggtgcttcgtggaagtgtggctcaggatgctgtaccatcttcttgtggagataggtagggtagaggccaagctggaggttcttatctggattcaaggacacaggacaccacgaggcaccaggcatcttgatatgtggcatgactgggtctgaagatctctaactaaggatatagttgtcaggaattcacatgcttctgaggtggcaccatgggtgggtggggtgactagaaggcaagcaagggggagtgagtccaggggtccctgcttctctttctgaatttgaaatcctcttttcttggtctatgccaggtgtgaattttggctgaaactgtaaaacatgagttctccaatcttgttctttttgctttccaaagattcacaatctatttatccattgaaacctcctttgaacttgggcatcagccctgattttgtttctacaaaataggtccatagaatctccacagggttgcctcgaatctgagcattgccttgggttgttttgctatctaagtttccatgttggccaaatagaatgatacaggtctgccattgcagttcccagaagcgaaagcagataaatcacaagttcaaaaccatcaaggctatgtagcaggtatgggaccagtctggcagccatgaatccttgtctcaaaacaaacactaaaaaggtgcctcattcgatctcccagtgagcaaagaaagatttcttcccttgcctttatcattttagcttgctttctattgctgtagtaaacgccaattaccaaaagccatttggggaggaaagggtttatttggcctacacattgctgatggaagaagccaaggcaggggctctagtagagcaggaacctggaggcagaaattgaagcagaagccatgaaggaatgatgcttactggcttgctccccatggctgtctcagcttgctttgttatagaacttaggaccacctgcccaggggtggggctactcacactaagcagagctctcccatattaatcatcaataaggacatgatctacgggccaactttatggaggtgtttcctcaactgagattttcttttcccagatatatctagtgtgtgtcaagttgacaaaagctagccagcataatatactccttgtcaagttgacatacaacgtttcactgttactataagccttcctttcttgttcatccctaagatctcatattaataatgttataatataaaacattccaacttttaaaagtcccacactctatagaaattcaaacactttaaacgttcagtttctaccctgtacccccaaaacccaatacaaacaaaagttcagtctctttaaaacatccaatgtctctttcaaagttcaaagccactctaaaactacagtctctctagaagtccaaagtctcttaactgtgggatcccataaaataaaataaaaagttacataattttatactccaagagggaagagtcagggcatggtcataataaaaccaaaaccaacgtccaatagtgtaaaacgttcagcacctggcatctggaatgtactcatgttcctgtgggctccaaagacctcaaccgtggcacttctccagctctgccctctgccacacacacagcttgtcttgtgggctcaggcgggcatccctccatggctgctgctgtccttggtggtcatctatggtcccggagtctccaaaatgttggcctctgtactgtaattggactgtacctttcccaatagcctctcctggcctctcctcagagactctaaccttgttacatggggccaggcctcactctcttcccgtgaccccttcggtattgaagcttcaactgcaactgagtctgcaccttctccaatggttccttatggcctgtgtgtgtgaatgtatatgtgtgtatatgtgtgtgtgtgcctctgtatatgtgtacatgtgtgtgcatatgagtgtgtgtgcctgtgtgtgtgtgtgtgtgtatgtacaccacagtgcagatgtggaggcagaggatagtctgtaaaacacagttctctctttctccagtgtggattctgggaacagattcccaggcttggtggccagcaccttacctgctgacttaccttaccgcatgactcttttataggagccgtgaagacgttctggatgtagacagtgccaatggtcatatagtccctgaagtggaccaaaagcaatgaactacaagctttaaggcaaattttagggcttgtggcttatatctcaatatattcacattttgacaatttcacatatacatacaatgtgtttcgatcatattctcttattactttcttttattctcctccttctcttactaactcccttctttcccccaactagtcccccttccagtctctcagtgtgtagcacactgagttcaattggggtcgattgtctaggtgtgggtgggaggagagtcaccatagaccgacaacgtatcagtccacactactgaggaagacagctaacttaaagatcactctttttctcggggactcccaattggagaatggtttcttaatgtgtccgggcaatgtcccctggcaaggacagtgtgagtcctgtcactggcaggggtgagctgggacaacttttgacatttcacataggctagccctgtgtttctgagggatactgagggccaagcaccagaaataaagtcttcatgtgagagtctaggtaaacccccgaggcaccatgactctctgagtctgacaccagcctcaagcccacagacaaggggcagcttctccttcattttctgggggcagtttggaagtgttaagagctgcttcaccacagagacagagaagctgtgtctaaacttgagacacaagagccagaaaggccggttggctctaggccagggcctcccctgaagcagagggtggagcaggaaggaatgactgtgggttttaatcccctgtgcacagaaagctctctggctggggagcctgtctgactttctgcagtggacagtttccctggccagttggtgctgccccaggtgctccccttgcggccgggggtggggtgttccacagtggaatcccacagtcacgtgcagtgtgcagggccatcagtcagtcacttcgcttcctgtaggctataaggagaaaccagagtctagacctcttaagtgcgactggcagctagttgtactttgtatgcctgagtccggctaagcccctgtgagggatgagcagccgtgggtgagagtcagagtcgtctgctctaaatatacacacgaaacgagtagtttgtcctggctaaactggtccagtcatttcactgtggactttgctgttaattttggcccaagaaatggccattgcgtaaacagtctcacttagcagaaagccaatgtttatgcctggaagccacttttcccatttctgccagagtagagtcacaccctgcctttacagcccacccaactcacccttgtccctgccctagcgtctcgagagtgtgcctgctctctcccaccctccctgttgggccctgtccttcatgtagagacgtgaaggtcaagttgttaatgtgccttgtagcctctcatccccagaaccccgacttctctcagctcttgtcatgggcaaacttctccagcctctgacactgtctcaacctcctcactccgcccttttactgtaaagctccgttaaaagcctagagaatgcacttttatcttacacaggacacctcagccacactcacaggtcattctaccagaaaataaacaccaggcaccattgctcatcagcctgctctcccttacacccttcccactgcttgtccaggacccacatgctggtactctcgaggggagaagccagtattctgagggaagtaagggtaagaaaaaagactgttcttgaccaggaccacaaacaatggcagccactcagaaaaccccaccttctcagagactgaaggacaaaagtcaagcagacaccccatggggggtcacagatgccctgcatgggccgagaaggaaagagaatcacacctaagatggctccatctcagtgctgcctgggtggactgaacaggacctaactgccagaggcacatttctcatggcctcctccaactcctgccttctcattataattatttatttatttatgctccttccagtgctcccttctagtcccctcccccgaaaggccctcctcacccccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactggtcgtgtatcaataggcacacacactcatacatgatgctcaggttgtccacatgcatacagtggcacaaatacagcacacacccgcacgtatgtgtgcacacagatacacacatacatgcacacagagtaaagcctcatggaaacagagactgttagctctcctctggctagcctggatggcttttgccagggccttaccagcacctgtacccagagggatctgctgagcctccacctatggtcactgggagacaagaaggtccatgtgaggcaggccaatcactgctcagagcctcctcctccatgtaagggtgttcccctgagttcagtatgatttgaataaaggcctctgccttacccacagtggtaaagccactacaggaagttctctcaatccttgtggcctggaggcagcctgacgtcgccccacccctcctcctgttttctcaagcatcacctgctattttgggagggtgaaggacacattttcccggctctctttgctctccacaacacccagcacagaaccgtgtacacagaatatcttcggccgctggatgcctgtgaactaaattcagcaaatggaaaccataacaggtttccaggccaccactcttacaaaacacagattcttttttttaaagattattaattattatatgtaagtagactgtagctgtcttcagacacaccagatgaggatatcagatctcattatggatggttgtgagccaccatgtaactgctgggatttgaactcaggacctctggaagaaaagtcagtgctcttaaccactgagccatctctccagccccaaaacacagatccttaaacataagcaaccccttcattgaaatgactgttcagttatcataggcaaggacaaggccatagctcagcagtagagaccttgagtgaggcataggtttgatctccagcatgacaaaaaggaacacacacacacacacacacacacacacacacacacgcatacacatactcactggggggcataggaaacctcctattaatggtatgttattttttaaaattacattgatagatggatggatggatggatggatggatggatggacagatggatggatgattgattgtgtccatgtgtcatggttcatgggcagagcagaggacaacttgcagaagtctgttctctccttgtatgtgggttccagggagattgaactcaggtcttcaggcatggtggcaaaccttaacctcctgatccatcttgcaagcccatttgatttcctcctcatgaactgtagtgatggcttatggcatctaattttcattcctttctcttccagggtcagaaagcatggatagagaagacattttgcaaaagggaatgcatctttgtaattcccagtacaaaagaccctaacaggtacgttggatgctattgtagagacatgatccaagtcggggctggtctggcatgtctcagcaactattcttctaatgtctgtgggagaagggagaggaggcaaggacatactagactctctccccaccagagccattaacacagagtcactgggctaatcagctcctcttttgagaggtaaatgccttggcagaggactttttctttgcaagtctcttgtgagctctctctctctcagccagatgtgagcaagatctttagacagtttcaggatatcttccagggcctcagcagtccaatcctctaatttatttatacaaaaaggaacttctatccttgggaaagatgtgagtggctgagtgaaatgactatggcccttgttcacaagatggccagcacttccacttacccgactgaaatgcatgctatagggtaaacagaaagccttccaaaacactccaagcaatctggaggattcagctgaaacatatcctctgagagaaaaagctgaggctaagctaaagggtaggagagacttacccacaggctctccttacaattcatgtgagcagggtcactggtgcaaaatgacacagatgcctgggcatcacctggttcagatttgcttggtgtctcatgtcctcaagctccctgttccccccacctcgtaccctgcaggccttgctcctcacctgaacccttgtataactaggagagaaagaggccctccatcacaggccttctctttcttcatcccagcaactgagaggtgaatagctctgtccctcctcctcctgctatgatggacaaaggtctttgaaacaatgagaaaaagctttcctccttattccccaagtcacatgactttgttatagaaaatagagagaatcaagtcctaaaatccacatgaacttttgtaagaagggagggaaggagagaaaagaggagcaatgctttggtaaatattattttgagggttttaccccacttagaccatatagtttctgaaataaaagacgcagaagccttaatatttataataaacttaaaagcaatagagctgggcagatatcagccctccgtgctattgtgtctacttccttgtcaataacccaagatatcacttgccatgtttcacctagactactcctacttcatcgctcatgatatacctagccgatagcaacttctctctctttcctcttattcttctcctgctccctgcctcggaccccaagctggggaaccctcattctgtcctctctcttctgcccagcccagactttaggcatcttagtaaccgatcaggaataacttggggtggggggtggggggtggggggaaggttcacacaacaaaagttggtgtccgtgaagatttcgggtagaaaaaaggtttcactgaaacaaacaagcaaacaaaaaaccttgaagaaccatgcggcaccctagaattccagaaggccacttgtctgttccaaggctatgactatacttgctacaaattgttcagcaatgttcacagggccctgtccacgttcttgaggcagtagaaagataaccagtcatccagtgagaaagaacagccatgcaaagtgttgcaagcagactggtatataagtagtgatgtgttgctctttgggaaatgggcatttcaggggacacctctgtccctgataaagctgataactaagatattcctgggggccctggctggtgccagcttgtccgcttaggctaccttacactcactggttggatggaaggaaggaaatgctgctgaatggcctgctttgctttgctttcagatgttgctgtggtcagctcactaaccagcacatcccccctctgccgagtggggctcccagcacaacaggagaggacaccaagcaggcagacacgcagtccgagaaatggtctgtcagcaaacacacccagagctacccaacagactcctatgggactcttgaattccagggtgggggttactccaataaagccatggtaagaggggtgatggggtgctgtacaaagcaacttagccttcactagggcctgtctcctggcccttaggatgcagagacctgggtcttcttccggcttacagctcagctttcataggcacattactgcaagtccatgagatggttctgtgcagatggattttacccattcatcagaacttgacatcactgtacatgcagcctcggagaatccaccccaagctctgaacctaatgcacaaagcatgcccaagcccacccttgcacacatgcgcctttgccccatccccagtgtcctcctttgctttgtattgctatgatagatactgcgaccaaagaaacttaagaagaaaaagggtttattccatcttatgtttctaggtgatataataggtcatcgctgagggaactcaagacatgaacctggaggcaggaactgaaacagaggccacagaggactgccgcttactggcttgctctccatcactttctcagcctgttttttttttttttttatacatcccaggatcacctgctcaggggtggcaccctccacactgagctaggccctcccacatcaattattaatcaagaaaaatgccctacacacttgcccacaggccagcctgatagacaaaaagcattttttctctctctttttttaaagaattatttattttttttatgtatacgagtacactgtagccgtcttcagacacaccagaagagggcattagattccattatagatggttgtgagccaccatgtggttgcagggaattgaactcaggacctctagaagagcagttagtctcttaaccactgagccatctctccagcccaaagtattttctcaattgaggtttcctcttcccagatgaccctagcttgtgtcaagttggcaaacaaacaaaccaatcaaccagcatacctactggtgagaaagttgtttaaaacaatattaataaccaagggctctccatccttctcagtccatgtggagtctctgcaagcattttcctctgaagtcagcttccctgtgtcttcccttctcaataagaggaaggaggcagtctctcatagtttgccataggtagggctgctacctatatttcattggtctaacattatgattcaaatacaattgttatgttctgaataccacaatataaggttctctgggatggcttcctgtatattagcatgggcacacatagacagcccagaggggccatggcctctggacactaatgtctttttcaccctgaagagaagaagcaccactttcatgaccatgaccactttcttcctcactcagcgatagcattgctcaacattccagacctttgttctagccgagtcagtttggaaatgattctttcaaggccaagtttgcaaataagtcacaaggcactcaggtatgtttgaatgtcagacaaaagaagagaccatttttagtacaactctataccaactcttatgtgatgtcctgcatttagtaaagatactatgctaaaccattttagatattcatctaaaattcaaatttagacaggcacattagcctggtcagttgacactaccatactttacatgaggtgatttataaacagaaatatactctatgcaattctcaaagctaagaagcctctaatcaaggtctcaattgagtatagtttctccccttgctggataagtgttaccttcttggtgtgtgctcacatatgtgagaaatgagcaaacccctgtgggcctcagaagcaccgtctcttatctacccttacccctgctgcactgggatggagtttacacatgttcctgtcaggctgacacaatccccatctccagttacggtcacgttaggggttggtgcttcaacaaggaatttgggagatgggtagagtactgatcttcaaataacactgcacaataagataacatttgataaaaaaaaaaaagaacaaattaatgatataaacttatatggtttgatctcataagcattattctaagtaagagaagccaaaaaccgtgtacctgtgactcaacttagacagtattactaaaggtaaaactctggagacagaagccagtcagtgatgccaggaattatgtgttcagcaaacacttgaatcatggtcctgtattttcctttgctgagttgcccttctttccccaggttacctttagtcagttggctgcagattaatgcagagggccccaagatatagagagcctccagacactgggggagttcttgtttggacacgtgtcatatccctgttcccctttgacagggacacgaagccaagcgcgggcgcgctgagcaccaccccttcttttgcagtacatccgagtctcctacgacaccaagccagattccctgctccacctcatggtgaaggactggcagctggagctcccgaagctcttgatatctgtgcacggaggcctccaaagcttcgagatgcagcccaaactgaagcaggtgtttgggaaaggtctgatcaaggctgccatgaccacgggggcgtggatcttcaccgggggtgtgagcactggtaagagcggccccgcccttgctgtgagtctgcgctgatggactcactgaagctgcagagggcctcccagtaagaactggctggaagactcgacacaaggaagcctgatcccaactgtaacagcatgttgagctttactcaacatggtttttactattatcgtggttgatttgtttagatagtacaaacatacttttgttaggtggctttccatcaccatgactgacagctgagatgatcagtttataaagggaaaaggtttactctggttcacagtgttagaggtttcagcctatggtcagttggaccattgctctgggcctgtacatatctcatggtgggagtacacagctcttcaagggcacttcccagtgactggcagaccacaggctgggtcctttctcttacagtgtccaccacttcccaatggtgccctgctagacaccaagatcaaacatgggactttgcagggacaatcgagatctaaacctcagtgagcataacagcgatgatagtgaacctctgagtcagctagtctgtgccattccctgagaatgaactgaaccatatatgaattaaggaacatccctggtggcctggctcttactgatagcagaatgtagctaggactacgagtgagacccagtgacttccagctttgggtcatagaaatccatgcatagccgtttggggctttgctcatattttccctactccaggagttaacacaagatcaatagttgtgatgagcacagacttgtgggatgtattctctttatgaaggttccatccctgatccacagggattatggaggctcagagtaggcacccctgaagttcatcagtgttgatgtggcatgatgtggctcaggaggtcctgaaatgtggcatgtggctgctcacaggtgtcgtcagccatgtgggggatgccttgaaagaccactcctccaagtccagaggccggctctgtgctataggaattgctccctggggcatggtggagaacaaggaagacctgattggaaaagatgtaagttttctctgaaggcactgacaggttttaaaaaattgaagtctgtattttgagactgtggtaaatttgtatattgttataagaaataccagagaacacctttcactcattcctctggtggaaggttcttgaaaaatggtagtataatcaggatgctgacattgctgccatcaagatacctcatcaactgaaggaaatctcctgttgtcctttaatatctataccaatctcctcccatctctccttcctccttaatcctaacaaccactaaggtgttacatatctctatcattgttgattatgttcacaatgtggtatcacatagtatgcaaccttaggaggatgggtttttcccatatggacactcagattgctatggcttccttctgtgatatggatagaccactgcaggttgtttaaccactatctcttgaagaacatctagactgtttatctctggtctattaaaaataaagtttctataaaatttgtgcttagggtgctggagagacagcttagtgaatgggtaaagtgcttgctggacaggcataagggcttgtgtttgtattcacaatactcacatataaatccaggtgtagcgtgtgattgtaacctcagggctggaaatgaaggcaggaggttctggggctcattgtcagccactctagcaagccagtggacttcatgtttagtgagggaccttgtcttaaaaataacctctgatctccactggcatgtgtagctaccacagatgcacacacagagacactcacccgtgctcaggattttatgttactgttatttttcatttctctgcagtaaatacatgttcaattattgggctgccactgtctaaagcaaacagtttttttcttttttaatacattaattgagaaaatagccttcagtgtgtagggtagagaaatgacacttaagtttacatgtggtagctgagcagtggtggcacacacctttagttccaacattcatgacaggcagaggcagaggcagaggcagaggcagaggcagaggcagaggcagaggcagaggcagaggcagaggcagaggcagaggcagaggcagagaggcagaggcagaggcaagcagatctttgtgagtttgaagctagcctggtcccacagtctatacagaggcctacgcagagaaaccctgtatcaaaaaacaaaaccaagtttatatgttgtgtgtttacactcatttcttgtgtctcctatgacacttaatatctaaattctgcagctttgattcacatcatgctttctgtcaggtaacaagagtctatcagaccatgtccaaccctctgagcaagctctctgtgctcaacaattcccacactcacttcattttggctgacaacggcaccctgggcaagtatggtgctgaggtgaagcttcgaagacagctggaaaaacacatctccctgcagaagatcaacacaagtaagtcctgggaggccatgggcaccagctcgggactgactctaccagggtggaagccagctgagaaggaaattaccagagggtgctgattcttgctaggtccatggactatgctcaaactctttgccctagccacctaccaaatcaccctcccagagcagtaatgggatgttttgcccaggttcacaatttggtctgagacttacccttgcactgtttgtcatggttgtcaaggtgatggcactgcccaccatgttgccctcggtcttgttcagtgtacttactgctattattttccttcatgttttatcaggaaaaaaaacctaaaaacttgttcccaaagatttggtataattcagattgtgacccaatgagtgttgtagaatcattacatatctctatagctctcagtctcccacatggactaagatggtgagataaggaaatccttggacttggctacagggccatctgttcctgatggtcaccatacttggtggtccagatggcacagctcactgctggggggaaatgtgaggataaattagagagaaaggactggctcccaaccagatgagaggacccataaccttctgggaaatgcccacatgcaaaacttctgtcagacaattatgaaatgatctcacagaatatttcattcttatcatcaccaggaatatctttgtgcaccacaatctagaactaggaaaatgtcagaatgtaaggaagtgtggtatcactcaagtggttagaactggggtgcctactcctaaaggctatagatttccaagaatcagcttaaactatttctattaattctctgagagttttatacaatttagttttatacaattattctttttttttttaagactgagtaattctttatttctacatacattaacgaaggagctttccttaaacattctctcgaaggagctttccttaaacattctctcgaaggagctttccttaaacattctctccaggggaaaacagagcatgagagcggcttccagctgctctgctcagggcctgggctcctctctgcccgaatggtgaggtggaggggtgtatttcccctctttcattagcttctcccgctgtttcttgatatcatgcattcgcctcatcgttttgtaccgaagcaagcactcttcgaagtcatcgaactctatcttgcactcctttttcgcccgggtcccaccgatcccgtgtgcacactctatccactctttttcaaacgcgtggcaccgagcggcgttcttgtagggctgttctgcgcttaggaacataaagtgccggtccaggctgatgcccagctttttctgtatgtcaaggaaaggcatggctctgcagtgcccttgtcaggtccctggtgcaattcccgaccaccggctgcttatacaattattctattcctcacctacttgtcccagatctacccccacctcccaaacagcccctgaattcatgtcctcttttaaagaaatgactacttgactcctactgttctgaccatgcaatcacaggtgtggggtcatccactagagtgtggtcaacctaccagggccgcacacttaaaaaaaaactgactcccttcccacagaagggaatttgtcaactcctccccaccctcatgctggaatactgaccggcttgatcctgtgcagccagccacactgtgagttcatgagtgcggaggtcctaagaatcagatcttggtggataaatcagtttgatttagtgtttttggacttgtaaattctgcttggacctgtgacctgtgggcttccctttgtcatcctttgcctaggcctctgagtgaggcaaggacagcaaaggggggctcagtggtcacctctactgcagagagttcggaagcctagcctgagccaagagcaagttcttctctgcttctggaaatgaagtcgccatgatcctgacgacgtaaaaatcccaagcatgcttggatggaaatctcagagacagacgatgccannnnnnnnnnnnnnnnnnnnccctccctccctccctccctctctctctctctctctctctctttctttctttctttctttctttctttctttctttctttctttctttcttttttgagacagggtttctttgtatagccctgtttgtcttggaactcactccgtagaccaggctggcctcgaattcagaaatctgcctgactctaccttctaagtgctaggattaagggtgtgcgccaccaccgcccggcttcattttccactatttcttattcatggcttagcccagtgggtcccacccttcctaatactctgaccctttaatacagtcacttgtgttgtggtgacccctcaaaccataaaattatttttgttgctacttcattactgcaacattgttactcttatgaatcataatgtaaatatctgatatgcaggatatttgatacgtgactcccctaaggggtagagacccacaggttgagaactgctggcttagcctatgccatatcttcaccgtttgctggctggaataaactcaactgtaattcttctaacaggagacaacaaagttatcctgaatccttaagtatccactggggaaaacaaagtagaaaaagagagactctgaattcactcattgatagtctcaaggcttcttatagcccgtgctggcagattttatcggaagctcttgagaaccataacatcaaggacatttccttcctcttgtctcttgtaatgttgctcacaactacagaaaccaagcaaaacctgatcagcagtcagtgagcctgggtgttgccaaggtccaaagcccaaaacttcactggtcacagacagaaaaacattcaggagagaaattctgtctttaattaatgtgtatggagttttttcccagttgctatccctcagaaacacaatataataactactttcatgtcattgcatcatgccaggcgttatgagtcccctggagatggcttgaggcacacaggagaagatacatgcagctgctacatcattttatataagagtcctgagcatcttgaatttggtgtccagggggatgttataaggttctggagccaatccctagtagatgcctaggaacaactctataatatgttctggccaggcagagatgacattttgaagtaggcaagtttgtcacgaagcctcctctccagcactttccccccagtattatctcagcttccagaattctcccatcacttcctgctggatctatcaccaaaaatttgtctattcctactgtgcccttgaagaattatattatttatttattttaaatcagagtagactctggaaataagccattggcaatgggctaatagtactccacgcttttacccctaaggtaatatcctggggccagaagtgttttagtcttggatttataaattttggacatatttgcataccctttaccaatgatcatctccaatccaaatatttggtcttggaagatgtcttggggacgggtgatgctcaaccttttctcccgtattcgaggctctggaggcagcaacaagagcagactaccacacgagtgcctctttgacttcccaaacactacgtaaaagccaaatctattcttatatttcaggtctgttgctcttcttgagataagtgaggtcctgatccttttacaactggtcacctgagagatggcgctttaatgaatggtccagcagtgctttactgatagaggagaggccctagattgggctgaattcccctctggctcagtccagccctccttatactggatcattgttggaagacagcccccagcatttcacacctaggcaggcagaaaaggagccttcatagcaatgcttttaaaactggcccggtgtccctgtgttggattctttaccagagttgggtcacatgggcgtgtcagggagtttaagagttctgaaatttggagtttacagtggggggccatgatatgaagttcgaatgcaagaatgaagacagtcacccttcgcttgacttagttgaagcattggtcaacattagcactacaaggaaagccctgtggcaggaagtttgtgctttttgctgttttggcatttaatgcaagttggagctgttcatgtttgtgtgagcaacaagtgtggttgtgttgcagggctgggccagggtgtacctgtcgtgggcctagtggtagaaggtggtcctaacgtggtttctatcgtcctggagtatctcaaagaagaccctcctgtccctgtggtggtttgcgatggcagtggacgcgcctctgacattttgtccttcgcacacaaatactgcgacgaaggagggtaggtttggtgtgtgacaagggtgagctcttaatggctttttgtcagactggggaaaacatctgacacccctcagatatcccccaaaatgtctaatttacaaggggttctcttgatcttctctcctgagctcccgagaccagcatgagaatgcccaggagctcctgttcctgactgaatcctctctgccgacatctctcttacaactttattttacagtattaagtcttgcaaagagctaaacgcaggccaatttttaatgctgcttttagactgggttggctttttgtctcctgtacacaaatctcatccattagcagtccaaaatcaaaagtactgggtgggcgaaactgtctggctcacttgggagctgatctaattcccttgcttccttccctctctttacccctttgaacagagtcataaacgagtccctgcgggaccagcttctagttaccattcagaaaacatttaattacagcaagtcccagtcgtatcagctgtttgcaattatcatggagtgcatgaagaagaaagaactcgtgagtgtcttgaattgcattaccaaacaagttccaaggagagagatctttctgtgtctagctctgccatgcttgcttgatgggccatctgcatactcagttgaccttctcaaaaggcagcttatgaactcatcccaaactagctgccagtgcaaccctgaaggaatgggaaaagccacagagcagtggttctcaacctgtgtgtcgggacctctttgggtgccaacctttcacaacctttcacaggggttgcttaagaccactggagtaacaataaaaataattttatggttggggatcaccacaacatgaggaatcgtattaaagggccgaagcattaggaaggttgagagccattgccacagaggacccaggtgtatccagaccttagtgaacataaggtgatgccaatcttgtcactcaactcagaaattcaaatcacaaatcagatgtaaagtccccagggaagagagacacaaacatgtcattagatgtgatgggtcacaaagtcaaattcacttccctttgcaaatgcagggctcatttctcatttcttccttcagcttccttcaaccttataaggcgtaggcacacctagttcatgaatgatgacatattcaaaattctaaattcatgttcacatattcctgctgattaggcatgtgttcacaagctcagataactatttaaatatggagctatcctgaggtgcttaccctcttcccaaggcaggatgatagattccaatcccgggcaagaattccatcagcaagaacaacatggaagctcctggggactgaaaactgtgaacatccatccaaccagctctcaactctgcttcattgctctagtctttgtgttcagttttaaaaacaacaacaaaaaaaccctgctcagtcccccccgcaccccgcattttcaatgtcgccttgactctgtcttctccccattcacctgtttccaggtcactgtgtttcggatgggttccgagggtcagcaagatgtcgagatggcaattttaactgccttgctcaaaggtgagcttctgggacgtggcgattctgatttctgtcttcccagagctgcctagcagggactttgtcagtagtgagagctccttcacatccccacccccactaaggactcacagtaaaagaaccccgagctggccaggttgccccgggtgacctctgcatgggttgctgggatgagcagactctgagagggcttttacgagagagggggttgatggatgcccatagatgttactaaattgtcagagctgagtccatccatagctgttctagtggggctgcctgaacatagcaacccacctctaaggacaggctgcaatcaggagttcatgatacaggaggattgccctgggaagcacgtgtcctccctgtctctcagctagcctggagccatagggacaagaggaagttcaccactgtcttctttatgctgcactgggctctgtgctgccctgggggttatggtccttggcttatcctggcaaaggttgatagtttcagatttctctccttttcagatgagggccacaaattactcggctcctcctccatcccttccaggaaaccatgcccagttggcttgggatgaggttgcccctggctttctctcaggaaacatttaagaaaaaaaaaaaaaaaagcagtattattagcttggatggtcatttgggggcaggcaagaaaggaggaagtgataggtgcttagttctgaaacagtccccggtgggaagcccaagttcccaaaccagaagctgccaagctcaagcggtccagatgtgagtgaggaaagctctgtcttcttcttttccaggaaccaacgcatcagctccagatcagctgagcttggccctggcttggaaccgggtcgacatagcgcgaagccagatcttcgtctttggcccacactggccggtgaaactgtttttctgttgttgttttgttttgttttgttttttttttttgatttctggagacagggtctcatatagtctagccaagaaggtgcctatgtaggcaaggttggtcttgaactcctgagcctcctgcctttacctccctcatgctgaggttaaaggcattcgccactgtgccttgcggaactgttttctgtttagaatattaattgtgacttgtcacggtgctgtattagtgggtccttgctcatgatgtagatctctggagatgatctgagggtttgctgatctgggtaatccatgagattactggaagatgttgctgtttaacatcaaagaaacaaaggctctgagcacagactccacactgagtgggtcttcctgagaaaactaaccaccgaacctttcatcattgctggtaaacaaaggttcttagcgtttgaaagaagaaaatggatcattaaaattaactgcagcaattccttctagaggactgagttttcagactatgtttcatgaagctttgtgggggggtcaagagaatgccatgtgtgatgtatatgtgatatgatcattgtgtctgatgtctctggtctagtatctgtggtgtggtttaatgtattagatgaagcaagtctgtggacagcatgtatgtagagtatgtgacttgtgatatacagatgtagtttagcatgtgtggtgtttgtagattataaataacatgtatgtagtacctgtgtgaatgtgagggaatatacacatatagctttccagatgtgtgtatatcacatctgtagaacagtgcctgtctgtgctctgtgatgtgcttgtggtataatgtgtgggtgaataatacatgtgggcatgggtggtgtgtgtatgattagcaggtgtgtgtacatgtgcatgtgtgtgattagcagatgtgtgtgcatgtgtgtgattagcaggtgtgtgtatatgtgcatgtgtgtgtgcatgtgtgggattagcaggtatatgtgtgtgattagcaggcatgtgtatatgtgtgtgcatgattagcaggtgtgtatgtatatgtatgtgtgtgattagcaggtctgtgtgcatgtgcatgtgtgtgattagcaggtgtgtgtgcatgtgcatgtgtgggattagcaggtatatgtgtgtgattagcaggcatgtgtatatgtgtatgtgtgattagcaggtgtgtatgtatatgtatgtgtgtgattagcaggtctgtgtgcatgtgcatgtgtgtgattagcaggtgtgtgtgcatgtgcatgtgagtgattagcagatgtgtgtgtgattagcaggtgtgtgtgtgcatgtgcatgtgtgggattagcaggtgtgtgtgcatgtgcatgtgcatgtgtgggattagcaggtacatgtgtgggattagcaggcatgtgtatatgtgtatgtgtgattagcaggtgtgcatgtatatgtatgtgtgtgattagcaggtgtgtgtgcatgtgcatgtgtgtgattagcaggtatgtgtgcatgtgcatgtgagtgattagcagatgtgtgtgtgattagcaggtctgtgtgcgtttgattgaggaatattttatatgtttgtgcctatgacaatgtaagtgaaagagagtcagcttgtgtgtggtcagaagattgtgtatgttttgatgtaggacaagctgtgtgtatgtgcacacacatgtcgccatggtagacagagtcttccatgtcacaaccataatcacggtttctaagaccccaattataccatctacccagttttcctcgtggctaaagcaaatgtcatcaatacccttagcacacatagcatgcgtgctaagtgactaggacatccttcagccactccttccatcaaagcaacttctttgctctgaaaattagagcataaactagactataaggcttgtaatgggctagaaagacacataaggatcccaaaggaatgccagagacactatttccagcaataattgctcaatccatatttgaagttcaaaggaaagtttcctccttgtggatgcggtccattgcaacccacatccttttaagggtgtggcacctacaatgtaaataccctgtgttgggtgtggtctcacctgcacagcacagatgacgatcacctgcctgtgctgctggctctacacacactctggcccagaaacagactcatttcacccctgttaacccatgtgcagaaatccccacaggttctgtcatgcacacctccgactacacccccccccccacacacacaattccacagctcaaagggccaggcaggtggtgcccaggggtagcggtgaggtaagtagggtggggattctgttccttgttattttttactttgctatgcttagtctaccatgtcacaaccatatcacattttgtaagactccaattgtatcatccacctgattttccttgtggttgaagcaaagaccatcaatacctggcttctttctaggctaccactctttacctcttctctgggattcctccataatattccattttaacctattatgacagctctaatgtggagcatccacatctcaagtgtatgatagctatattcagccatcagctgccctcttcctgacagctactgaggcccttcttccgaagtgtaggctctgccagcctgggctacaagctcttcttctgaggttacccacagtgctctaggcatcctggaaggtagccaggaagcccaagaggtgagctcatttgagcaactagaagatctcttctcataccagccacacatgtagtgccttctctacacccaacaacagcaaggccagagctacggcagggagataggctgcctctgcacacttgctccatgtgttttcaaaactgtgtatttttattcactaatttaggaaatgttggttgaccgttgcgtcttgtgtctggcgccctcgtttcatgtgctggggacacagaagttaatagaattgactcacaagagcctttgatgaagtcttcattggggcagacgtgaaggtgggaggttgaagacagaaggaggctggcgtggaatgaaaaaacagataattattggattccaacgtgtagaaaatggatagcgcatagagggtgctaatttgtgatgggattccaggaaagacactgctgagtagacactgggtgattgacaggtagatgctggctgctgggccatgaggatcgagaaccttccctgcagggggaagggcaactgaaaccagcagaggcaagaaaggaacaggcaaaacaagtgcagggaggtgggaacgttatggttggaatacaaagtgagaacagggtgactcaggggaaggctgaaagccaggatatgtgtttctgagtcctgcaaatacaatccgggactgaatgccagggttcacagaagacatttttgtttttaatgcaacagtaagtatctgctatcctgttatcctgtggtggctggtgtacaccttaaatcccagcaggtggaaggcagaagcagatggaacactatgagtttgagactagtctgttctacaaagtgagttccaggcctgtagggttacacagtgagagaccctgtcttgaaatgagagggagggggagggggaggggggggaagccctaccctgtgtgtgtccacactgcttctccatccagccatcaatgaatcctagccgtcatgagtagcatcactatggatgtgggtgtgcaagtgtccatttgagtcttgccataaattcctttgggaatatatccagaggtggacttctgtcataactcataattaagtgataattctgtgtctaaatttttggcagctaccaagatcttttccataacactttcataattttacatctgcacccagagtgtaaacattctgccttctcagaaacgtgtgttattttctgttgttttatattgctgttttaccataacagccatcccagtgggttaggatggcatctcagctggcttttatttgtgtttacttcatgctggtaagcatctgtgccgtccacttgtgaaattctttggagaaacagctattcaagtgttttgcttatttttgaattgggtgttttgttgttgagttttaggagttctgtatacagtctgataatcccttttcatatttctgacttgccatatattcccttgtcctatagcagcggttctctgcctgtggatcatgacctctttggaggtcatgtatcagacatcctgcatagcagatatttacattctgatccatggcagtagcaaaattacactcatgaagtagcaacaaaataattttatggcctggggggtcaccacaatatgaggagctatgttaaaagggtgcagcactaggaaggatgagagccactgtgctataggctgcctttactcttctggcagtatcaacattatcactcttctcttctcttctcttctcttctcttatcttctcttaactccgaagacacacgggcaaggacacgagcacgtgagcacacacccagttgagcagctcaagctaccggggnnnnnnnnnnnnnnnnnnnnccttcccttcccttcccttcccttcccttcccttcccttcccttcccttcccttcccttcccttcccttcccttccctctctctctctctctctctctccctctcccttctctctctctctctctctctctctctctgtcattttttccaggctgtagctgttcctacgcctttccccatgtttgtgatacagcaaagaggtccagggtagagctggccccatgttacttggagtctcagcccccaaaactctaggctcgatatgcagtatcaagctcctggtatttcactgtaacagcagaaagctgactgatacagaagtaaggagtctctgagacacgcatatgccaagttcaccagaggaactctgggaaggagagtgggctgaaactgggcagggaagattgctcatcagtaaataaagacccgtggtgtgagcatgggtgagagcggtgggtggtgtgagcatcagtgaggctgctgatggagagaacaaaatgaaagtgaagcaggctaagggcagagcccagccttggcattgagaagcactgaccacacagaaaagaaaacctggagcttgtggtgcccaggaacctgggagagatgcctaagggaagatgcggctattgagtcagatgacctaaggatgtgacatgaagggagctgggtgatgcccttgatgtgggcatcagtattgtcgctggtgatcaacgccagagcattagataagcagaaagatgcatcaaagcaagcagaggaagaagaggagggagtgtgtcgtggacaacccaccagcagagcctgatgggaggaaggcagtagggagaggctgtcagcagagggtccagtggttctgacactggctgtgttaccatgacaggcccctcatcccacacttaccaggggatcaggcccacttctttctccctcctattccactgagtgagcaccctcagtccttgaggccttccgtctgtcactgtactacattgagcccttgaaacttccagttcatcaccacactgtaagtgtcctcaaggctcctgaagcctccctccctccatcaccacatgcatgtgctcctgaagcctccctctatccatcaccaaatgcatgtgtccttgaagtctccatccatcaccacatgtgtccctgaagcctctatccatcaccacatgcatgtgttcctgaaacctccttctatccatcaccacatgcatgtgcccttgaagtctccattcatcaccacatgcatgtgtccctgaagtctccatccatcaccacatgcatgtgtccctgaagtctccatccatcatcacatgcatgtgcccctgaagcctccatccatcaccacatgcatatgtccctgaagtctccatctatcactatactctatgggctcctgaagcctccatccaccaccacattacacagctctaaggtacctgccagagctgttttagccataataatctctagctcacatttctcccgaaatagcaacttgcattatatcttttgcctctgacccattcacagtcacattctcccatcattagaggactatcagcacacctctggtaccttttagtttgtgtttcagcatcctttccttaaaatatacccatcaatcaatatgttatttgcttcaaatatacatattaggccaactaactctttgtgcccatcaggaacagtggttcacagtatcaagatcttcttcatcagactgccaggccacagttgactgtgtgtgtacatgtgtgtatgcctgtgtgtgctggtgcatatgtgtcttgggtgtgtgcatgtgtgaatacttatgtatatgttcatagcattaaccatggatgcataacttcaccacgtgcacactgaggcattgtttgcaggaataggaatgtgtaccttacaatgtgtacgtgcatctgtactattcgtgtgtgtgtgtgtgtgtgtgtgtgtgtgtgtgtgtgtgtgtgtgtatgcacacatgcacatagagttcagggtgtccctgtgcatatcttaaaatgagtggggggtggtcttggtaccttttcccaatatgcttgttgtggattgcagccactgggaagcctggcccctcctgtggacaccaaagccacagagaaggaaaagaagccacccacagccaccaccaaggggagaggaaaaggaaaaggcaagaagaaaggcaaagtgaaagaggaagtggaggaagagacggacccccggaagcttgagctgctcaactgggtgtgtgctcacgtgctcgtgtccttgcccgtgtgtcttcagagttctgtactggcattccccaagatcgccaggaagagactcccttgttacctttgcttcatccctgccgggatgggggacagatgggttaatgtcaatacttcatggcaatagtgtgttcacttcaatgtagccgcaggtggtcacagctgtttcgtaaggaggagtggttgtccctgtggcatatgcttgccactgcagagggagacctggaaaacatgcatgatggctccagcctcccaagccggaggctagctactgctaaccacctatcactcctttctacactaccacttcaaaagggttttgtggcatgaattctaaatatgtggtttgtttcccatattttcctgccccaaatgtctgcatgtctgccaagcagagagagctactactgagtaaatgaccagaacttcctttcagagtggtaccttggttccataaataggagcgtgtggtcatcactcacccaacggcaccctagtggactatgacatgcccacatggtctgaccactgccaaaaatgctccccagtcaaggaaacagcagagagaaacttagcagggcaaacgctgggatggctatctttaattcattagaaatttgtttagattcatttttactattttacatgtgtaagtattttgcctgcatatgtgtatgtgcaccaccatgtacatacacctaatccctacagaagtcaaaaaaaggcactgggtcccctgggatgggagttagcagggaggttgtgaactaacatgttagccctgagaattgaacctgggtcctcctcaagcacaagaagtgcttgtaacttctgagccaactccatggcctctttgactctttttgttgttgtcgttttgttttgttttgttttgttttgttttgttttgttttgtttttcgagacagggtttctctgtgtagccctggctgtcctggaactcactctgtagaccatgttggcctcaaactcagaaattcgcctgcctctgcctcccaagtgctgggattaaaggtgtgcgccaccacgcctggctctttgactcatttttaaaagatagaatcccttacaaactttgacagagcatgaggggaccaaactgaaagcagaggggagaaggttaaggcatggttattcaaaggaaacaaccttgggaaccacagactgtcgtgcaggcccttagtgcagctcttgacagtcatatgtgaggccatgggctcaatttccagcaccaggttaacaaaacatgcccccaacacacacatgcatgcacgcacgtgcacaaagcaaacaaacaaaatatcaaaacattccggaactttccatgggatgtcctaaggtctcatgcctggagtcttctgggaggccactcatggtctcccttctggatttcctgcaggtgaatgccctggagcaagccatgctggatgctcttgtcctagatcgggtggactttgtaaagctcctgattgaaaacggagtgaacatgcagcatttcctcaccatcccgaggctggaggagctatacaacaccgtgagcatcccgggaggaagggtggaggcgagctagcaccgcgaatatgctcatcattgatgcatattattccccccaaaagtggggggcagagtatagactggggcagcttcagccagaagacacatatgtagtgagagtcatctccttctcacttgctcctggacagtgtgcattcatcatattcttagcaactatgccataccagacagccagtccttccagctgcagtggacagatgatcctcgctgtgcagtgggctcacatctttataaagccatctctaaagtatcctaagatgacaatgtacttgatggtcccagcccactgaacatcacgacttagtaacatagaccactgaagcatcaggcatctccctggggcatggggcttaccaggagctgcagctcatgggactgtacatcactagcctggggaaagggttccgattctgtttatctcgaaggcctgtgtggtgctcgtgccaacagggaaaagtctaaaatcagccagacagtaagcctgcatctacacggtatgcttgtgaagcaagaggacgtcataccctaaggcatcagccaactgaacagtcaccggggttgttactcagttgttgcttgggatcctcgagtgtccaggggctacactgagaacaagggttagcagtcaggagcggtgctgtctcagaacaggaagtggtagggtgcaatttactttgcctccactagaacaattcaagttttagaaatttataactccttccccagtctgaccttcagtggcagaaatggtgtaaaacatgcaggtatttcacactacaagaacaccgaaagtattcaaagtatttcacacacgtttgagtggggtaaccacagccagttgtcttataaaggaaatgagccaggagtacactacaggctccgcatttcagtggggcaggattttgctcaagagttgacgagccaagtgtgcttactgtggctgatgcttccctttcagaggctgggcccaccaaacacccttcatctgctggtgcgggatgtaaagaaggtgagcccatttgcccccctttcagccctctgccagcatctatcactaaagtaattcttaaagacaatcttctgtttttaagatgttttatcttcgtatttaggatgtagggaataatgatttcatctatttatagtaagagtttacttataactttaaagagcagaacaaagggccagggacatagatggctgtaaagtgctggaaagcgtgagaactgaagttgggatttctggaatcaagtaaatgctaggtggggtcttatgcgatgactctgcgggtgaaggtggttgctgatgagtttgattgcctgagtctcatctctgggactcatatggtagaagaagagagctgattcctacagatttttctctgacctcaacaggtgaactgtggtgtgcatgctcaggcgcacacgcacacatacacacacacatttgctctttctctctccctctccatatacatttacatatgcgtgtacatatacatatcatttttaaatctagtctggatgggtatgatacctgccccctccataactgtagcctgccagaggtagagacagggaatccctgaagtcagctggcaagccccaggttcattgcaagctctacttcagtatataagataaagagaagttgaagaagacaccagaaatcaatcttagatctccatacacatgtgcacacatgcacaaacacagatacatatatgcatatcaaaaaccacattcagacgataaacaaaaataaaacttgaaatggtgggtgggcgagggggctagaataaactttgtcacagcctaggaacgcactgacaattgcttggttatagtagttttagcaccaaggtgacctcagaagtgtcaacaggaggctccccaggaagtctgtatgtatgtcctatggactgcatcagaggttctcttagcctttgcaatctcttagggaagctgctctcctcactctccagggctccccactatggacagactgtgttcctgtggggtttcctttctcagtcctaccctggcatctcttgtgtcctgccatcacaagttagagatgagattagattctcacaggagcaacccgtctctctagaatgagggaatgcggctcctggacagcctggttacattttgtatcgataatcagttctaagaatatgaaaaaaagtatttctacagagcagaataaaatcagtggatctgggaaatgggggacctcagaggcctctggtctagagtcttgttccacacacaagaattctgcttcctccctcaagacccaagtggaagacagtgcaaactttcaaagtgagagctacccaagttcaagctcaaccacttctcagctgaatgcatgacttcaataatcactccttctcctgtagtcctccctcctaccacttgattccctgttcataaacaccacctccaaactgccatggctgcaatataaagttcaagcttgttccaatacctacaaattcccactgatcctggcccatgctctagactcctcctaccacattccactacatctacactgacccatctgaacatggggaggcctgggaggctatatcctgcctgggacacacttcctcccatccacagcacccactctttctcatcttacctcaccatccctgctcctctgctcctatgtcaccatttcttggaaactcttactccccctaacatccctaacatctgtgagtgacacatgttgctgcactgatctctttacagcctcatccctctcccccagcatccagctccttagagaaggcctacatctccttgtcaccagtaagagaaaagggttctgggatgtgctcattggtagagtacaaacctaccatgtaggaaaccctgagctcaatccacagcactgagaaaaaaagtcccattaataagcaatacccaacatggccaatgatcataatcagagcagaagaaatgcataatttattagcaaagtattcagccagtataaaaagtctgcttataaaaaagacattcagtggatcccagggtatcaacatcatttcagttcttacaaaatcaatgacacaatgacatatgaaccagtctgggatgtggaggaatggcacaatgcaggaagggcctctcttcaggccattgcttttcaccattgggactgtgtcccagcaaaccctcttccacattgattagattcagtccttttggtagctcctagtcataccacagctactggctgtgttttactgaagatccagtgtctccagagtccctgagtacaatttgttaagacctaggtaaaatattaaggcctagatggaatgttaaggcctaggtaactgttacctgcctagcctggtaatagaactgctttgtatagttacccacaataagcttagacccaaatcaacctcccagaagtacttcctgcacctgtgtataagcctttatggtatttgtttttataagctgcccctaggatgaacctcagtgtaagagagacttctgcgtcgatataagaaactatttgaaataagacttccattttgagtaagggtcgagtaaagtttaagttcccaagacctccttctacttggcagaaagagacatctgtgggtaactgacaatctggttagcaagttaagacatgagtgttagacaaggcaagccccctgccaaagatgaattttccaaccaatgggaacaggataagtgtataacaaattcatgttcctaaggaaaccccctagccctaaagcttgattggtggaataatttgccacagatgtttgtagatcctgactcaacgtcacaaccagcttctgggtctgggtttgtgacgctgactgatcaaccctacctgaggtgtatactcaataaactatctctgtctgactgagattggtgtttgaatggtttgtgaggtaactcccgaacctcatcaccatttaaagctttcactagtgagactccagttctaagaaatactctggtctcctacgggtttccatgagactcactacttcctccatgaaactcggcccctccctgaggctagctcttcctctacaagggctgatctagggtatgtgacatccaaatacatctgcttttaggccggggcaccacactgctccctccacctccatataccagctactgatcactctatctggccacaggtgtgccatggactctatagtagttgagtgtccaactttttattctcaatagaagtcaatttctgggatataattcaacctgtcattcccgtatatcatatggtaacagaatgaacatcgttgttatagtaacaaccagttgctcctgggatggtgacacactgtgaacttcctttcttgcagagcaaccttccacctgattaccacatcagcctcattgatataggactggtgctggagtacctcatgggcggtgcctaccgctgcaactacactcggaaaagcttccggactctctacaacaacttgtttggccctaagagggtagagctcagcagacacacagtgtcctgtgcctcccagagtaacatgtggttccttgatgtgcttccccaaaagcccacctgtgcagaatgcaactcttcatctcacctgtcccaaagtgacatcaccccacctctgccctgacacccagtgcagggcctcctagctttcacatgcagccattcacatcgcctctcaagactgggccaggcagtgcaacctgtcaagcatgtctgtcctcccctccttcctacaatagcgccccctctgggccccatgcctctgctctctcagcccgttctcctccccactgatcactggcgctcctgttgtcttccaaggcaaggaacaaggaaaagcatcttttgcccacaaaagtttagggctccccgctgttcaaccatagccaacctcactgtacatcggagtcatccaggccagctgccacacacaagccttccccaccctatcccaatagaccctattcctccatcaaaatcaaagctaactcctggcctgccacattgcttcttcttgctccagcctgttaaacctccaataaatgtcagatctgtgggaagccttcctcactctcactccacagtttgtacagagagcgagagcctcgtttggttctacttacaaggaaggctttgtgtctgtctgtccttcccaactgacttctgttgacagaagcagtttccacatgaaagcgttgactcacctggatgttgtcattaattaatagtgatacaaaatattgacacttcttttcctgcttctttgttatgcagccgaaagcacttaagcttctgggaatggaagtaagtaggacatgtttgtggcagtttatttactatatatacctttgtcattctgtggaagcaaaaattgagcaatgttttccatgaataaagtactttatacaactcaccaaaatcttagatgaattggctgaatcataaaaaagcgcatatacctttaaaaaattaaactggtttgtgcacacacgcgcctgcctgtatatgggggggggggctatgtttttctgcacacatgcacatgtgtgtttgtgtgtgtggcctgtgttttcctctgtgtgtgtgtgtgtatgtgtgtgtctgtgtgtagcgcctgtgttctttcatgtgtttaggtgtgtgcaggtcagaggttgtcaccatgtgttttcctcagttgttccccccctgtatttactaaggcaggagctttcactgaacctgaagcttgctaattacaactactctatctaaccagtatggcttggggaaacctcctgcctctgatctccaaggcctaggactgctggcaggtgtggcagctgcccagcttttacatgaattctgagcatctgaacttagtccttatacttcagagacaagcatgttgtccactgagccagctcctcaacccaagattatcattatcatttttaaaaataattttcttttttattgagttcatacatgcatataatgtgttttaatcaatcaaatccaccctcattaaccactaactccctccaactcctcccatatcctccctgcccccatccttccctcaatataatactcagctcccagtcctggttttggtttatttttcatttcctgatgacagacactggaaataaaagttcatttcaggcttcctgccttaagagttgagttaaagttggtaattttcattttcctcaaagtcacttcatctagactctcacgttcacttttacaagctttcacacaacattctggcctcttctgcccgcctaagagcttcagtgacgtgtcatgcttcttctgggttatctttttaattacattttatttgtgtgtgtgtgtgtgtgtgtgtgtgtgtgtgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccaacccaccccctctctttcccctccatcttatttttttgagacgtagtctttcactgaagctgggcctcgttgattagctagaccagcttggccaccagagcccagggattgccctgtctctgcttcccagtgctggggttatgggaacaggctgcttcagctggctgtttacgccgcacagggacacagactcagtttctcatgctgtacagcaaccctgttacctttattttgaggcagaatctcactcagttgcccagatttgctgttgacgcactccatagcccaggcaggtcttgaacttgtttacctcctgcttcggtctccgggtgagttggtgttatagccctgtttccaccaggccccactttacactgtgtctatcagtttctagttcagctacatcttacaaacaagtattggtgttctgctgtgttggaacatgtccctgaagagacaaacagtgacttcacctttcctgttgtgctatcagtatttggttgatggggagttggggggggggggggtctcctccattaaagaaagccctttggggggggcgtggaactgaagctgctcacccagtgggataaattattcaaatagcaacattccttttcagttcacttgctttaaagtgatttgcttttcataataaaaactccgtgccttctcaaaggaatcagtaagcggaatgacgaccagagcctaggcttacaaagtctcttagcgcttctgacccggaagtctccagaactatttgttgcccgttgaggaggaaacctttttttttttaaagtgtgtttctctccccctcaggatgatgaacccccagccaaaggcaagaagaaaaagaagaagaagaaagaggaagagattgacatcgacgtggacgaccccgccgtgagtaggttccagtacccgttccatgagctcatggtatgggccgtgctcatgaagcgccagaagatggcggtcttcctgtggcagcgtggggaagagtgcatggcgaaggccttggtggcctgcaagctctacaaggccatggcccacgagtcctccgagagcgagctggtggatgacatctcccaggatctggacaacaattccaagtgagtatctcgagggaatctgagggcgaggctgcctgcggtctggtgctctctgccttgaaggcgtgccaactgtacttctcatttaaggaccatgtggttaaggcttactcataaagggctttcccgatcacatctgtcagtattatttctgagttgttaccgatttagtctgctgccttctcatgcatacatatgatcaaagacagtaaaatcaatttctataaagaaatattcacggctgctgtatataaacttcagcacatctatgtgttgggcactggatgtcaggagaacttctggatttttcttcccctagagctggggcagatgtccaaagaggggtagtagtgcccttttctcttcatatagattaggcccttggtggtctttctgtttagctagtttctcctgacggcaggcctagctaaggagagcagagtactgccagatttcaatgccagatctccttttcccctacatcagctgtcagaacctggtcgggtggggccctggacttgatcacatttggacttggtcacaggaaacattcagcaattcataggttacagcttatgtttcctaagcccgccctggttctgcagacatgtctgctacggtaagtgataattctgaatctgcttgcttgcccctgcagtctggggacagcagtctttcctgtgatgaactgaagggacctgcttgttcaagggattgactgttgttaagagagaccaactctttgcaagtttgtcatgtgacagactggaaagctggaggccagaaatgacgttatgggcacatgaacttggggcagccgagccaggcagctgagccggcatctcacagctctgcttggagtctttctgcttgctgtctctctggtttctgtgatttccacatgattagctggtttccaagggttagaccccaaggctttaaatgcttttctcttgggtttattttaccttgttttataaggtttttgcccatttgtgtgtgtgtgtgtgtgtgtgtgtgtgcgtgtgtgtgtgtaccatgtgcatgcatgcatggtgcctgagaaggtcagaagaagatgttccgatctccttgaactggagttacaggtagttgtgagccaccatggggatggttgggaactgagcctggctcctctgcaagagagacacatgctcttagccactaagtcattcctgtaactccagaacccaatgctttttagaacagagatatgttcacctaccttgggtttctggatgtggtcctgccttccagagagtccccttcccccaccccaccccaccccccggtgatgtgtcaccctgaagcctaggatcaggcccagaaaatactgtacactccagaatcttcaatggacaggagtggccactctccttccctcatctccatcttgataactgcaacaaaatctcctatacatggagaggcaaaaccagaggaggagaatggtaactatgtaactgtgtggtaactatagtgataaatattttaaccacatcccatgacaaaaaaaaaaaaaaggcaaaggagatggaaatgactctagctgtcattaaacattggactcagggtcatgaggaaaaagaaataacaaactaggttcaaaattcaattgtgtcactttctaggtgccccttactcctatacttccactgccgtgcttctgtgttctatcttgctgctggggtgtgtgaactctgcttgggcagacaaaatgggtagcattaggctaagaatatagcctaagataaggggcccagcctgagtgagaaacaaggaaggctgaggagacaggagttcccaaactccggggtgtccagttgttgctggaaacctcgtgaagtctggaactgggccgcatgggtctgcaatgaccagcctgcggcaggtggaaacagggggtacaattccagcttagcttagctgtgagtgtccaggagcatggaggggtcttctgtgggagacgaaggtgtggaggatctatatgatgaaggctcccccctcacagtggttcttgatgagagagaaagtccatgcttgtccatagtgtttattcattgttcagcatggaatatgggtgactacaatttactcagggagaaccagagattaaataccttttacaagaagaagtgtccaagaagggaagcttattggctaaaccctcagggtggcccatctagataactcatttacatggagaactctgtgctctaagctacatgactaggggtcacaatcctaatgcggggtgctatggtcacatgctccaggactcgaaccatatcgggagacgataaaacacctaccgatctcagatatgagaatactggagtttctgaatccgttcaaccttcccagtttttgtctggtgacccttgccccacaccctgccattagcaatcagatctcttgctctgggccctatgacagctacactctgttttattgcacagagcatgttggactatcttggaatcaaggacttgttgaatgaagtcttacacaacacatgaaaagctcacggttaaaatgtttgacttttagcaaacatgtggggtatggccaacacccaccgttagaatcagaacctaaccaacccccagaagtcatcctggtgatccgaatgccccattccttggggttccagaagcagccactggttaccactcgcaatcccatagatcttgcctgttccatctgccccactgttgcacagcccaaggaaaagagctttgtctccttggggcctgagggacacagctagttcacctaaagctctgttgcaggaggagcgaccaatccctttcctgaccaatcacagagcttgctacttgctgccccttcctctggtgacaggtcttgagaatgtacagaggacctcaaagccgctttaaaccctgtggtctgtgtcttgtggctcctcaagttaccttgggcacacatatttaagtacaaactcataacctctatggttttgtcaccgccgacatctttttccctccagagattttggccagctcgctgtggagctgttagaccagtcttacaagcacgatgagcaggttgccatgaaacttctgacctacgagctcaagaactggagcaactcaacctgcctgaagctggctgtggcagccaagcaccgggacttcattgctcacacctgcagccagatgctgctgacagacatgtggatgggaaggcttcgcatgaggaagaaccctggcctgaaggtgggtgagctgtggccatcccattactaagtgttaaattaaaaaataatcaattcataaggttcctttgtttgtttgtggggcaatccagggcctgatataagttagatgaaggctctgccactgagctacaccctaactcccttgcttgagttgtaaattgcattctgagcagcacagtgaagtctcatatgatcacactctgtcccacccaaaacatacaccatctgcgtgcccagtatatctacagtgtattctgcacctacccattagtcatctaccagataaactgtcacaacacttcaatgcttgtattcaagtaaccctgaagttccttactgacagtctcaaagaggagcggctcccaggacacaccaggatgtaaaatgtatggcaccctagctgtgccactaggtgacgatgctacaggacatatagacaacacacagaggaagcacagatcagcactatatgtttcaggcatccactggtggttaagggggataaggaggacactgtattcccctgagcaaccccacgaaggagacactacaacagttctagctttacaaataaggaattcaaagcttggagattatgccgcccaaagtctgagttgctcagtatgggataggacctgagctgaggtggtcagacactccagtcccagtatagccggcatgcctggcttacagagctcttggtacagtctgtgttttcagctggaacctaccatgatcatgctttccagatggatcaccaacttacgattgatccagggactgaagagatggctcagtggttaaaaccacccttgcagaggatccaggttccattcccagtaccacagtggttaacaaatgtctgtaactacagttccaggagatccagtgccctcttatggtcttcccaggaactgcattcacatagtgcacagacatacatgcgaacacaacatccatgtgcataaaaataaattaatcttaaaaagtcaaagtatagatctgacctctgtttctacagtattttagctgacaatatctcccttacaggtggcttaggagaaaatatggagcaatgaaaaggtttgaataagatatgttgggagaaaaatcactgttaacaaacccctagattatcttgagaaacgttttgttaacccggctgtctaatggttatactatggtggccctatggaatctcaatgagaatggagtctgaacaggacaggctcagcatcacttttctgaaatgtctgggaccaaaagtgtttccagtttcttttttggtttgaaattattgcatagccctaataagctatcttggagatggtattaagtccaaatgcaaaattaagtgtctcacattcaatttatattcacaacctaaagattcattgtatttgctatttctagggtgcctgacttttgactatggctcattacattaagtcaggtgacttcccacctatggtaggagtttttcttaggttgagagtttggagtattaaaaatgtactcaccgggcagtggtagtacacacctttaatcccaacacttgggaggcagaggcaggtggatttctaagtttgaggccagcctggtctacagagtgagttccagaacagccagggctacacagagaaaccctgtatcaaaacaaaacaaaacaaaacaaaacaaaacaaaacaatcaaaaaaacaataaaacaaaaaacaaaacaaaaaattgcactcatcctgtatggcacagtgactagcagaagagactctgcctcttagaaatacagacaatatgcctagctatccaattctatacaaggcataaatttgctagattgatgttgcatatagctttggatattaacaaatatagtttgttttcagaatggcaagatcaaagaggcattgaagaaaacaggtcaggtgtgaagtgaggaatgctgggtcagcatcacgagtcatggcagcatcaaagcccagaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacacacacacacacacacacacacacacacacacacacacacacaagggggtggggaggagagggagggagggaaggggaagtaggaagggagggggagggagggagggagaactgatagaatgaacagctaaaatgcccccaagtgtcaggggtgcaggttcagggaagcaaacactgttgataatccttaacaagaaaacagaaggggaattgaaatttcagggtgaaattaaagccacgcacacaaagttgaggttcaggtttggttaggattaaacttggagtctttatagcaatcagtggagcatagagaagcacccgataaaacagcagcgagccaccgagtatcctttgatcctctgcgccgagctcagcccttcctctgtgagtcacacgaacccccccaactctcagtacacatattctcatcatgctgaagtagttttatataaaacagaggcggtactagattttaacgtagtcacgcacttgctttgtttgggtagtttgcttttgtggtgttgggatctagtgcaggggtgcgtccatgcaagcaagcactctagctaagcctctgtcccagcttacctgcatggagagtcagtgtgagatcgtagctttttagagtctggattacacacaccattgcttgtcatttctcatctgaaaaaaacgaaaatcggtggatgtttttcaaacttctcatgattctatcaactacccagcacataaagccatggatcataagagcagggatggccccttatgtaactgacaagtgtggacagcctaactttacacatttaactgtatactcagccctccaggtccgaggatttcatgtttttgaaatcaaccaaacccgcaccaaaagcctctttagaggctttcaaaatgtcttggtgggcaaaggtgcctgatgccaagctggtcagcctgagttccatctctgagacccacaaagttgaaggagaaaaccactttcaaaagttgtgctctgatttctacaaattcactgtgacatgggatatgcacacgctagatgggtgttgggtttgtcataaaagaaaacagtatttgtaaatacatccaaactgaatgagtataagccatttcccctctttactccctaagcaatataatataacagcttttaacccagcattgacattgcattaggttagcaactctctatacatgactcagagcatgcggaaggatgtgtgcagatgatatgcaaatactgtgtcacttaatgaccataagtatccacaggttttggtatcaatggttggtgaatcggtagagtaccctctgggtccactaggagtgcatatccaggaaggattaattcaagagacctgcccaaaatgtggttagcaccggttcataggctaccaatgggtgatataaaagaggaaggagagaaagcccaaaatgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 158 - DNA, 2675 bp, Mus musculus
ggtcagaaagcatggatagagaagacattttgcaaaagggaatgcatctttgtaattcccagtacaaaagaccctaacagatgttgctgtggtcagctcactaaccagcacatcccccctctgccgagtggggctcccagcacaacaggagaggacaccaagcaggcagacacgcagtccgagaaatggtctgtcagcaaacacacccagagctacccaacagactcctatgggactcttgaattccagggtgggggttactccaataaagccatgtacatccgagtctcctacgacaccaagccagattccctgctccacctcatggtgaaggactggcagctggagctcccgaagctcttgatatctgtgcacggaggcctccaaagcttcgagatgcagcccaaactgaagcaggtgtttgggaaaggtctgatcaaggctgccatgaccacgggggcgtggatcttcaccgggggtgtgagcactggtgtcgtcagccatgtgggggatgccttgaaagaccactcctccaagtccagaggccggctctgtgctataggaattgctccctggggcatggtggagaacaaggaagacctgattggaaaagatgtaacaagagtctatcagaccatgtccaaccctctgagcaagctctctgtgctcaacaattcccacactcacttcattttggctgacaacggcaccctgggcaagtatggtgctgaggtgaagcttcgaagacagctggaaaaacacatctccctgcagaagatcaacacaaggctgggccagggtgtacctgtcgtgggcctagtggtagaaggtggtcctaacgtggtttctatcgtcctggagtatctcaaagaagaccctcctgtccctgtggtggtttgcgatggcagtggacgcgcctctgacattttgtccttcgcacacaaatactgcgacgaaggaggagtcataaacgagtccctgcgggaccagcttctagttaccattcagaaaacatttaattacagcaagtcccagtcgtatcagctgtttgcaattatcatggagtgcatgaagaagaaagaactcgtcactgtgtttcggatgggttccgagggtcagcaagatgtcgagatggcaattttaactgccttgctcaaaggaaccaacgcatcagctccagatcagctgagcttggccctggcttggaaccgggtcgacatagcgcgaagccagatcttcgtctttggcccacactggccgccactgggaagcctggcccctcctgtggacaccaaagccacagagaaggaaaagaagccacccacagccaccaccaaggggagaggaaaaggaaaaggcaagaagaaaggcaaagtgaaagaggaagtggaggaagagacggacccccggaagcttgagctgctcaactgggtgaatgccctggagcaagccatgctggatgctcttgtcctagatcgggtggactttgtaaagctcctgattgaaaacggagtgaacatgcagcatttcctcaccatcccgaggctggaggagctatacaacaccaggctgggcccaccaaacacccttcatctgctggtgcgggatgtaaagaagagcaaccttccacctgattaccacatcagcctcattgatataggactggtgctggagtacctcatgggcggtgcctaccgctgcaactacactcggaaaagcttccggactctctacaacaacttgtttggccctaagagggtagagctcagcagacacacagtgtcctgtgcctcccagagtaacatgtggttccttgatgtgcttccccaaaagcccacctgtgcagaatgcaactcttcatctcacctgtcccaaagtgacatcaccccacctctgccctgacacccagtgcagggcctcctagctttcacatgcagccattcacatcgcctctcaagactgggccaggcagtgcaacctgtcaagcatgtctgtcctcccctccttcctacaatagcgccccctctgggccccatgcctctgctctctcagcccgttctcctccccactgatcactggcgctcctgttgtcttccaaggcaaggaacaaggaaaagcatcttttgcccacaaaagtttagggctccccgctgttcaaccatagccaacctcactgtacatcggagtcatccaggccagctgccacacacaagccttccccaccctatcccaatagaccctattcctccatcaaaatcaaagctaactcctggcctgccacattgcttcttcttgctccagcctgttaaacctccaataaatgtcagatctgtgggaagccttcctcactctcactccacagtttgtacagagagcgagagcctcgtttggttctacttacaaggaaggctttgtgtctgtctgtccttcccaactgacttctgttgacagaagcagtttccacatgaaagcgttgactcacctggatgttgtcattaattaatagtgatacaaaatattgacacttcttttcctgcttctttgttatgcagccgaaagcacttaagcttctgggaatggaagtaagtaggacatgtttgtggcagtttatttactatatatacctttgtcattctgtggaagcaaaaattgagcaatgttttccatgaataaag

SEQ ID NO: 159 - protein, 633 aa, Mus musculus
GQKAWIEKTFCKRECIFVIPSTKDPNRCCCGQLTNQHIPPLPSGAPSTTGEDTKQADTQSEKWSVSKHTQSYPTDSYGTLEFQGGGYSNKAMYIRVSYDTKPDSLLHLMVKDWQLELPKLLISVHGGLQSFEMQPKLKQVFGKGLIKAAMTTGAWIFTGGVSTGVVSHVGDALKDHSSKSRGRLCAIGIAPWGMVENKEDLIGKDVTRVYQTMSNPLSKLSVLNNSHTHFILADNGTLGKYGAEVKLRRQLEKHISLQKINTRLGQGVPVVGLVVEGGPNVVSIVLEYLKEDPPVPVVVCDGSGRASDILSFAHKYCDEGGVINESLRDQLLVTIQKTFNYSKSQSYQLFAIIMECMKKKELVTVFRMGSEGQQDVEMAILTALLKGTNASAPDQLSLALAWNRVDIARSQIFVFGPHWPPLGSLAPPVDTKATEKEKKPPTATTKGRGKGKGKKKGKVKEEVEEETDPRKLELLNWVNALEQAMLDALVLDRVDFVKLLIENGVNMQHFLTIPRLEELYNTRLGPPNTLHLLVRDVKKSNLPPDYHISLIDIGLVLEYLMGGAYRCNYTRKSFRTLYNNLFGPKRVELSRHTVSCASQSNMWFLDVLPQKPTCAECNSSSHLSQSDITPPLP

SEQ ID NO: 160 - DNA, 95683 bp, Homo sapiens
gttaagatgagtgatgttgagtatcttttcatgtttgttggccattcatacatcttccttggagaaatgtgtaaagtccttttttaaatcagtttgttcatttgtttgctgttattgggttgtaaggtattgtaaatattaatatattttaaatattaattgcttatcagatatatgatttgcaaatatttctccacattgcataggttgtcagatatatacacttttaacaacctcccttagaccaggggagaaatgctttgaagaacctggcacaggatctgtgggcccctttctagaagcaagtttctgggccaggttccacctaggagcagggcccaaggggaggagacagggaggagtgctggctccactcagaccctggagcccctgctgggagaggtggggatgctgacctaggcacccacaggcacccagaagccagggcctcccccatttacagggcacatcatgtccctggtcaccacccctcgaaagagcatgatgccaaaaagcccgggctgtgcctgagtcccctctgcgatggggcagggggctgcacacatctgcaaggcgcagcttgtgttagaagcacctgcctggcttatctccatgtgactctgtaaatggggagcagtggagtctgataccagcaggtgctccaggcatccagtctgatgcctcgcaggagctccctgctctgctagctccacctgaagggctagaggccaaccttgccgctccccctctcctcccgtcccttcctcccagcctggtctgatgccccatggttctccccacagcccccaggtgttccccagtggtcccacccttttcttcaggtccagcagatgccttagctggagttatctgcttatgacagcccttgtttatgaccactgtgaaggtagttctctgaagggtgagagaattagataatccaacacccagcccagttttcctttgcttttctcctcggaacggtcagagatcagtgatcgtacaagttagtcccacaggtcttccttccaggacatcctacacccatcagtctgggcctggggtctttctctaagcgtgaggcctgtggctgcgggtccagggtatcttttctgccagtggtaaaaaatgagaagcaaatatcaaaagattcaaaagcctgaccctggctgctgtctgtgtccagccaggataattcggggtctgcattgcagctcttctgtttttgtttggttttgttctcctaattgactatttgcactaaccaggtcagggctaactagtaacaccctacattctgcacaaaaaatcagcaaccccatgacctgtgatgagggtggcctggcaggaggcaaaagcgacaagcgttcctggtatctgaccagcaccaccttgaattaggacatcaacacatgcgattggactataaatcatgtaatgacaactgcaatgacaactctaaaaacaattgggcgtgtgctcacattttcacagtaaagccccgacaatgttgacaaaatccactgtttgaattctgatacgactttcttccattttgtgatctttttattgctcttaattacaacggttagcattagagacataccctatgattccattatttgcaattgcagcttaaatatgcatatgtcctaaatgatggaatgataaccagcagtgccattggaaaatgaaaatattagtgatgctgcagaaatgccaaggatgtaaccatgaggctggactcttggaactggccatagctggggagaccttggactgaggcaccctggtattggctgggtgaccctgggcacattctcctttttctcttttttaaaataagctatgttggtctttagaaaattaaaaacacaacacggacaatgaagaaattaaagaaaaagtctgtatcccctcccacaaacacaaaatgaacaagttaatgaatttgcttccttttttcctagccatattttgtattcactttaaaaagaaaaaatgttggctgggcacggcagctcatacctgtaatcccagcactttgggaggctgaggcaggtggatcacctgaggtcaggagttcgagaccagcctggtcaacatggtgaaacacccatctctactaaaaaataccaaaaaaaaaaaaaaaaattagccaggcgtggtggcgggcgcctgtagttccagctatgcaggaggctgaggcggggaatcacttgaacccaggaggtggagtttgcagtgagccaagatcgcgccactgcactccagcctaggcgacagagtgagactctgtctcaaaaaaaaaaaaaaagaaaagaaaaaagaaagaaagagagaaaaaatgtcttactgatagcactattcacaatagccaaaagtggaaacaacccaaattcatcaactgatgaattcatgtaatggaatattacagaggcatagaaaagagtaaagtcctgatctgcgctacctggatgacccttgaaaacatgacgccgagcaaaaggagccagacacaaaaggccacacgttgaatgattccattcatatagagtgcccagaataggcaaatccatagagacagaaagtggatttgtggttgccaggagctgggcagggtcagggaggaatgaggagtgactgctaatgggtaccggctttttttaggagtgatcaaagtgctctggaattaggtagtggtgatggtttcacagtcttggaactatatgtaaaacactgaactgcagactttaataggtgaattttagggtatgtggattatatctcgatttttaaaaaagaaagtacaaagaaaaatatcactgtctttaaagatccagctctgtttcctggactctagtctagaggaggatctctcagtgtccccagaggagagcccctgggagagaagaaggctagaaacccggaggaaagggaaccctggcccaggagaggggtcggctgtgacgacctccagcatttcctgcaagccagccctgtcaccttcctgcggatagtgatgatgaagcagaggacaataggtttcaaaggtcttccaagcatggtgtcactaggctctcacaccagcctgtggggcagatgtgaggggtatcattgtcctcattttgcaggtgacgttccacaagatgggactgaggtgaccctcagctgggccctcctacctgtgctctctgcagctaggggcaggaggctgcatctgacctgagagtatccctgagaagccagagcaggactctcagctgaaccacccagaaatggccagttggacccaggccaggacctccagtggcagtggagcgagggggtgggagggtggagcaggaaggagtggttgtggcttttaatcctttctgcatataaggctgggcggcttgtgctttggctggcaggcttgtttgattctcctgcatggagagtttcaggcatgcaggtgccaccccaggtggggcccacaggtgcccctaggagccgggcaaaggcaggtcccagggagctgtcagggcacatgtgggaacccgccgccacctgcagctgtgccaggacaccagccagcgttcccacatcctgagggctttcaagagaagccataagtataatctccctcttggttaataatggcagctaaatgtagttttcacaaaaggttccaaccaagcccatatgtgggccacatgtagctgtgggaatgagagtttgagtcgtctgctctaaatatatacacaaaacaagcagtttcttctggataaactggtccacacatcattcatttcattgcggggtttgcttgttaattttggcccaagacatagggctttgagtaaacagagcctcgcccggcagtacaccagctcttacattcagaagccacttccccgagccatgtcctcccagaccaaagtcacactgtgtctttgcagccttcctccttgtctccgtccagccttctcaaggtatccccctgcaccttcctgtacccctccttgtgggtcgcccccacctgtgtgtgtaaacaccttctagaaggtcacattgttaaagccccccatgacccttcattccactccagctcccaccatttctgggctccccttcaggggaagacttctcctcggggttgacacttgctgtctacacttcctcggccccctcactctaaaactacgtaaatgcccagagaataacatgacaacgtgcacctgagcaacccccacccagatggtacaaaggtttccttggccatgtttgtagcagatatttctttctttaaaaaataaataagtacagagctggcagaacatttcccattgcccttcagcccactcctcttggactttcttcccgcagcctccccgtggcccttcatggacacatggtcctggctacagatgaaaaatcgctgggtcctcagcagggcagtcatatttgataatgaccaggattgcatttaaatctagtacctcccagatactgtacagataagatcccagctaaggctcaaaaccactcaaagccatttccatttcagagatgagaaaatcacagctcagaggggttgggggcgtggtggcagtgccagcagtccgcctccagtatgacctccactgtcccttcactcagccggggtagacagacttcccagctgggacaagcactcttaaaatctcagtgggatttccatctccagtgccagtgctcctatcatccggcacagaggcattcaaaataaccatttctgatggactggaatattttgcacaagtgggcagtatctcacctaatgggggtggggaggttatgaagggtttgtgaacaaaccacaggaagccctgctttctcctttcacaaggacaggtggcacctgcagggtctcccctgcagtggcgttatcgttgcactgaaacttgcatgaccaatctgtaaggagtcagggtgggttcagccatttgttatgaccttggcattgttcagccccagagcctggcaggaggggaaggaggaaagtttgactgaggggcctccacccattgcctttcacctgcacactgcctctgagcagattcaggagaccaagctcctccccaggtgagccatgcctctcctggggtgacctggcttacttcatgtgtgccctgctggcaaatgctctgctgctgtaggtggcattagcaagggctgagcaggtggcactgctccaccgggaggttgagtaaatcactgagtcattaggagatgttgagctctcgccaggccctcctggaggcacaggggatacagcagagaactgaagggggctgctgcctctgtggctttggtgcgaggttggggaggaggggacaggcaggaggtgggggagaaggtttatggagaacagagcgcaggggttggggtagatggggagtcagggagccctggtgaagaggccacattagagcagagactggaacaaagggagggcaggatttgttcatcttgcttcccaagaaagaggctgcaggcaaagtgactcttactcctcttgtttatcctcgtaggttctagaagatttctgaggactcagcagtaacttgcagtgctggactgaggctatttccttatatcaactttttgaaaactcatggttaatacctaagtaaagcacttccaccttccccccctccccccctgagaaagtacgttagtcacatgctagcgtttttattaggaaaagacggatttccagtgaagcagagggaagtggattgagcctggctcgggccatggcgccagttgcacttgccctggtgccgagccacagcaagggctggcactcggcaccatgaaaagccctccttttcggaatctgggggacaaaatgcaagaccgatgccccagagtcatcacagatgaccttcattggcacgataaggggggggacagggggccctgccttgaaggaggcatctaaacaccccttgtgatggaacagacttagccacaaaagccagcgaggggcacgttgttgctccctcatccgccggtggcattaagtcctgtagggcaggctgcgtttccccctttcacgatgaggggcctgagcctaagcgctcggagcctgggctttagtttctgattccccacgctgtgctggcacaggtttcctggacagcgccccagcgcgggtttcttatcctagggcggtgagaggggctgccagggaaagtgtgggaaaggacgaggggcgggactatgagagggagcggggctgggggcggggcctggaggaccgggctgagagggcggggccgtgagaggtaacagggggcggggtgagggggcggggtcgaggacgatgggggcggacttgggggcggggcctgggggctagggaaggacagtgccagatcttgtgtccagcctctggaatcttccctcagttcttccttgtcttttcgtggccttgacgtttttgaggaacgcaggtgggttatttcgtaggatggccctcagttcgggctgtctgatgatccttcctccagatcaggttcagatgatgtactttgggcacttttgttcctcttggtgcgttttatccagagcctcataataaatatttgttccatgacaggcgatgtgcactttgttttaggtggttctccccagaattctccactgtcaagttactaatttctcctttgtaattaataagtatccatgggaaatactttgagattatgtaaatacgttgttactcttcagacttttacccactacttttagcattcatcagagattcttgatggttgccaaatggtgattgtcggattccatcattccttccacatttaatagggactttccactggaagaaagagctttctccctcccctgtgcgtttatttacatatgtatttatatcagtgtggacccatgggtctttatttaagtctaaaggttataattcttcattgtagtcatttattttcatgctgaagggaccccagagaaagccactgggagccccttcaagcagccactgtgttcttttggcatgttcccatgtcaaaagtaaagtttctcacttgctggtacagtaaggtgttccaggctcttcttatacttccccgccccagccctggattccttttagtggagaatggtatttggaaaccagtattggagcatgagtatgctcattgctattgaagtgttattgtgaaacccattaagggagccagggaatgtatgagtgtgtaagcatacaggcatgcatgcatatgtgcatatgtatgtaggcatatggccccaaggtccctgcctgctgatatgcatgctttgtgtaaccccctcccttgagtgtgggatggactgagtgactcaatgctaatgaatgggctacggcaaaagccatgggctgtcactttggacaccaggttataaagagacctggcttctgttttgcatgcactcttttgcttgcgcactcagagggtggtcagctgccccttcgtgagctgccctggagagcggtttccctggcaaggagttaagggaggcctgggccaacaaccacatgagtgagcctggaaacggatccttccaggtttccttccttcccttaagaccacagcccccacccatagctcagtcaaatccttgtgagaaaccagagtcagaagcacccagctaagccacattcaactcctggtccatagaaactgggagataataattgtttgttattctaagccactaagttttggggcaatttgttttgttactccatagttaattaatgcaatatgttatatctctatatatgtgtatatgtatagacagggaccacacatacatttatatctgtttttatacctgtctctatatattacaaaccatgagttcacactgataactttaattttagctcagtgctacaaggttcattgtgaccttccccactttccatatttgtaactcctttctccagcagtgagaaacccagctccaatcatctgcaatgtattaatttatttgttcagtcctagaggacacaaaaacagcttcagaattgctatcctatgttccagaaaaagtaacctactcatgggagttcaatctttgtttagagttcttgtctttagttgtcatatagtccaaatactgcaacccctatgttataaaaaacaagggcttcccagcttctctgggaagtaaggcatgagatgcaaaggggaaaagcacagtttctttccaggcagcaggtgctgggcttcgctgtcttgcgctggagaagtgcgaaacagacgggaaaagtgcaaaacagaagggcagggcggggcttcagaggctcccgctccatgctttctttctcccctgagcccacactgcctgcctcccttgcattagcacaaaagcaccaacctctgaggccagcgatgttgtttttaaacagtcattaaattatttacagagaaaagtgtacggtgttgctttttgaaggctactgaggaaggtttgaattttcatcatttctattattcaaaaagccaagtaacaagccgacttggatcttcccagaaaggctgagtttggggggtacttgcacgccctagtccgcacagctgggactagggctggggctctcctagagtaacaaatggggcatcggcatgacctctctgcggagggcctctctgacatgcagttgtcactgcagacctctgcagaggtgacctccccagagacaagggacctcccagagcagcactgctgcttaggtaaatggggacagccaggaggccagctccaagcctcaccccgcagatacctcagtcccatcctggtcacaggcacatggggcactcctcatggcagttgtgggaaagtggccaaggacacaaggctcccgccggccatggtttctctaagatctgactcaggattgtcacatgctaagcgttctacttccccatgcctgcaagcaccccacaagctccccacagacatacacactacacaggtcatagtcatgcacacgccacactacacaggtcatagtcatgcacacaacacactacactgcacacataccacacacataacaccacacacacatcacaaacacacaccacacatgcgtgcgcacacacccactcacatacagactcatcacacacacacacatgcatcacgacacactctgcactcgtacaacacacatccatcagacacatacacaaacatagcacacacacacacacatcatacatccacaaatagcacaaatacgcactgagccaggcctcatggagatccagcgaagggtgctggctctctccctgcctcccacgagcccttccagggatccccgaggcccctgccccacagcctgcctgcacctccctcccacctgcaggaagggctctccccagctctctctgccaactgactccacaaaccctgggaagcagacccaatggggcccttcagatgcaggccggttcacttcccagtgcccagcctctgtgtgagatgtccctggtgactgagaacaagaggccatgtgggataaagccagcagaaatcgctgagcatccagcaccagcagggcctccacaggggatttccctcccacctccttctgctccaggtggcctccctgagccacacccctaacgtgccatttccagatggtaaacaacacttgcactgcagtttatctccttggaaatccccacagctcccaccccagaaccgtgcacaaaaaatatcttcaacaggtagatatggatgaattaaggtgcaaaatgagaaccattaaatacatacttgcaagccatttctcttaaaaggtactagagctaagatccttaaagacttgcatccaccattattgcagatgactattcagatgttgtgggcagacatattgttttataaaggtataagaatggactctgatgatggcttgggaatatattggtccaatatccacttctctctctcttccagggtcagaaatcttggatagagaaaaccttttgcaaacgggaatgtatctttgtaattcctagcacgaaagactctaacaggtaaattgaaatccacgattaagacattatccaaaccagtgcttgtctgccactattctcatgtttgtaagaggcagaaagaggagtccagaagggtggccagaatccattccccatgggagtcactaacaagggagtcactggggctccttgttactccattaacatgcaaatggcttcagaaaagagtttgtgtccaccacccaccctaatgcgagctctcatagccaactgggcccacatcattcctcttagtctcagcaagatcaaggagttgagggctttcaacaggtttccaggatattttccaggcctcttcaatagagtttcataatgtatttagatgaaaaggaatttccatcacaggaaagatctgagcggttgaatgaactagctataactttattaaaggatttggcttgtacacaaaacatccaacaattttattcacctacattaaaatgcatctgttataagctgaacagaggccttgtaaagtcatgtaagtagagattaatttaactaaaatgtctcatctctaagggcaaaagctatgaggctgagtctgggggaaggggaacaatttatccatacattcgtccaatatgaaattcatgcaggtagaataatgacacagaagtacacactcttcaagatcacctgcttcaaatttgtttcacacatgcaatcacagtccctccacatccccaagctgccccttgccccacaccaccctgcagattctcctccctgcttaaaccccagtgattgccccccgaggtaagaaatgccattatgaaacaatgccaacggtcacaaaagtctcccctttgttgcatctacatgtcccttcttatttcaatggcacataggccatcctgggaactctctgtgccagcactgcagtcctccatgaagccagatgcccaggcaatagagggcaaaaagtgcttctgggctcacatacaagcctccttgatgcactccatgcagtccccagcatggattaaaaaaaaaaaaaaactagaatgaaaaaaccaaccgtttaaacccttggaaatgatcccaaagacaaacagcaagtaaaggaatatctttagagaaagccagcaaaaattcagtaagaaaggctagagtctgtgggatttgaaccaagagtttcctccctccctctgcccagctcagcaagatagagactctactccagagtgctgcagccaagaacacagagctccctctccaccagctcccagtcagggggctttcttcctgggaggagcaggatttcagcatttctcatcctgtcccttaccacctgttgctgaggctaagtcctgaatgaatgcagttgagagatagaggctcccttcttccacccgtgccccactcatgtaagcagcaaccacagaaagtgagagtggttataatggattcagacaaaacatactttaaagcaagaaaatgtaactagagatattaagaacattttataatgataaatgggacaatcgatcaggaagttacaacaaatataaacatatatgtacctaaaacagcaccaaaatgcatgaagcaaaactgacataaacaaagggagaagtagacaattcaacatgacagttggagacttcaataccccactttcaataatgcatagatcacctaaacagaagaccaacaagggaatagaaagcttgaacaacatcataaaccaattaggcttaacagataactatagagcacaccacccagtaacaatagaaaacacattcttctcaagtgcatatggaacattctccagcatagaccatgtgttagtccattaaaaagcctcaaaatatctaaaaggatagaaataatacaaactgtcctccaaccacaatgtaataaaattagaaataagaaaccaataggaggaaaaaaattggaaactcataaatatgtgaaaattaatacactaccagataaccactaggttaaagaaaatgtcagaaggttaattagaaaatacttttaggtaaatggaaatgaagacataacaaaccaaaacttaggggatgcaggtaaagtagtacggacagggaaatttatacctgtaaatacctatattaagaaagatatttaataagtaacataactttctaccttaagacactggaaaaagaagagtaaactaaacctaaagcaagtagagggaaggagataatgattaaagtggaattaatggaaaagagaatagaaaagtagagaaattcaatgaaattaaaagctcttctttaaaaacctcaacaaaattcacatatctttagctagagtcataaaagaagagaaagataagactcaaatgactagactcagaaatgaaagaggggacattactaccaaccttatagaaatgagtatgaaagaatactatgacttatatgcaaacaaattagataacttagatgaaatgggaaaattctgagaaatatacaatctgccaaaactgactcaagaaaaaatgtacaatctgaacagatctataaggagtaaagagataggattagtaataaaaaaactgtccaaagaaaagcccaggcccacatggctttttcgatgaattctaaaaaacatttaaggaagagttaataccaattcttcacaaactcttcaagaaaatagcagagaagggaacatttcccaactcatttaatgaggccagtactacccagataccaaactagacaaagatatcacaagatagaaaactatagatcaatatctattatgaacatgggtgcagaaattctgaacaaaatactatcaaaccaaatccagcaacatataaaaataatgatacaccatgaccaagcagggtttatcccaggaatgtaaagttggtttacattagaaaaataaataatgtaatatagcatatcaatatagtagaaacaaaaatcacatgatcttttcaataggcacagcaaaagacttggataaaactcaacactctttataaaaaatcactcggaaaaccaggaatagaagggaacttcctcaacccgataaagaacagctataaagaatccacagttaacatcagacttaatggtgaaagattgctttcctcctaagattaggaacaagataaggatgtcctctctcgctacttctattcaacattttaatggaagtacaggccaaagcaattaggtaagagaaataaagaaagaaaaaatattgagattggaaagagagaagtaaaactctctatttgcagatgacataatcttatacatagaaaaatcctaaggaatccaccaaaaaatattagaactaataaatgagttcagcaagattgtggcatataagatcaatacacaaaaatcaaatgtatttctatacacttgcaatgaactatatggaaatgaaactggcaacataatttatctataattgcatcaaaaagaataataggaggactcacattttctgatttcaaaacttaatacaaagctacagtaataaaaggacaacgatactggcataggatagacatatagacaaatggaacagaattgacagtccagaaataaacccatacacctatggcaaattgatttttggcaagggtgaaaagtactttcaatggcgaaatagtagtcgtctcttcagcaaatggtactggaataactggatagccacatgcaaaagaatagtcttggacccttacctcatgctatctataaaagttaaaatggaccaaacacctaaatgtcaaagctaaaactataaaactcttagaagaaaatgtaagggtaaatcatgacctgggatttggcaaatgattctgagatattacaccaaaaacatggacaacaaaaacaacaaaaaaattgtctttaccaaaattaaacactgtgcttcaagggacgctatcaagaaagtggaaagacaacccacagaatgggagaaaatatttgtgaattatgtctctgataagggacttgtatccagaatacggaaagagatccaataattaaaaaaaaataaataacccaagttttttaaatgggcaaaggaaatgaatagacatctttccaaagaagatacacaaatagtcaataagcacatgaaaaatgctcaatgtccttattcttcagggaaatgcaaatcaaaaccatgatgataaactgcttcacactcagaaggaagactagaatgaaaatgtaagatagtgtgtgggagaggatatggagaaatcagaaccctcagacactgctggtggaaatgtaccatgatacagccaccttggagaacagtttggtggttcttcagaagattaaacatagagtaaccgtatgacccagcaatcccatgcctagtgtatacccaagaaaaatgaaaacattcatccactcaaaaacttgttacataaatattcatagcagcattattcataacagctgaagagtgcgaatagcccaaatgtccattaaatgataaatagataaacaaaatgttcatccattcatacgagaatattattaagccataaaagggagtgaagtaccaacacatgctacaatatggatgaaccttgaaaacatgctaagaagctgatctccaaagaccagatattacaggactgcattcatatgaagtgtctagaacatggaaatccacagagataaaaagtagacttgaggttgcttatggcttggggagtggtgcacaggtagatagatggtggtgagaaggaagataacttaaaatatgccatgccaagtttctttttgaggtgatgaaaatgttcgaaaattaactgtgatgatggttgcacatatctgtcaatactaaaaaccatttaatctctctctctctctctctctctctctctctctatatatatatatatatatatatatatatatatatatatgttttttttttttttttgagacggagtctcactctgtcaaccacgctggagtgcagtgccacgatcccggctcattgcaacctctgcctccggggttcaaacgattctcctgcctcagcctcccaagtagctggaattacagacgtgtgccaccacactcagctaatttttgtgtttatggtggagacggggtttcacaatattgaccaggctggtctcgaactcctgacctcaagtgatccacatgccacggcctctcaaagtgttgggattacaggcgtgagccactgctcctggcctgaatcacatacttgaaatgggttgattatgtattacatgaattatatctcaataaaaggaaaaaagagagagagaaagagggagggagtgagggagggaagatggaaggccatcagaaggagggtgggagggagagaatggggaagcgaggagggaaaagaaaaaggaaaacaaaaggaaagacaaggcagggaggaagccccaaggctggccccatgggagcacagaaagccttctggcaagggccctgcacatgtgcattacacacgtgcacgcattcgcacatctagcccagtaaagacatcctctctagtcctcaagccaactccatccccagctctcccaccccatttgctagggtgcacggctgcccacacaggctcctgctgggtccaggaacagacctccctccatgccttccctggattccatctccaccaaggcatcactccaggctactgcagttcttcctaacaaacttttcaagtttttggtgggtccagtccactcaaaacagtggcagccaaaaatgatggagtaacagatgaaatcctaggcacactaggaaaagaagctggcacaaagccagggaacatgttcagagaagactagaaagccagagttcagggagggcgtgagaggttggctgggttttgggagagatgctgtagagctagaagatccctgatgctggggcgggttatggcccaatgggccatctgtccaaggcagaaaaagacatattggtcacttttgaaatagccttttagcattacttgagtggagaaatgttttactaaggaacagaacaattcaacaatatggaaaaatttggctgacacctaagtaagtaattttagaactttgggaggccaaggcaggcggattgcttgagcccaggagttcgagaccagcctgggtaacatggcaaaatgctgtctctactaaaaatataaaaactagctgagcatggtagtgtgtgcctgtggtcccagttactagggaggctgaggtgagaggatcacctgagcttgggggaggtctgggctgcagtgagctatgatagcgccactacactccaacctgaatgacaagagaaagaaaaatctggaaggtcaactctatgttcggagggcatgtctatactttgtcacagaatgtttagtacttgatgtttatactgatgttatcaagacatcaaaaagttgaaatattttccgaaagagcaaccatccaatgtgtctaaaatcgactggcatataaagagatgtgcactgattatctggaaaaggccatcagatggggcatttctgtccctaataacgctggcttactgaagtgttagtaggctcctgtttgggcccaactcacctgttgaggttaattcatttttgctaatgaaggggaaagggggagattgttgtagaaagaccctgctttgcctttgttttcaggtgttgctgtggccagttcaccaaccagcatatcccccctctgccaagtgcaacacccagcaaaaatgaagaggaaaacaaacaggtggagactcagcctgagaaatggtctgttgccaagcacacccagagctacccaacagattcctatggagttcttgaattccagggtggcggatattccaataaagccatggtgagaaaggcattcagacatggtgccactaggatcacagctttcattggcggccagtctcccagccccaaactgcagatacctggtcttcttcatggctgtggctcaatcttcctagatatttcattgaaaaaccaagagatatatctgtgcacatggcttttagccatgaggcttggaaactggacaccactgtaaagaacatctagtgtcccgtaaatccataccaaagctctgaatccacaaaccaggctctggcccaaccctgcaaacacactccattgctccatcttcagtaaaggaagacaaattcatttttctaataactgtggacctgcagcccccttagatgtgttgagagtctttggaaatattttcctctgaggtctgtccacagcttccctgggcctgcgctcagctggcccgagaaggaccaaggtccctcacatttgcatgtaaacagggagtgccctctgcccttccagtgagccctgccagcgtgggggaggcttcagctctgtgatccgttccagctcactctgaattacactcctacatgcccagtcacagactttttgcaatttcattttatttcactggcccaacatcattgttaaaataaaatttagttgtgttccaaatgctgcaatatacagtcttctgaaatggcaccctacatattagcccagacacaaagaagcagtttataggagacaaggcatctgagcattattagcctcctcctcactttgaagaggtcaagttcatgggtgggcccatgatcgcctgacccatttactcaacaacatcctcatccaacttcttgggccactgttctagctaagccagctttggaacctattcctccaacattaggattgccagataaaatacaggacacccagttatatttgaacttcagacatacattggataaattttcagtacaagtatgtcccaaatattgcatgatttattgcatttaataaaaatgttgtactgaaacatttttcattgttcctctaaaattcaaatttaactgggtgtcttggtctgtttggctgctataacaaattgccttaggctgggtaatttataaacaacagaaatttattgctcacatttctagagtctgggaggcccaagatcaaggtgccagcagatttggtgcctggcgagggcccatcctctgcttcatagatagcaccttcttgctgtgtcctcacatggcagaagcagagaacaagctctctgagtcctcttttttttttttttttttttttttttttttgagttggagtttcgatcttgttgcccaggctggaatgcaatggctcaatcttggctcactgcaacctccgcctcccaggttcaagtgatcctcctgcctcagcttctgaagtagctgagattacaggtatgcgctaccacacctggctaattttgtattttttttagtagagacggggtttcaacatgttggtcaggctggtctcgaactcctgacctcaagtgatccacctgcctcggcttcccaaagtgctgggattacaggcatgagccaccacgcccagccctgagtcctcttttataaggacactagtcccactcacgagggatccatgctcatgacgtaatcaccttctaacatcccacctcttaacactattgcattgggaattaggtttccacgtgaattttaggggaatacaaacattcagaccatggtaccaggcatcttttatttgtatttgctaaacctgacaatcctctccaaagttcccttcagtcacttggccacagactcacacagagggctccagggccctgaggaagagacaagccaggcagttcttgcttggacatgagcaatagcctcactcccctttgacacgagaagcaaaaccaagaacagaggctgagtgccacacactctttcacagtatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacaggtaagagcaggccctttccctcccgataatcaatgtaccacccagaactcactgtggtccccaaagagcttcctaataactaaggacaacaaaacatattgcatcctgatcctatttatgactaaagtgaagtctttattccctagcttgtgttttttactttgatatgactcttaaaaaaaaacagcaaatatagtaatgattgtcataatggtcaacatctctgggtcacccatgacatgcaatattccttgaactgagccctgtacaagcatcatcttcattagacctctcgacaatccttttcctgttataggacaggaaactgaggcacaaagacattaaggaacataccaggcagtatggctctcaattttcactgaaggcagccaaggaatgccaaaaagactccagttatttccagctttaggccttagacatctgtaaaggaaatccctacacagttgctttggtttctgtttttgtttttccgtttctagagttaatgcaagattgctcgttatcatgaactcagactttcagtgtactttgttttaatgataaagatgagtgtgtctcacccctgatctgtagggaatgtagggactcagggcaagtgtccctaaatttcatgaatgatggtgtgctgggaagtaaaagagcctaaaatatgaccaatggctgctcacaggtgttatcagccacgtaggggatgccttgaaagaccactcctccaagtccagaggccgggtttgtgctataggaattgctccatggggcatcgtggagaataaggaagacctggttggaaaggatgtaagtgttttctctgcaaatgttggcagttttttaaaattaatgattgatttgaggtaacagttgattcagatgcagttgtaagaataataagagagctcccttgcagcctttcccattcctccaatggtaacatcttgcaaaaccataatgcaagatcacaacccggatactgtcattgataaggtcaaggtgcagaatgtttccatcaacacgaggatccctcctgttgccctttcatatacatatacctcactccttcctacccccacctcttccttaacccctggaaacaactaatctgcaccaccccgcatttcaagaaggttctgtaaatggaatcatacagtaatgtaacctttggggattggcttttttttcactccacatagttctctgaacacgcgtccaggttgccatatgtattggtcttcattcctttttactgctggctgacatcccatgatatggaggcaccagtttctttaaccatttgtctgttgaggaacagtttggctgttacaagtaaagtagccataaacattccagtgcaggatttgaggttaacataggttttcatttctctgtgataaatgccaggggtgcaattgctaggttgtcattatctaaaacaattaactttctttctattttaatgtaacaattggcaaaaataaaaccttcaaaaggcagggtagagatgtgagaataagttttagtgcagtcactccacacatatgtattgtgcttgcttcccttgttggtcttaacatccaagtcctgcaggtctgatttgcgctgtgcactttgtcaggtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctgcagaagatcaacacaagtaagtgctggcaaaggcacgcagtcctcctgggctgatgccatcacagtggaaacaaggctgagaaggagattgattgcccaaggggattagaagattaaccttgcttcttgttaggtcaacagaaaatgactcacctagatgtcttaccttagccacctaccaaatcacattcactgggctacatggggatgctttgccccaggttcacaagttagcacgaaataaccctcagtgctcgccatggtgatggccttgcccaccctgttgcccagtggttcttgttccctgtaattagttgttattttttaagtgttttaacaggaaaacaatttctcaaagatttagtaggattctttctatttgctgataagtattatgtgattattaaatatctctgtaatgctgggcctttcatgtagactaagatggccaggtggggacatatctggagagggctgcaggagccatctgctcctgaaggggcatcatccttgctggtcctgagggggagctgtcactgtcagacgaaagctgaggtcgaactagagagaaagacgcaaacctcaaccagaagaaacaatgataacaactggttagaattacaataactggtataatctcttggagcatgtttatactccagtaattcttaacgtcaaacaattgttaaatgatctgaaagagcagtttgtttttcccattactggcaagatttttgtgggagaccatctagtcctggcgaatggtcattgggaatcatcatgtatgggactgtgatgctgcagagtgggtagaatggggatggcctactaggaaaagttgtagatttccgagaatcagatctcgaagaatacattggtcgatgactgaatgttttttgttctcacatctctaatttttctggacttgtaagtttttacaacaccccatttcacctggccatgtgacttgtgggcttccctttgtcatccttcgcctagggctctgagcagggcagggacagcaaaggggtgctcagttgtcacttcccacagcacggagcttcgaggactccagcctaagccaagaagaacctgttctactctgttgctcgaaaagaaggtgatttggccaccatattcctaaagattgaaaataccaatccttgcttgggttggaaatctcaaaggcggagtccaggatatcttagttcatttttccaatatctcctggtcagggctttgcacaaagcagaccctcaatgcatgtctgctgaaatgaacttagctgtaattactctggtggacacagcagagttattcaacatatgtaagagtccctgactgtagaaacacctcatggaagcaaattagaaactctgaaatggctcatttgaaattctccaatcttctcttaaccaatgctggcagatttttatctgaagcccttcagagctgagaccaacgatacttccacttgcctttagttaatatcgatcaactaattcccatcacaactaatggacagctggtgaaataggctcagagtgtgatctgtcatggccagtgtggcataaaattaggaagtaggcaaatgtgcctccactcccatttccttcccattccagaatcccaacttcctggaatcttcctgccacctcttgcttcccagagccatgcctgcaggttctgccaccaaaagttagttggtacccactgtgttcttgaagagtcctattaactgatagagacagagggaggactctgggaacaggtcattaactgatgggccactagtggtccaagtggctgcgtccaagatctgcactttattccagccactgaagacagaaacgtcaacaagaacagtgtacctcatttgtatgctacttaacgtttacaaaattatttgctagccaaacacatattctgatatttttacaactgcaggagttaaaggaagcactgtgattgttcaccttttacaaatggctgtctaaggctcttggtgatttggtgattggcccagtgtcataagggagaagccaggaattgaactgcaatttccctggctggtccagatcccctttcatcatcttattcttcagggacagccatcagggtgggaatttcagaccataggctaggacagccagggggatatttttccagccaggaataccttccaatatttctcagtggtcaccttgaagtagccccaacatcaggtgggtgggttattcaggagtttaaccatatgtgagtcagaaagtttcagactttgaggtcctggttttcccaatgaggccataatatgtgacagaatgcaagaatgataactgggctgggcacagtggcttacacctgtaatcctagcactttgggaggccaaggcaggtggatcacttgagcccaggtgtttgagaccagcctgggcaacatggcaagacttcatctctaccaaaaattagccgggtgtggtggcatgtgcccgtagtcccagctactcaggaggctgaggtgggaggattgcctgagctgagagggaggttgaggctgcagtgagccatgatcatgccactgcactccagcttgggggacagagtgtgattctgtctcaaaaaagaaaaaagaaaagaaaagaaaaagaaaattgttatcacatgcctgaattccttccagccagatagaacatcccccaagtcgtaatgtttttactcttccccatacttcaggagttaaaacgactgggtggacagtgcagggcacaggtggtatgggcgaatgtggtttgtgttgcaggactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaagtactgtgaagaaggcgggtaggatttctgacgcgcgaggaagggcgggttcgtaactccctctttgtcgggccaaggagaaaatctaaagtggtctgcttagacattccaaacgtgtttaaatcaggaagatttgctagatctcctctcccatttcctcaggtcagcatccaggggaaccatcagaggcagggtgttcctgatggaattctctctccctcatttccaacttcatttgcccttagaaagtttgcaacaaagctggaatttaggacaagtgagaatacgatgtttgactatggttactttttgtctcctgtgtcaggatatcctcccacagcaaagtctcaaatcaaagacagagatatgtctgactcattcatatatagatttaacttgccttgttttgttctcttgcattttctttgaacagaataataaatgagtccctcagggagcagcttctagttaccattcagaaaacatttaattataataaggcacaatcacatcagctgtttgcaattataatggagtgcatgaagaagaaagaactcgtaagtgtcttgaatttatttccaaacaagctctgtggagagaattatgtttccttttctaattccgcccatgtgtgcatgacagggttattcatattttagtccggccttttctgagagacagtacaaatgcataccaaattggtggctgtgtccacatgacagaagctgaacgagcccacacaggggagggcccctggtgctttcaaactttagcaagtggggcatgacaccacacaacaccctctgaggctcataatattactcagattgatagtcttggggaaaagggccacataccaccctgtcaggcatgtttacaaagttctgttattttatttcccactccttccctcttccgttccatttacaaggaataggtactcttgtcgtgcacataagatggcctcttcaaaattctaattcctacaaatatctcctgtctgattagatacgactttgcatctccgatggcgactgagatttcggagtgtagctccctcctctcgagggtgccagaagggatggggaaaataataaagtcagtatgcaggcaggcaccccacggcaatgccataacttctggaaatcagccgggcacagtggctcacacctgtaatcccagcactttggggggctgagacaggcagatcacctgaggtcaggagtttgagaccggcctggccaacatggtgaaaccccatctctactaaaaataccaaaacaattagccaggcatggtggcgtgcacctgtaatcccagccacttgggaggctgagataggagaatcgcttgaacctgggaggtggagtttgcagtgacccaagatagcgccattgcactccagcctgggcgacaagagcgaaactccatctcaaaaaaaaaacaaaaagaaaaaagaaaaagaaaagaaaaaaaagaaatcaacagcacttgctttgaaactgtttagtgctcaggatcattttattacgtgtcagtctctgtggtcattttgtaacaacaccccatatctccttcttgttttcaacttggctttaattcagtcttttcacattttcaggtcactgtgttcagaatgggttctgagggccagcaggacatcgagatggcaattttaactgccctgctgaaaggtgagctctcaggaaatggtgactcctgtccctctgatgttggcctagccggcaatccttccctcccggcctcccatggactatgtctgctggtgctagaccctgagccagccaggccacttgagcagtctcagcatgaagccacggcagaatgacaaggctcgctgtttctgtggggcagaggtctgtgggtgctcctggaccatcatgggctgaggtcagaaccgtttctatttgtaactggttcattgagggcctcagctcctagagtgtaaacatcagatgggttcctttgcaatcactgcattccgcagtgttctgtccaatttccccgtcttggttctaatgacaggcttcaggccagcgttcatggccgggcggggagggtctgctctgggatgcacacttcctccctgcctctcagttagcctggtgccatgagggggcagggaggacagagagaggggaagggtcactgtcaggctggctgcctggcagtcccagggttccagccttcctggagatcatctccagggtccctgagtcactgggttcctgttctgtccctcccaaggagaccatgcacagctggcatgggaagaggctgcctccaccttcctccagggaagctctttcagctcggagcctttgtggtcattcaaggcaagagcaaagccagcaatgcttagttctaggccagcagcccaagggaagcctgtgctcaccacccagcacctgccaaaccctggcggtccaggcgtggagtgaaaaatcattccggtttcttgcctttccaggaacaaacgtatctgctccagatcagctgagcttggcactggcttggaaccgcgtggacatagcacgaagccagatctttgtctttgggccccactggccggtgaaactgttttttttcgattcatatcattgatcttgactttgtacaagtgacctattagtatgttctcccttgtgacatggaattcaggaaattatgtggggtttctgatgatatgatatgtaatctattaggctcattagaagatgtcactgtttaacttcaaagaaccaacaagaagtaattccacattcaaaccagtactcctgaagaaattaatcaccaaatattttatcgttgctgatgaaagtgggtttttacctttttaaagaaaaagaagaagaaataaaatagcttattaaaatttaatgcaatgcttccatccagggcaatgatttttcaaactatgttccatgaaaccctggaggcctagagaactctgtgtgtgtgtgtgtttatgtgtgtgtgtgtatgtgtgtgtctatgtgtgtgtctgtatgtgtgtatagggtgtctgtgtgcatgtgatatgtggtgtgcctgtatgtggtatgattttgtgtaggtgagtaatgtgtgtggccatgggtggtatagtgtgtatgtgggtgtcattgggagggtattgtgtgtgtgtgatatgggatgagcagtgtgtgtggagtgttgaggagtactaatgtgtgtgtgtgacatggggatgagcgtgtgtgtgtgtgaacacacataagtctgcatgataaaggactccaagcctcctacttcttcttcagtcaaagcagcttctttgatccattttatagattaggagtcaggataaatttgtgtttgcaaaaagggctctgctgcttatgaaaggtagtaggaatatctagagagtttatgttggttttaaaaaccacatttcttggccagatgtggtggctcacacctgtaattccagcactttgggaggccgatttgggaggattgcttgaggccaggagttcaagaccaacctggtcaacatagtgagacaccatctctacaaaaaataaaaaaaattagccaggcatgggagtgcatgcctatagtcccagctactttggaggctgaggcaggaggattgcttgagcctaggaatctgaggttacagttagctgtgactgcaccactacactacagcctgggtgagagaatgagatcccatctctaaaacataaaacaaaaaacaatgcaaaaccatttctcaaaacatccctggcatattgctgcacaaatgcattttacttaactgcctctgtgtttaggtctccctaaagcatttaattgcctcccaaagcatttaactgcctctgtgtttaggtctcctggaagttgcttccacacattgccataacacgtaatatcactctttattgattgatcatgtgtagacggatccatcaattctccacttggtaatagaagtaggtggattgctcactctgcttccactgcccctgttcctcctggatttgatagttgcctgtttaattctattttttctttttttgaaatggagtctcactctgttgcccaggctagagtgcagtggtgttatctcagctcactacagcctctgcatcccggattcaagcgattctcctgcctcagcctcccaagtagctgggactacaggcacccaccacacccagctaaattttttttgcatttttagtggacacagggtttcaccatgtcggccaggctggtctcaaactcctgacctcaagtgacccacccgccttggcctcccaaagtgctgggattacaggcatgagtcactgcacccagccctgcttaattcttatattggtcacctttatgacggtaaagagtacgtggaaccacctacttgttctgtccgcttcagactcccattttgttaaatgaggaaattcactccatactcctccttcctctcctgacaagtttcatcttcctaattcaatcagccccacttttacaaggtgcttgacatgatgaacatgtacatatccttctttaatcattgaggtcctgcttacatcttactctttaatcatcattcagtttttgtacttagtctctatgttgattctaaaaaaatggagaaaccagcagctttgacattgttgtgattacatggagattgttcactgctgaaccgcaaagtaggattgaagtcaaggagaagggaaggtagtcctgggtcatttatctggctcacacaaaggaaaatatgacaggcatcaaggtttccatcattcaccaactatttaaaattaggtgacactttaatttccttcatatttggaccatgacttatttgaatagatatttgcttttctccacatttctaattgattctctttttttcttccaaacatttgccttgatgtcattgctgtatctattcttttttttttaagtatttttattgtatctttagtttggttccaaacaaatagatgtaaagtttggtacctgcctatgtacacttgccactgctaatgttgaggcttatactagtccgttttcacactgctataaagaatagcagtcttctgagactgtgtaatttgtaaaggaggtttaattgactcacatctccaaatggctggggagaccccaggacacttacaatcatggcggaggacaaaggagaagcaaaggcacatcttacacggcagcccgtgagagagagaaaagagcacaaggggctgccaaacatttttaaaaccatcaattctcataagaactctttcactatcatgagaacagcgtgggggaaactgccctcatgatccaatcacttcacatcaggccccactcttgacacctggggattacaactggagatgagatttgggtgggacacagagccaaaccatatcaaggctcttgtcagcaacgtggatatatcaagcatggctgcagcaaaggctaccctgtggggagctagggcaaaattattgcactctttccaagatgaagccatacagatattaccttaaaaatgccattttgtacttttatttgcatatacatagtttatatttaatatatactttgtactttaagttcaggggtacaagtgcaggtttgttatgtaggtaaacttgtgtcatgggggtttgttgtacagattatttcaccacccagttattaagcctagtacctgctagttgtttttcctgaccctctccctcctcccactctcctccctccaaaaggccccagtgtctgttattcccctctatgtgtccatgtgttctcatcatttagctcccacttatgagaatatgcagcatttggttttctgtttctgccttagtttgctaaggataatggcctccatctccatccatgtccctgcgaaggacataatcttgttcttttttatggctgcagccatatctattctcttaattgttactgtcccatttcttcttgaagaatctttcaaagccccatgagttcctacccccatcttccctggatgctctcaatgcctactgtacagttgtctacatcagacatcccttcgttgcactctgagactggccattgcctcctagaccccatgtcttcctccctttcagattcctttttcattttgctggagtacatcttcaagtaacttttacataaaagcatgtgggagaattactgtctgagtctgtgttgtgtttctgtaacagaataccacagatggggtaactgataaagaaaggagatttatttcttacagttctagaaactggaaagtccaagatcaaggggctggtatcttgtcagggccttcttgctacatcatcccatggtgggaggtgaaagggtaagagagcgagagacagcgagagagggctgaactcttaaaacaaatctctcaagatcatgaaccctctccctctataaaagcattaatccattcatgagagcagaatttcataacctaaacaattttaaaggtcccatctctcagcactgttgcactggggattcagtttccaacacaagaactttgggggacactttcaaaccacagcaattatcattctgtgtctttacatgtctgaaaaaagtctgcctcacatgaggctcaagattgtcctatgattttcattcaattatagatgaaccattgttttctctctgctctttgctttttcagtgcttgaaaatttcacaaggatgtatcttctatttcaagcaaatgaaaatagaagtgtatagagaatacaaactcaagcagccatatcttcacacatgtagacatttaattcttctggctttcaaaggtccctttatgctgaagacctgaatcagctctgtgaaattttcttctatctcttctttgagtatttctttctttattatctctttcccttcatctggattttctattagtcaagcaactgctggtccccttctcccagattgaccgtccattttcggttttttatttctctatcattttgctgtatgtttttggaaatctcaactttttctttagcttttatacaatttttaaaggtttaggcactcatgctttttatatttaagaaagtgtttttgttccttaacaattttattttcttattagcctattttcatctcacagatgcaatatctaaggatatgaattagattttttgaagttatcttctgttccctagattatctctattttctccctggtcagctgttctttttgttcattttgggtttttctgttatgctgttgattttctcaaatgctctagatccttggctgtccatcacactacagaatgagggatagaactgcttaattggtatggaaacccattttgccaacaggtttttctcctccctgggaggactgcccaggaattccctgcttaggaaggagagtatcgcctgaacctcctgctttgctgagtgccgactggagagggctggtgggctctgggcctccctattctttagcagacatcctcccagtttttactgggagtgaagcccaggaatgcagttgcttgctctgcacccaccacagtggcagcctggagaccgggaggggatgtgtggcctcctgctctgtagaccatcttccggtcaccatgccttctgcccaccacatgccctcttctttgtatcttggaaaatctggtctcacctcaagagcaacctccacattacacattttgggctttggcttcctctccatagttttaactggtccttcaatgcttccagaaatttgttaaaaactctctggcccgcctcttctccctgaaatagatttttctttttcatactcctctgctgtcatttaaatagtatctggggagggagggaagacaggaaacacatgctcaggctgtaacctggagccaaaagtccttctctgtctccctacagtgggatataaggtctccaaaatcttcttttaatagttgaagcactcaagaaaggatgtgcctgtgaatctatagtctatctagaattcttcatatagtagaaaacttgtggtagggaggacataagaattccaacacagtaaatcaatcttaggtctgatttgctatatattactagacaaaattcttctatctatattttctgttattgaatgcaaaaaataaaagctgcatgagagtatgatgtggttatcagaagctaggatgtgagggattgggagattttggtttaaaagtacaaagtctcagttaagaagaataaattctggagacctattgtacaacatagtgactataattaataataatgtatagtgcacttgaaaattgctaaaagagtagattttaaatgttctcatcacaaaaatgataagtatgtgaggtgatggatatgttaattagcttcatcgttccacaatgtatacatatatttaagcatcatgtataccataaatatatacaatttgtcatttgctaattaaaataattaattaaagtaaaagctttgcaaaaaaaattcttcttaaaacatgcttttaaacataacgaagaggccaggcacagtggctcactcctgtaattccagcactttggaaggctgaggcgggtggatcacctgaggtcaggagtttgagacaagcctggccaacatggtgaaaccccgtctctactaaaaatacaaaaattacccgggtgtgatgttgcatgcctgtaatcccagctacttaggaggctgaggcaggagaattgcttgaacctgggagccggaggttgcagtgagctgagatcatgccactgcactccagcctgggtgacagaacaaaactccgtctcaaaaaacaaacaaataaacaaacaaacaaaaaacataatgaagagagagaaaaagagagacgtttgatatatacaggtaacaaaaggcaatttatttatttatattgaatcataaaaactttggactaacaatttttgaaggaaaatcatcaccaacattcatctcaagagcttttttatcttgcaaaatggacactctatgcccatcaaacaataattccccatcctgccctctcctgtgactggcaaccaccattctactttctgttgccatgaatatgactactgtcagtacctcctataagtggagtcatgtaatatttgtccttttgtgactggcttatttcactcagaacaatgtctcaaggttcatccgtgttgtagcatttgtcagaatttccttccttttaaggctgaataatattccattatatggatagaccacattttgcttatccaagcatccatcagtggacacttgggttgctcccatgttttagaataatgctgctatgaatgtaggtgtacaaatacttctttgagacttgctttcagttcttttgggtatgccaagaagtgaaaccattgatcacacggtaatcctatttttaattttttgaagaatcaccaaactcctcccacagcagttgcaccattttacatttccacccccagtgcacagggttccagtttgtcctcattttcacaaacatttgtcattttctgttgtttagataatagccatcttggctgggcacagtggcttacatgcctgtaatcccagcactttgggaggccaaggcaggtggatcacctgaggtcaggaattggagaccagcctggccaacatggcgaaaccccgtctctactaaaaatacagaaaaaaaaaaaaaaatgagccgggagtggtggcacacatctgtagtcccagctactgaggaggctgaggtaggagaatcacttgaacctgggaggcggaggttgcagtgagccaacatcgtgccactgcactccagcctgggcaacaagagcaaaactccatctcaaataaaaggaaaaaaaaagataatagccatcttaatgggtgtgagataatatctcagatggttttgatttgtatttccctaatgattagtgatattgagcgtttttgtgtgtgtttattggccatttgtgtatctgctttgtagaaatgtctattcaagtctcttgcctatttttgaatcaggttgggttttcttgttgttgaattttaggagttctctatatattctggctatgaaccccttatcatatacatgatgtacaaatatattctcctattctgtggctacctttactctgttaatggtattttttgctgcacaaaacttttaaattttcataaagtccatcggatttgttattaataatttttccgtttgtgcctgtgcctttggtgtcatattcaagaattgaattcccaaatccaatatagtgatatttttgccctatgttttcttctaagcattttagtttaattaattaattagtttttgagattgagtttcactcttgtcacccaggctggagtgcaacggcacgatctcagctcactgcaacctcttcctcctgggttcaaggaattctcctgcctcagcctcctaagtagctgggattacaggcacccaccaccatgtccagctaattattgtatttttagtagagatgggattttaccatgttggccaggctggtctcaaattcctggcctcaggtgatccatctgcctcggcctcccaaagtgctgggattacagacatgaactaccgtgcccagcagcattttatattagtagttttcgattttatgttcaggtctttgattcattttgagttaatatttgtatatggtgtaaggtaagggtccaactccagtcttttgcatgtggatatccagttttcccagcaccatttgttggatgcggtgtcactctgtcactcaggaccataacggttttatctgcatgaggagtcagccaagacactttttcatccatatttgtatgttgaccaggaactatataaatgcacacctcccctgacataagctctgcctcagccctacttaagggttttaagcaggagagttacttgcttccatttttatatttaaaggtcactctggagttactgtggaaaatgcactgggtgggtgccatggcaggtgtgcagagtcctgttaataggcctttgaaataattcaggccttggactagagcagaggcaaagaagaaggcaagaatcagaattaagcaaaatttagcattaaacatggctgcacataggggtagatgaatcattgagggcactggagggactgagatgtcacaatgctccccagttctctggtttgcacaacttgcaagctgtggtaacatttccctgagataagggaccctggaagaggactgggtcggagggtaggtcctgagagtggtttgggacataaggagctgcatgtctttgagacatgcaagcaggatgctgagcaggcaacaggagctctggggagagaggtgggccgcagccagaaaggagaagttgtatgccaatcagtggtgactggtggtgtgggggtcaatgaggtcgtcaaggaagagagtagagtggaaaggtagaaggctgaggacagagcccagaggaaccttgacatttaaagctgcactgagaagtagtggccagacagggaagaggaaagctgggagcttgtgatgcccaagaagccaagggaagagactctaggaggaagcaggcagtggagtcagatgtgctgagaacccagcatgaaatgcccatgaggcaggcaccagcacagttctcagcaactaaacccacagcccaggacagatggaagaagcagcagggtgcgtgcaggagagataggaagagaggaaatggaggctcctcaggtaggcaacccaccaggagcgtttggtaagaggagcgggtgggtctggcaagagaggacgccagctggagggtccggttgtttaggtgctggctctgtgtctgcaccaggacacactcccacattctccaccagaccaggagacaaggccatggggccaggcctacttctgctgtccctcctgttctctggagtagagcacacactccccttgatgaatgagtctgtcaccgcattgcatgcatttcagtgacatgcggagagcttctttacccgccgataagctccagtttacgtttacatccaggcaggcatcctcagttctatccattgtcttgtacccccttcacaatcactttttcccatcattaaacaactatggacacatgtctttggtgcctttgaactctcctttcagcatcctttcctccatgcaaaagcacacatggatcaaaatgtcagccactttaagtatgcaaagccgctgcatcaagtcaagtgtgtgtttgtgcacacgagtaacagtggttcccagtatcagagccttcttcagacagccaggcctgcgacgactgagtatgtaggtgtatgggatggagtccgtgtgcacctgtacatatgtgtgggcatatgtgtgcactgtgtgggtgtgcacatgtacattgtgtgcatgtgtggtgtgcatgtgtgcacatacagaggtgggagggtcaatgagctggtctggggacaagaaagagccttagtaccatttcccaactctgattgctgtggactgcagcccctgggaagcctggcacccccgacggacagcaaagccacggagaaggagaagaagccacccatggccaccaccaagggaggaagaggaaaagggaaaggcaagaagaaagggaaagtgaaagaggaagtggaggaagaaactgacccccggaagatagagctgctgaactgggtatgtggaaggtcacagagatcacgagcttggcatcacccttccccaggggaagggatggttcttgtccttgcttcagtcccacccagggccctgatcccaggagggacgggtaaaggcttgactgggtagtgtcagcatttcaaactacaacagcacattcgctgcaatgagcctgtcggttgtccaaaacaccaaacgttcctgctttggggggaatgatgccacccacagaggggccctgagtcatcctgttcagcaatggttctgtacctggcagacatgccaatgcttgatgcatgaatatacagcagacaaatcagttgtcaccaaataaatgcaattcatgaaaaagcccttttttgacagacagagcccatgattgggtgtgtggggtaacagcagtttaggtggggaggctggagccacacatcgcatggcagttcttggtcttgctgccaccaggacacaggcaagacaggggaccaggcctctgtggtgacgtgtgcctgcccttatcacagtcactcacccacacggcaccctggtcatgctgcctgcccatgcagctcctcctggcacaacttctcagtcaaggaaacaaatggtggagactgggcaggccaatgccaggagggctgagattttgaatcctcttcaatctatttttaaaaggaaacaataatttacagacatggatggaacatgtagaggccaaactgagaagaaaggagaggggagatggggagtgtttacccaagataaagagcaaagagtaccatgctggagtgctctggaatctggcgttcggaataccctttcctctgtgtttccagtcgcccccctcccctgtgtctctgagaggccactcacaggctcccggcccttggtccctgcaggtgaatgctttggagcaagcgatgctagatgctttagtcttagatcgtgtcgactttgtgaagctcctgattgaaaacggagtgaacatgcaacactttctgaccattccgaggctggaggagctttataacacagtgagtgctctagaaaaagggaaggaagcgggaggcagccacctaaatgtgtttgtcactgatgcatattgtgcataaatgtgctcatctgacctccttcagctgggaggtccgtatttaatggcaggcggctacttctcacctgctgctggccacagcctgtgttcatattctcaccacctcctgccatgcctcgccagtcactcctttctcgggcagtattaactcttgtcccgcatttaagggtggtgtgtgagtacttgttgctacaaagagggaatctagctccccaagccattagcagagtgaaatgtcaccaagggtgagaagtcaattgttccttgggaccctcacatttgatgaggctttggggtaaaacatagagctaagtttcacacccaggagctctgctggaagggtttgaatgaaattcccttggcttatattattacaatataagttttgagaatttacatttccttccctattgtaagattttaagtagcagaaatgatcctcagcagctgcttgctaaaacttggtgaatttttttttgtttgttctgagacagagtctctcttgttgcccaggctggggtgcagtgacatgatctcagctcactgcagcctcaacctcctaggctcaagccatcctccgatcccagcctcctgagtatctgggactacaggtgcacaccaccacacccagctaatttttaaaaattttgtagagacagggtttcgacatgttgcccaggttggtctcaaactcctagcctcaagtgatccacctcccttggcctcccaaagtgctgggataataggctcaaatatactaatttgagccactgattctggccaacttgatgaattattaacactatattgtgcaccttaagatactcttttaaaaaaatgcaacagaaagtatttcacaacttttgaaatgtgttggatactttctaaccatgaccagctctgttttgtaaaagaaaaaggctggtgtgggttacactccagctctcacaattcattaattatatagagtagggcaggattttgctcgaagagttcaagaaaaaaacttatttatttatttatttatttattcattcttagacgaggtctcactttatcacctaggctggagtatagtggtgcaatcttagctcactgcagctgcctccccggttcaagtgatcctccaacctcagcctccctagtagctaggattacaggtgcccaccaccacgcccagctaatttttgtatttttagtagagatggggtttcaccatgttggccaggctggcctcaaactactgacctcaagtgatctgcctgccttggcctcccaaagtgctgggactacaggcgtgagccaccgcgcctggccaagaaaaacatatttaacacacatgaatgcttctctttcagagactgggtccaccaaacacacttcatctgctggtgagggatgtgaaaaaggtcagtctactgttttacaattcttacctgttggcatctttcacaaaatcatttcttaagagcaagttttaaattttcaaaatgtattattattccaggcacaggagataatgaattccttctttcgtaaagagtctatttaaaactaagaaagcaaaggataatcttttttaagttgcatgttcatccaaatccatgatagggacactgtcagtgacagccggattataggttgacgccagcgccaggccagggcggccactgggtggggttggggaagggggtggcctggctgctgacctgagccccgctgtctgtccatgcagcctctcgttctgtccctcctttgagatctctcacccactgcctgtggctctttccagaagcaccggcaggaggttcctcaagtcattctgtgtcctgttgattgcagctgctgttcttggccctttctgccaccttgttatcaagggatagatgctttccccagcctgaatattgtttaatcccccacccacccacctgttacatgaactcccaagtgggggccaggacagccacttaccccctagacgtgtgatgaagtccacactgcgaacgcattctcacagggcctgagaccagacttcttttacagagcaaccttccgcctgattaccacatcagcctcatagacatcgggctcgtgctggagtacctcatgggaggagcctaccgctgcaactacactcggaaaaactttcggaccctttacaacaacttgtttggaccaaagagggtagaactcagtgcctgtgtagtgttctgtggttcgcgagtaccatgtggttcctcgcttgcttttcaacaacttggccggttcagagccaagcccttcgccctgtccccagcacagctgtcctgcctcctacagtgctctcaggccagagccacggcattctccagctcccctgagcacgggccgccccgcccatccattgcatttgccctccttttctatccacagcagacttcctcctgggctccggggctactgtctgcccgctccagcctattctactatcccaccactgtacctgccataatcttccaaagcaagggacatgcctgcattccctgcttcaagcctcccagagctcctcactgcctggagaatcgtatccaaactcattatcacagcagccaaggccctccaccagctggccctcacccacatgggagaccacatacctgcaccaaaatcaaatcctgtgatcaaatcaaagacgtgtacctgccacgtctttccccactatcagtgcctttcccacccttatcaaaagtccaactcaaatgtctgatctttcatgatgtcctcctctcacacccaccttacagccccacagctctctacatgtctattagggaacttctcggtttctacctggaataagggccacgcgtctgctgagctttcttctcaattaacttctgctgacagaagaagagtttctatattaaagcacttcttttccttggatattatcattaattgttaatgatacaaagtgctttttaatccattcgtatgtccactatcaacaatactgctcatgtactactaacattagttatctaagtaaattgattttttttcttcctctttcaccatgcagcctaaagctcttaaacttctgggaatggaagtaagtagaacttgttttcaacagttttataatatcctggtcaaatatacatagcccttttaagttctgtatttgcgaatatacgatactactcaccaaaatttacctagatgtcttagtcaaattatataaaaggaccatatatacattttctttaatggggataaaagctgcacaatccatttctagaactaacaaaaccacagtttcaaaagcaaagattaagcaaacaaaaaaactagagaggaacaccacttacgtatgcaaaaaccataagtaaaaaaccaaaaataacaccaaaaagaattcaatagactattttcatagtcctaaatcaaagtagagtcctccaagaatgcaaatacaatgcagtgttagtctttaatatattgcatcatatctatgaccatctctcagcaggtgctaatgaagaatttgaaacacatgtaaaacatatgccttactttgttaaaaaatatatagttttctcaaaatagaatgataaaatactttcttggaatgattaaaatacacgtatatcttagagcaagggaaacgtatgatgagcagtgcatccctgaagtcatgtccatgagaatcaagaacaagacaagcatgcccaatatcattggcgtcatctactgttttataattcttacctattggcatctttcactagtccccaaaagtgttctggaaattgaaccacaaggaaaaataaatgctaaaaaaagaatacccaagaaagggagaaattattatcagcaaaaaaatttggggggagttagaaaatccaggaaaatcaactaaagttccctcacaataggacaaaagtaccagaaattacctttactagcaaccgtaagaacaatgtcccagacctaaaaatatttaaatgaatggaagaaatgccatattgtggaatattaggattgactcttggaaacattctttttaaataaatttatgagctaaacagcatcccgattcttcatggattcagtgtagacggctttcattctgtgttgacaattaagactgtcctttaacacggtgctcctggaagggttatgagctttctgtgatctcctgttctctcaaactctccaggtcagggtttatttattccatgaaggtttggtggactcacctgtaaaatttccgggtccagtcctatttcttagaagtgtgtatttcataatactacttcataatagccattataaatataagtacatttcaggctttttattttctagagtcaactttggtcatttatagtttcctaaaatgacttatttcatctagactttcaagttccctggaataaacttttacatagtattctagtttttttcagtctcctcagtatcttcagttgtgtgtcatttcttgtgccaattttttttttttttttttttttgagtaggagtctcactctgtcacccaggctggagtgcaatggtgcaatctcggctcactgcaaccttagcctcccaggttcaagcaattctcctgtctcagcctcccaagtagctgggactgcaggtgcatgccaccataccaggctaatttttgcatttttagtagagatggggcttcaccatattggtcaggctggtctcaaacttctgatctcagattctcaggtgatccacccatcttggcctcccaaagtgctggaattacaggcacgagccaccacgcccagcctcttgtgccatttttaaacaaaatttatatctcctattttcttaaactttctttcctacatattttattggtatttttgctttatcaagcaacttcctttttctgtttctattttattaatgtctgcttttatttgtatttgtttcttccatatactttccctactgttattgcattgttcgtgctaactcagtttgaaaggaaaattcactcattttccatcttcactgtattcctataaatgcattaaaggtataaattgttctgagcattgtttcatggtattccacaggtttggataagtagaaccttcattgtcgttttttctaaggcatttattatttccttttcaatccaagagttatttagaagtgtatttcaaatttcccagatacagacttttgttgttgtcatactactgttattgatttcaaagtttattccttgtatagaaatatcctgtaattttttttcaaattcattgctaagtaaggtgtgttacttactcaactatggtaatatgtcaatttttccttacactcccagttcagatcctttgttattttattggtttttttcccttttcctcattgatttgtgacaggcctttgcattttaggaaaattaactctttgtttctcatattctctctctggcagtttttaaagagaatttacatgcaattaatattttaataatattagatgttattgaaaggtaggcttaaaaggacttctgttttataacatttcattagtcattagttaatttttattttatcttatatattcttgaaaatctatgtttatctaaacatttctacgatgttcatttttaacctgtgtagatgaacctttcccatatcactgcgactgtagcttcactgtgacaaaattagaaaattagaacaaagatatttaaattggagtcaagatactatattttccattaaaatgttatcacagctcattatgatattataaaaattgggtcagtcgtggccgggcgtggtggctcatggctacaatcccagcactttgggaggccgaggcgggaggaccacgaggtcaggagatcgagaccatcctggctaacacggtgaaaccccgtctctactaaacatacaaaaaattagccgggcgtggtggcgggcacctgtagtcccagctactccagaggtgaggcaggagaatggcatgaacccgggaggcagagcttgcagtgagccgagatggtgccactgcactccagcctgggcgacacagtgagactccgtctcaaaaacaaaacaaaacaaaacaaattgggtcagtagtgaacaacctgagataggaattggagagccaggatacctcctataactccccatgctccagaccactccaactctgtgaatgtggctgagttattcagactgagccacagcttcctaatctgagggaatggaaggaattcacaacctctcagagtccttgtaagaataaaagaagataactgatgggaacgctgtttgcaaaagaacaaacatctgtttctgttattccattgaatactaaagtattagcctggagtagtctgagacccacatatttcatgccaattttcccaatcacgatctgcctttcttatgaatcctgatccattcacagaacagttctcataacccctttaggaaatgggaaagattggccttcctttttgcaccatatggggaaaaggacagtgctcactaaaagaggaatgtttgctttcttaaaacactggagggaaacctaaaacatttttctctagccccttttgcatgtttcctgttaatttctggttcagctacgtctggcaaacgagtgttatttttgctacatttgaagacctccctgaggaaataaactgtagaccttccctcttccatgatgttatttgtgtttagttttgggggaggttttgcttgtttgttttagttttgcagcgtcgcctcagttaaaggcttctaagtaaaactgctgacccaggggtgcaagttatccaaacagtatgccttctcagttcatttggttttagatagtttacttatcataataaacgtgtgcatcttttcaaaagaattcatatgcggagtggaaatgtaagatgtacttcagaagtctctttattacctctgacagaaagggttccctttctccaggagttctggaactctttgttgcatacttttatggcaaaaccatgaaatccatgtttctcccctcaggatgatgagcctccagctaaagggaagaaaaagaaaaagaagaaaaaggaggaagagatcgacattgatgtggacgaccctgccgtgagtcggttccagtatcccttccacgagctgatggtgtgggcagtgctgatgaaacgccagaaaatggcagtgttcctctggcagcgaggggaagagagcatggccaaggccctggtggcctgcaagctctacaaggccatggcccacgagtcctccgagagtgatctggtggatgacatctcccaggacttggataacaattccaagttagtgtctagcggggatttaaaggccaggagagatgaccatcctgagtacttgtctctgcagggaggggtggccaatgtacttctcacttaaggacaatggtggttaaagcttgttcacaaatcacttcgtctgtcatgtcagcatttttctttctgtctctcagaggtgtttttggactgtcgttgttttcgtgtactgccttctctttgcatcaaaattgaaacacaatttttttcctttccttgaaacacaattttaatgcaaagatggtgaaattaatttccatagggaaacacacactaacaaggaatacaacattaatgagcctgtgccctggactgtgacctggactgtgaccttcacaggtgtttctgattttgctccatgcttaggtgggacaggatggctagagggggctggagttgggcgtgcttcccctgggtcagtcaggctctgatcaaaccagcaggtgaggctctggtaaaattggttctcctggccgggcacggtggctcatgcctgtaatcccagcactttgggaggccgaggtgggcggatcacaaggtcaggagatcgagaccatcctggctaacatggtgaaaccccgtctctactaaaatatattttagcccggcgtagtggcgggcgcctgtagtcccagctactcgggaggctgaggcaggagaaaggcgtggacccaggaagtggagcttgcagtgagccgagattgccccactgcactccagcctgggtgatagagtgagactccatctcaaaaaaaaaaaaagttgaaggaacttggaacgtttatggttattgccaaatatttgaatctggatcatgtggggaaggcagtaaactttatgctcaaaattcagcttgtgccaccttctccatgccccccaacttctatcactgtccccatcagtcattagacgccctctggcctgggccctatgacaactatgcctcatccctgtcatagcactgagaatgttggcttctctgtaatcactgtgatggtgaagtgttacacgggcagagaaaggcatacatccgaaatgtccagctggtgacagtccacaggtgggacatgccggcaccaccagcacccagatcaactaagaacctagccggcacccaccagccctcctgtgactcctttcagtgtccacctcccgccaccaccaccaccagcagccccgctactgtggcctccaactccacaggtgctgcatttgaagtcacttttgctgtcttttctatctgcctccctgatctgtgcacaacttgagggaagggactttgtcttctcgtctctatgtccctggggtctgaggggcagatgtggtctcaacctacagctccatttgcagcagtagcagtcagcccacctcctgactgagctcccagccactgtccctggccttccccctttggggacacatccctggagcttcttgcttgcagagaacctcagagcccctccagtgaaggatactgtgtcccgtggctccataagtccttggtggatatgcctgtctaagaaacagcttgcggccactgtggcttcaccctggtcccttctctttccccccagagacttcggccagcttgctttggagttattagaccagtcctataagcatgacgagcagatcgctatgaaactcctgacctacgagctgaaaaactggagcaactcgacctgcctcaaactggccgtggcagccaaacaccgggacttcattgctcacacctgcagccagatgctgctgaccgatatgtggatgggaagactgcggatgcggaagaaccccggcctgaaggtgcgtgcaacgtgctgcgaggcgggccagggtgacagtgacaagtgactctctgccaggctgaactgagcactttctgtgtcttatttcatttattccttctagcaaccccctgagggagacgccatgacaatcattgtcttatagatgaggaatctgaagctttgagatgaagtgacatgcctaggatcttagctggtcagcatgggatcagaacctacactcaggtgctctaactccagagccccacctgaccagcccaccaggctgcacaaacccctgccacagtcagagtctcctaatggagccccccataactcagtatgcacacgcaccctggttgggtcgtctacccaccattaaaggagggactggaactctgtttctagattcccttataactctgaaattgtgtattattttaactagtgatgttttcatgacatgggagaaaattacaagaaaataggaagctacgaaggggtttgaaaaagatatagtgggggaaaaattatattgcaatcaaaccctagctcttgggtttactgctgttaactactaggttatcttgagaagagattctaatctgcagataacctagcaatctaatggcagtattatatctattttagagctctccatgaggataaagaaaagactatacgagttacactgtgtagtatggttctggcaaatagagggcactttgtttcttagaaatgtgaatgttatgcttaactgtctaattctatataatatgctaagctgatgttatacataacttaggatattaataaacagttttcagaattccaagaataaagagctctttaaggttttcaggaaactaaagtagatcgcctacatggggatgaacatcaaattggcatcagacttttcatcaacaacactgaaacccagaaggcagcactggagtaaggccttcacggttctgaagggaaggcatttggagcctggaatattttctacccaggccaactattcaaaaagcatgagaaaagaatatctgtttaagacaggcaaagactcaaactatacaccttcaacctcccatgcagaagaattagtttagcaggtagtccaagcaaaaaaaaaaaaaaaaaaaggggaagcatgttttctatctatgagcctgggcatccgggcatccttttgttgtctaggctgagcccatgttagtccttcttttctgagtcacattagccttggaactcttagttcacataatctcatttatatcaaagttatttctatataaaatacttttggcctacttcactagaggtattatattttatttatattattctattttaatttaaagatttgccttcctcgaaatttcatgtaaggacttttattttattttattttattttatttttgagacagggtcttgctctgtcacccaggctggagtgcagtggcgcgatctcgcctcactgcaagctccgcctcctgggttcaagtgattcttgtgcctcagcctcccaagtagctggtattacagacgtgcaccaccatgcccagttaatttttgtattttagtagagatggggtttcaccatgttggccaggctggtctcaaactcctggcctcatatgagccaccaaccttggcctcccaaaagtgctgggattacaggtgtgagctaccatgccagccaagacttttctttttaaagttaggatcaccaacagtgctgtttgccattcatctaaaaaatttagtgtatgttcttaaattgttttactgcctgcaattctactaatttaccaagcacatgtcacagaacgtcagaccagggataacattccagggctcctaggttattgaataatgttgaaggtcataatttaaaaattttaactatgctgggacatttttctagaattgccacagcttaaaaaatcaatttatgttccgtaggttatcatggggattcttctaccccccaccatcttgtttttggaatttcgcacatacgatgatttctcgtatcaaacatccaaggaaaacgaggatggcaaagaaaaagaagaggaaaatacggtcagtgacacacttgaccctaagcatatcagtgtaatcttgttttcaaaattgttgagatttcttgtaccacagattgagaaatctcactggttaaaggtatttttggaattgtgtttttctaatggtgcctgtgtgccggagtgccttgcatttcccatttagccacctgcctgtcatgtgctgtgctctgttttccaggatgcaaatgcagatgctggctcaagaaagggggatgaggagaacgagcacaaaaaacagagaagtattcccatcggaacaaagatctgtgaattctataatgcgcccattgtcaagttctggttttacacagtgaggcctcctcctgaacatttgacattcagtatattttgaatgctttgatatgttggaatcaagaaaaacttcaagggcttaaaaaagtatctaaaaattcactgaattaaaatgaattatgagaacaaaactgggactaattgagatctctggctaacattggatctcgatatcctgtcatatattgatatatggccatcctagtcccaaatacaccatctcataaggcaaaatagtcacatgctatttgcttaagatgaattcttctgatgcctttagcaatacaaacttaaggaactataattttatttttaaatgaacagagatgactagtgatttaaagagcaaattcacagattccatttttcatgaaattggtggggtcattacaagggcatggctaaatccagatggtaaactcttggaatagggaaacaaatcaaggcgtctcattctgaagtgctcaccaaactgacccgcttggctggcaagccatcctccagccctctctgaggccctgggtctacacagctcccagagtgtggctctctgctaacaagaacaggagaggaggcaggagggcagatcagagcgcctctgggggaaatggccgagctgcaggcggtcccagtgggggtggccaggcacactgtggcttgtgcaaccacgtcagtcgggaggagagagacttctcatgaaatcccaagcatcaagccacagcccccgccaggcaggcctcggtgctgtggttgcactggtgatgaggtgagagcagggtatgggacatgaggagctgggtccctggccgtggtctgggcgatgaatgagggtgggctgggggcagagcaaagctctgtgtgggggcccacctcaagggtcagctgagggcctggacacccaaccttgtggcagccaagattgatgatacagtcgaagtcactgctgcccatcgattctggttagaaccatctgagggcctggggtgcacccagcctgcaggagagcccagccatagaggctgctgccggagatggggccaggaagccatcgaggcctctcagccttgggtctcaccccagaccctctggatcgggtggagggtggagtcatcacacattgtgcagcttcgcagggattaggatgcagcccaaagtctgagaacatggctctaatctttcttcaaagagtggatagtggatcttggggtggggcctgcctctctcctggtaaagcttataggcttgggaggcaggatcttgaaaaaaaagaaaaaaaaaccaaactgcccagttacaaatactcagtttttagcacccctcccccaagccttccacaggggcctgtgccagtgagggacccagaagcttaagtttccttggcatcatggtgaatcactggggacaggtgatctactttagacgtcctcccccaaccccttaactccccgcttttgcctcacccactgccacctccagctctgcctctttccctgccacagagataggggccctgctgtggccacagcaaatcctggacatgccaccagtaactgaggggactctagggtcagctcgcatatctgggtgggcaactcatccacatgtcctctcatctaacttcccagttgtggaaagaatcaggaaggaaatttctgaggcagggaggagtaagtaacattttccagtttccaggaatgtagaagacactccagcaaactattaaaagtttcccgttatcataatgtttgcaacttcatagtttccccatgaggatgacagcaccaaccaatatgtctccatgtagaaaatgaaaagtcagggcccatatcgtgctgaagtataaaatgcctcccgtcctgcctccaggtcttctgtctgcactggtgaggtgcagtgaaggtttcctctcaatgagtcagtccagttggaaacaaagattcttttagatgtgtcaacctgaaagaaaacagcgtttcaaaatttgattgctatgtgattcccccaaacacggctaacagcttgtctttctttcagatatcatacttgggctacctgctgctgtttaactacgtcatcctggtgcggatggatggctggccgtccctccaggagtggatcgtcatctcctacatcgtgagcctggcgttagagaagatacgagaggtggctactccaaaggcctcccccagcccactaaccgctgactgcaaatgcagatatggctccttactgaaaaaacgtttcatgcaaattatgcatgttgggccaggcgtggtggctcatgcctgtaatcccagcactctgggaggctgaggcggatggatcacttgaggtcaggaatttgaaaccagcctggccaacagggtgaatgaaacactgcctctactaaaaataaaaaaaattagccagtcgtggtggtgcacgcctgtaatgccagctactagggaggctgaggtgtgaggatcacttgagatagcagtaattcgaaaccagcctggccaacatggtgaaaccccgtctcaactaaaaatacaaaaattagccggtcgtgtggcagttgcctgtaatttcggctactcaggaggctgaggtggaaggatcacttgaaccctggaggcagaggttgcaatgagccgagatcgcgccactgcactccagcctgagtgacagagtgagagtccatctcgaaaacaaaaacaaaaaaacaaattacacatgctgtgggactttttttggaggtatcacaatcccaagtttattccatttctttatttaagatgtatacatcttgaatgaacttgaacttgcaaatcaaaacacaaggcaaaataaagatatttaataatgaaaacaggtttgaatgcataggaaagcatcagcaaatgctgccagcgacctgagataaaccaattaccgcaactgggcacaaattttggcttagttatttgggatcagagggagaaagagagatacaagagacacttgcacagtgtggtccaaagcccaaagttacaggaaaaatgccatctcttttatctctggactcttgtgcaggagatttatgaagggagggctcccagtcaggaggaaaaggagctaagtgaggtgtggcttcaggtggatcctgtccttggcctaatcctgtagggggctctgagtggactggacactgtggagtctgtctcacctttgggccccacctcaatttgtcattggtacccaccagagacatggctccaagcatctaagagcaagcctcccagaagggggcaggtgtgggcctaacagcagcacctgcagcagatggggtgggcaagcccacctggggaaaagctccaggggatatgggaggggcctagagcgtttgctgcaaacagagggaacaggattttcaactcagtattgcaaaagaacagataccatctcacatatgactcgttatcccagagagctcgagtgaaaatgtaactcccagtaagcaatctctgcagacagcagaggaaagataggccggatacttccctttccaatatcattcagaagttttaattcactaaatttgcttataaagagaaagcatgtatccaagcaaaaaagcaacttgagctgaaaaagcccacagcatcatttcatatcctttctccaactgatatacaaccaatactattattttgcagtaattgttgaccctttcactgaactgaaaaacattattaacctagtccagatagagggaatctgatggcatcggtctaattagagcctgaaaaaccaaaagagcactgaatccaaaattatacttgccaccttctactactgttccttttctagctgggcctcattcaaattctgcaggtgctgcaactggtatttcctgagcggcctgctttaccatcgctgtgccgtcctggccttgctgagggtccaccatacaccgagacactgttctttattccagaaacctgcccccagttataggagagagagggtggccatcggctagtgtgcatgggttgttaaactagtgaatcccttctgtgtgggctgacagatagccactgccccatcctaccacagagatccccaagacctctgcaactgaaggggtaccacctggcatggcaaccctccatcccagtgtggtaccacagacagctgtgccattgggaaggctctgcgcacgcctgtgcatgctgcttgctaaatatcttccattttactctgtggaagtctccccttaagcagcagtgattttgaaaggataatatctcaagtaggggaaaacctggtctaactttcccctaatttctcatgtctaagttgcaaaggaattttgccaaatcaaaacatttcctagtggtattctgccatctccactgggtggactgcccctctgtggggccacgtggggctcatctatgctctagagttttcatcctgtgtgactctggaatgtggagtaacaggcacgtgtccagataattaaaaaagaaatcaaaatgcagctgctttaattacagccagaaggacataatttagaaggcatttcctgagtttgtaaaaccctgaatctaagaatagggaggattccgtggaatttccctttctagatatctctccctgcctgagaagaagagtgtttaaacgttttgagtaggaaaggggccagatgacctggaatgttccatcagtcttattgttccaagattctaagacaagacttctaatacggcatctcagtttattgttctttggggtttgttttcagatcctcatgtcagaaccaggcaaactcagccagaaaatcaaagtttggcttcaggagtactggaacatcacagatctcgtggccatttccacattcatgattggagcaattcttcgcctacagaaccagccctacatgggctatggccgggtgatctactgtgtggatatcatcttctggtacatccgtgtcctggacatctttggtgtcaacaagtatctggggccatacgtgatgatgattggaaagatggttagtagtggcatcctgtgggtatccagagagactttggctgtagttaggacataagaacaggccttgggcatggcttccttcaatttcatttggtttttcttttgcagttggctttttaaaggaaatattctttgctttaagatacacagttctcctacatgttgataacttaataaaatccaatagaaaaacatgagttgagggcctactgtgtatatatacataacatatatacatatatagtgtatatacattcactgtatatatgtgtgtatacatacacacgtacacatgtatatctctctcaatatatatcaggtactcaatatatactgtctcccttcttccataccatatctcaactgtagggtgactaattacgtttgttttttattccttctgatttattattaatgagtctattttgacagcaatataaaagaaaatagcctcgtttttttgtaagagcttacttcactttcccaggacataagagaacatcaatttttgatgcaataggaattcagtagcaaaatagatgtctcaaaatatttacttcttgatggctggaaacatattttcagcattctttagtacagggacatggatttgatgttctatgagactacatccacttcagaatgtatatatatatggccaaaaaaaaaaaaaaaaaaaaccccgcctgatttataacctcctaacatgtggtagaagccggagacaaagggagcccagggccaatccccaacctgtactccagatgatcttcagctcatttactctggcctggagtgaacacaggaagtccatgtgattagaccatgatgacttatactccagaacaggccagagaatatgaaactgaaaatgaaccagcaggtcatccttacattacctaaaagagcttcagtgttaggactggtacaagaagaaagcaagcctcctacatttaggaaggactctttatagggcaagtggttttgagctaagggaagtatgctttagtaaattccagcaagggcctccatcttcagggatgttcaaaattaggaattataccagtttagtatccacagtaaccagggcattgctcagcacttgtgtagtgaatgaataaatgttggtctatactctcaattcattatcgttttatttccttaggtatctgctcctcttcctccttagcatcccttacaaactcccatcttttcttctaattcttccctttctccatttgcagttgtagttactaagggacatgtgtttatgggcaacaacagagaagaagcaagaaggatgaagagcagatgaagatagcaatgttctagaagacattctaggcataaagcattgcatggagtaggaaaaagccttcccagggatgggaagaaaggaagggaaagaggctttcttcgtcctaattaagcactcgtgaagtgcttaattggagacagcaatataatgagccagggtgaacttggcccacaagccaagacagtgagagacaaatgttctccttactcagatgatcgacatgctgtactttgtggtcatcatgctggtcgtgctcatgagtttcggagtagcccgtcaagccattctgcatccagaggagaagccctcttggaaactggcccgaaacatcttctacatgccctactggatgatctatggagaggtgtttgcagaccagatagaccgtaagagtagaattcatagtaagattctcttccctgcttctgaggcagatgatcagttccaaattaatggaagaacatgtattaatttggaaataaaaaatatttgtcactccaccataggcatcaaattattttacaaagaaataagaacaaattatggaacatggattttcagacatcagtcatttcttttattctaaaaataattcactagaattcccttgagctggacctgatggacatcgtgtcacatgaatgcagttctaatgccaatagcctagtttttcttcaacccagtatctccccaccccaggataaggctgatagtgttttccagtagaatgaactagtgaacagagcagagtaactgatacttcccaccatcctcttcttaaagccatcagagcccattttccacatagctacccatttcatacccatttcatcttcactactagagtgctattttgtattatcaaaaataatctggatgttagtagaggaaatgggctatgatcctgcacagatttctggggaatgtaggcccagctcctctgcaggctgagctggtgtcttctggattgaaggaatgtaaagctcaaatgttcttgtacactatttaccaggacagttgaataaatgttccaccagtgaaggaggcacttttagtcccatttccatttcaggaccaacattttcatttgcatgttgtgatttatcataaagcatcagctataatagcatgtctgctgcttccagagctctgctatttgggaatagaaagtttttatcatcttcctctcatatggaatgtagggctgtcagtgtatatctactgcctctaggttagacaataaccagctcatgcagtagcttctttctaacttttataatgtcattctgaccatatcattattgcaagtatcacaaagtcaactattgaagtgtgttagtagcttggtaagccagaacataaaaatctaatttgatttcaaaagaatattagtttaggtagatatacatacacgttaaaagttcctgaattccaggcataaactgtagtatttttattgttgagctcttttttttttaaattaaattgggttatgagagaaggtaaagaggtaaactttaggctgtgctattctcagtaacataattaaatgtaggtttttgattcttgatctattaactaataattttgtagttatttgtgcttatgaggtgtttgtgttggaatatagggagcgcgtgattggttaacctgatcatctgccagtaacatcatgtctttttcacagtatttttaactagtgagcttttgctctcgcttatgacacagggtaaaataaatatccatgatatatattttctagaatgattaatgtatgtaattcttctaaacagatcactgtttctaagtgtgaatcaatatttcccaagcttaaaatatttgcatttcttcacagcaaaacagttatgttgttaaaccacttgttttacttttctctcaaccatcatcttattttctttcctcccctcctgtcaaaacaaaacaaaacaaaaatcctgctttccaatcgtcatgtagtctacgccatggaaattaatcgtaagtttacatggaattgattattctagtctatggaatgtgtttttcaattaccttttccttagctgattactagtagtcttaaactgttttcaaatacttctcttgttttttggtgccagtactttttaagctgtcagtaaaaagtaaagagaaccacaaattcactgttgggatcaccctatttttttaggggagaaatagaccccctatgataaaaagttgcatttcaaatgagcagagggagaaaagattatttttcaaacatggcaccaaaacagttgattaaacaatttgggaagtagaggaaatccctaacccatacaacataacaaaaatattttcaaatttaatgtatcagtgaaaccaagaaaacaaccagaagacaacataagctgatgttaaataattagaagccacaatgactttcaaatggataacgataaagggaaaaaacataaagatacatttgtctgcttaaaaatgaagacttttatatttgaaagccacaataaagaaatgggaaaatgtttagaaatatgacaaataatgactatctctgagcgcagatatgagtttctgacttttttctttgtgtgagttgttttttttttgagacaactgggagtctcgctcagtcacccaggctggagtacagtggctcgatctcggctcactgcaagctctgcctcccgggttcacgccattctcctgcctcagactcccgagtagctggggctacagagtttattttttcccatggaaaaaatattgcttatgaaataagaaagaatcatattaaaaaagaaataggtattgaaaaacatatgtaagagatatttatccttttcattatatgtaaaaagcaaagacaaaactatttttttctttcagctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaagtacgtgtcacagccgatgaccacatgcttattatttattactgtacagattttccatttaatctcagaacgctcccaagataccaatatatttgcagataatttcattagggtttttaagtagatccaatttttgcagtctctttgttcaaacttaatcagtcttaatgtattcataaatcaagagttgacacttaaatacatttaaatttaatcttggttagtattttaacactttagcatgtattttaatctaatgaaaatattttcttagatgaaagtctcctggggtacagaatatttgattaagtcatgctttttattcatcagcagaggtggaaaaggcaatatgagtttcataagctgttacaattactgtaatactagtaaagcatttttttctgatcatttatagaatacaagataaaatggcctaagaaaaaaatggcttaaagggttaaatcgagtttcttataaaacctgcctatttggcatgttgtgttgagtatgttgaccatgctcaataaatattgaaaaaaatgattttagcttctaagatgaaaaatatagagggaaaaatccttcacagaaatatgcaatcttagaattgaacagggcattggagaaaacctggtccaaacttctggcttgagagatgagaaaactaaggtcagggaaggtaactggttttcctaaggtcccagtattggtagacaatgaaatcatgcacttactgcttcctgttggaagctaaaataagacaaagattgtacctaccccatgtccaaaataacgaaccttcaatcaaataagttcaataactaattaattcagttgaaaaaaaagtagtcatctacttgttagacagaattgaaagtttaaacatgtgaaagcatttagttaaatggcttataccgctacacataggaaattaaatttcctgagtatatgagtagattgtggtgtggtttttcaagaaagcagtacatagcaatttattacacttagctatttatgaatacaatgtccttaagcacagataatccacattgatggataaaccaaaagattggataatcaaggaatcagtactaaagggcactaaaaggccatctcattgagtattttcacttaaatgtgagtaactttgactgctctgggaaatcactataaaaagtaatataactaactgtaaaaatgtcttctttttaaagcaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgagtatgtgcagggctcttcatttctaagttgggctgatttcaaaatagtgttcaaattggacatcctcacagaaatctcactcaactacttgctcgtgtgaaaagcaccacactcagtccaactgctgttcttttcaaaaggcttctcattttgtacccattttattctagtttcgttaatttgttagtaattaatattaggaaagccagctcatagagaccagaagttgagctaattctctaaaataactctactctgtaaatttctatataaattcaatgctcctttcaaaacgtcttaatttgttgcatctaaagaaaatgagaaaataatgctatacgtttgactctattcataaaaataagtgcaaaaagttttccaggaaatattacttggctttactttcccagtaaatgtaattttgttttttatgtttaaaagcgggccgtttggctccaactgatagagggttggggcgtatgacaacccctttttagataaaaatcaattggagtagtggcgaactgccttaggagtggcggagaagagagcttaattaaagtggggctgtgaaattctcattgacgccacgaaactgattcttcttgtttttcacgtggccgacacttctcccttcacacagagctcttccttagcgacgaggagctaaagaggctgcatgagttcgaggagcagtgcgtgcaggagcacttccgggagaaggaggatgagcagcagtcgtccagcgacgagcgcatccgggtcacttctgaaaggtacgtgtagcgtccccaccgcgggcccgtgagccaagggtttgctgactcgggcgccccactctatgggggatgccagagttcatttaaacatgcactccgagttctcctgttttatttaaactttaggttttaacgtggttcccacgaaatagtgagaaagttactaggtaataactgtgcattggatatagaagggaatgacatttatttatcctgggccgaaagaaaacctaacagttgactaccttcaccccctaccccaaagtgggggtgtttccgcaaggttaatggaagctacagaaagccatccttctcccagctcttgttcctaacttccctttgcgagcatggtcctccccaggggactgccctcctcatccggcctagctgcttgctgcaccttggcaacacctttcccagcctcacagggcagaggaaaaggctccctcctggggctcccctgagagtgggaactgggaggggtggggtgcagggtggggggtgaggtgtctggccccatgagggtgggatccgctaaactagggcagggtgtgtctttcagacaccttcacatccgcagtacccagcaaggtcagcctaatctccgcggtgatgcttaataaatgcagagtgaatgaatgcaggatgtgtgaaccagtgaatgagtaaatgaagtcaggtcgcgaggtacagaaatggtgacattttccaaacttcgtagtattgctctaccctaagctaggaaagagcaactggcaaagggtagacaggagcaatggaccttcactgtctgcactttttatcacgtaagttttgagagcctttatcatttactaaaagcattttcagcctgctaaagatcttggtgactgataacacgctgttccaaagggtttcactaacaacgtggccagaaggatgagctcagaggagccatgcctagctctgctttctatccttgagtacacagaattaaagtttcctaacagacacattgagagccataaaaacagggtgggacttcaaaaagatattgcagctgacagttcccaaacaattacaacagaattcacagatgcaccttaggtctccctggtgcatgttgaggccagtgaactctgccccagcccacaggaggggagatggcaactgtgggtccctggcctcggttccctcctagacccagtcaccttgtgacccaaccaaatccaaccagctaaactctagggttacctgcaccacctttcttccttaccaaggtgaatttttaataaaactttgaaatgtttctttgatgctttaacagtaattgctaaactttcaaggtataaaaattatttcttcatgagaaagttaaggtaccccatgtaatccaatttccactttttagttagacattaacttgaacgtaattttaaccagtcatttacaatggagattgtgttttgttttgctctgcctccccctctcccttccccggcattccttggatttttaccattcttggaccaaagctgcaagagtgtggttatcaggtcactaccaaattgcatttttctctgggggctctgtgcacacgtaatagggatgaaagtgtgtagggcagagaaaacatgctgcttcctgtttccctcggctgagatcccaggagcgatgggagcacattcttgcccctccatttcccttggccttgtcaggctgactcacaggtgaatgcccaagacagaaagaggagaaggcttgaggagaagggagttttccttccctcttagccaagccagctgagaagcaagggataaggtgggaggatggaaataaaagtagctatttgggcacctgtgactactttaaaaatcacacttgaagtactcaagcatttctgccatttctttaatattctttctatataaaattagttttattttctgcatcaccatttcccatttgatgattttcctgctcttctctcggtcgtgtcttcgccagcactattcagtctgtagggtctggttaggagcatgtcagcccctgccttgtctccctgttgtcttggtagctttcagagctgagctaccaattctcatgactcagttttacaggcgtgttcacacaggatgggtacccattaatcattctcctccacgcagggtgcttttagtgcttctgtgcagaaaccaaattcatggttctctcctaatgtttggaaatttacctataaaatgctaacaatttaaccatttattttttctcaaaaagttccaacattttgtaagatccaacattcagtcctgcaatgagatttgcaatacgattcagcattgattgacacaacactgggtcagtcctaccaaccacgcccacttagatgtcataggggccctgctctcagggttctcctcccaaacttgcactccagtctctgtgaatggcatcgccattaagctcagttagcaaactggcaaatcattgtggcacctccctcttcttcactaacaatcatcaagttctgtttacttcccctcgtgaatacatcctgatccacttatttttttcatccctaccccaacgcacctagtacaggcttccatcattttccacttccattcctgtagctgcccctacctgagctctccatatttgtttctgctgtttcaatccatgttgcactgtcagctctcatggggtcctgttccctcctgcactggctttcctgaaaaaccctctgtggcccccactgtcctcaggcctgcaaggccctgccctctctccggctttgccatgcactatcttctccttcatgctctgtattccatttctctttcatttcctcaaagcactgcttccttcctgccacaggggctctgcatgggctgtgccctctgtctgatgcacctcaccctccttccctgctcctcttccttggatctctgcccaaatgccaattccttatggaaaacttcaccacctcacaccttagactaggtcaggaccctcaggccttaagctgcatgaaggcagggccatgtctgggtttggtccaccatgatatacctagagcctgcacatatccacatagtaggagccagacttttgtttctgtttttgtttttgtttttgtttttgagacaaggtctcgctctgtgcccagtgcagtggcacaatcaggtctcaccacagcctcaacctcctggactcaagcgagccttctgcatcagcctctgaagtagctgggaatacatgtatgtgccaccacgcccagctaattttttttattttttattttagtagagaggaagtctcactgtgttgcccaggcaggtctcaaactcctggcctcagcaatcctgcctcagcctcgagatttttttgaacgaatggatgacttaaaagcttttctcctgattcgaatataaatttctatcccatccttaatgagttccctcatggaatatcaaaaaggaaaccagctatgctccctccaggttcaagacactggttttactataaggaagtaggagcagactcaagagccaaaggattgtgccacaggaaggataacaagtgttggtgttggcaccatctttttgctcaaagggataacatcaaagagccatgagggctggtgggataagaacattttataaacaactccttttttattattatttgtagaaacagggtctcactatgttgcccaggctgatctcaaactcctgggctcaagctatcctcctgcctcagccttccaaaatgctgggattacaggcatgggccaccatgtctggtcaacttctggcagcatggccaaagtagacctcgtcaacccatgtgttctgtcctcattgctccaggagaatatttggcaacatgagtccttatcattgggagatttgaggctatctgtgtcttctgcacatccactacggagcacactgttctctttgtggttcagcatcccttatcacaggttcacaggttcaagagcaattgggctagaaagaatctttcctgacaaaattttttcagagacccaacttccttttctcaatgagaattatgttatccagtgtgttttccttttttccatggcttcaaggaagcttaacaccaaacttaatattaaattatcaaatatattactataggattttgaaatatgtggggtacgttgcctcttctctgctttttttatatcgtctacctccatttacatacattttattaatgtctgacatttcacaatatgcaggatataactcataaattatacattttaagtgtagttggccttgtgcttaagaagctatgggtcttagatgagctaaacctataatagcattttctgattcccccaaaactttctggattaagtggtttcttgtcagatttgtggatatggattaaagtgttttgtcttttttttttttttttttaattctagagacagggtactgctttgttgcccaggctggagtacagtgggatgatcatagctcactacagcctccagttcctgggctcaagtgagtctactgcctcagcttcctgagtagctgaggctacaggcgtgcaccaccacacccagctaatttttgcatattttgtagatacaggatctcactatgttgcccaggctggtctggaactcctggcctcaagcggtcctcccgccttagcctcccaaagtgctgggattacaggcatgagacatcatgccccatcctggattgcctgcaggcttgatgggaaatcagcaatttgtggctttgaaatctttttatttggcatcctcttcccatgtgaccagaaagagaaatggctggtaatggagacctacctagaagaaacaagatagtaactagaggaactgaaagagagatcagtcttaggaaggaggtgggggattctttgcatgtagagaaggttgtagaacggcaaatgcgcagtgatggggaagacatttggggatgatcctgtctgaataccttaatcttctaaattcatagggttcaaggttgcttggataataggaaggagatggcttaaatgttgaaattttgatgtgccagtggatgacacccttgttcctgatctgactttgaaagccaattcagagacagatgcagacttcaggaggatagagaaaaaaaaatcagttttattagtaataaaagttgtactggagggtgtggcttcgttcttgcctactactcacccagaattaggaatacccacttagccacaggcagcaccagccaccacaggcctcgcttcccacaggcagagtttagcctgcgcgctaagcctaccagaagaccaagacagagagacaagcatgcagtatcctggtccccaatctccaaccaaatgagccgtcctcctccaaaataaataaaggcctggaatgaggtcagagcattactaatgaaaagtccacatacatagaaagaaaaactaggcatgggcaaagtgtacctctccaacaatcaacatcactgacttaaagccagtaggaaggattcaagtcaagtgagttcacttttagggggaatatggcaggaaaggagataaccaggattgcttggcaggaataacgaagatgcaagttaaattagataacatggctttgtactgggccaggtcagtgtggttcccatgaccttcatcggtgacaccgtacagccgaaaggcagggatacagaaagacaactgtacatacagcatggatgctgaaggaggccatgcgcccaaaaaccagtctgtggagagacctcaaagatgctagtgtttgcaaatggcagcataaacatacgacattgcctccaggcaccaaatatccttgcttagtcctggagtcctggtagcaataggttgggggttagggattggcactaacgtgttgcaagtaagggagaaagaacataggttattaatgagggcttcacttcgtggccaaccacagaatctggcctgaatagaaaacagaacataaccagaaaaggctaatgattagatgacttgaattctataaacccaggaagtctggggtatgtttaaatgaggcagcatacagctagaatcccagaaagcttaatgttcttttagtaactattcagtatactgtttattacagagaatgaaaaagccagaagaaagacatgagtcttggccgggagcagtggctcacacctgtaatcctagcactttgggaggccgaggtgggcggatcacttgaggtcaggagttcaagaccaacctggtcaacatggtgcaaccccttttctactaaaaatgcaaaaattagccaggtgtggcagcgaaaggcctgtaatcccagcactttgggaggccaaggtggatcacttgaggtcaggcgttcaagaccaacctggtcaacatggtgaaaccccgtttctactaaaaatacaaaaattagccaggcatggtggcgaaagcctgtaatcccagcactttgggaggccgaggtgggcagatcacttgaggtcaggagttcaagaccaacctgaccaatatggtgaaatcctgtctctactaaaaatacaaaaattagctgggagtggtggtaagcatctgtaatcccagccactcgggaggctgaggcaggagaatctcttgaacccgagaggcgaaggttgcactgagccgagatagtgccactgattgcactccagcctgcgtgacagagactccctctcaaaaacaaacaaaaaaaagaaagacgtgagtcttgttcttttatgattagtcttcatttagtctttcacacataaaaactctgtaagtaagcacaacaaggttctatcctggtgttcttcctataactactaaatgtaaaaggcagccctgtatgaagaagtggatggaaattaaaatagctggatgtaaaatttagagtggataagacaactttatgatcagtagttctggaattaaattatagggtaggaatagttttagaactcaagtatagaataccatgggatcttgaaacaggggtttcttcaagtatgaactggacctagctccactaacatcatgtctttatgttaacatttaactctatcattaaggaaatgttcccatataatttatgagattccttgcaggtgaagggcaactgtttcccatgaaaagataactgcatataaaacaagttttaggctgggcacagtggctcacgcctgtaatctcagcactttgggaggccaaggtgggctgattgcttggggccaggagttcgagatcagcttggccaacatggcaaaactccatctctactaaaattacaaaattagccgggtgtagtggcacatgccagtaatcccagctactgaggcacgagaatcacttgaaccggagaggcggagtttgcagtgagccaagattgcacccctgcactccagcctgggcaacagagtgagactctgtctcaaaaatttaaaaaggccaggtgtggtggttcatccctgtaatccagcactttgggtgctgaggcaggtggatcacctgaggtcaggagttagagagcagcctgaccaacatggtgaaaccccgtctctactaaatacaaaaaattagctgggcatggtggcgcatgcctgtaatcccagctacttgggaggctgaggcaggagaattgtttgaacccaggaggcataggttgcagtgaaccgagactgcaccattgcactccagcctgggcaacaaaagtgaaagtctgtctcaaaaataaaatgaaaaataaaataaatttaaaatttaaaaggccaagtgtggtggctcatgcctgtaatcccagcactttgggaggccgaggcgggcagatcacctgaggtcaggggttcgagaccagcctgaccaacatggtgaaaccccatctgtactaaaaattcaaaaattgccaggcgtggtggcacatgcctgaaatcccagctgtttgggaggctgaggcaggagagttgcttgaactcgagaggcagaggttgcagtgagccgaggtcgcaccactgcactccagcctgggcgatagagcgaaactccatctcaaaaataaaataaaataataaataaataaacaaataaataaaattaaataaaacaggttttaacaactggcttactacagaactccagatgtttcagtccttcctaggaaagacacacagggactcttaccacaaggacatgagtttggaccttatgtttaatagacaagagtctatgcaaagtccaataaagttatgccatacataggtattctcttggaagttaatgcaaaagttccacaaattcaggtattgccatacctattatttgaatgaaacagaacacattatgtacaaccccttaacaaaaagtatgttttcatttaaccaccttcaggcttagtggcatcatgttcaaaatcaaatatccttaataatagatataccccaatatagagaagatttgcaatgatattcacacagccatgtcctttgacacttgtgtagcatttacagttcacagagcacacagtttcatttaattcatttaatttagttgctgtcatgctgcaactgttgttaatgtttgataaatcactccccagggacagaagtacaataaagaggggctggtggagtagcttcatcccgaatgccaatgtggatgggcacatctcaaagggaacactgacactggccatatgttaatcagaaacagcttttgttttttctcaaaaccaaattaaacaaaaagagtcatgacatgtaatatcagttgttaatctggtacaatcttttactctattttatttatgtattttgagacagagtcttgctctgtcgctcaggctggagtgcagtggcatgatctcggctcactgcaacctccgcctcccgggttcaagcaacctttgtcctgcctcagcctcccgagtagctgggactacagacgcacgccaccatgtccggctaatttttgtagttttagtagagacgggggtttcaccatgttggtcaggctggtctcgaactcctgacctcaggtgatctgcccaccttggcctcccaaagtgctaggattacaggcgtgaaccaccacaaccggccaactttcttaatttaaaaaacaagttttgtgtgtgtgtgtgtgtgtgtgtgtgtgtgtacgccaggttttgagactgattagggcattcaggtgtatccttttaacagaaaagcccaaagatttaatctgtgagtcaaaagatgaatatgggcgtggaggatcacagctattattaatcatgactgattaagcacatgcggttctgggctcctcgtgactttagtagcagtacacatgatgcagttaaggacagagcaaatattgtaataaatcaagtgcagcttaaatttctattcaaagtcaggagaatgattaattggggcccagacagtttatagatttcatttgtttatagtttcctttgatacaaaaggatggagagtggccctcaggaattgctcttaggcctgccagttaagaaatcatgtatttggtggttagaaaaatggcctcattaatgaccttttcaaaagtattcataagtggaatttttttctgtgaagtcagtgctaccataatgtgaaaaataaaaacctagtggagctatttatagcatctacaagtaaatccaaacccagaaatagttacagaagccacaaacttcaattagagggaaaggaagataatcaacctgatcagaaatcagtgtcaccatgtgtaagaaagcacactttgcatcacaaaagtaccactattcaaagaaatcatttattagtgctgaatacttgttatactaaaaacatagttataagttatttcactatgtgatttgaaatatttgagggtattggcatattttgtaaagtgaatattattttgaaaaatttcgcaaaccctataataaataacacagccatgataatctaattaaatcatgcctaaagccaggatagtaacgtacgtttacatgcaatggctgaggtccctgacatcaccaagacagctttcatttatctagttcttccacaaacatcagaggtagctgaaagctctaggacaggttttctcacagctggggtcatcaaatgccttggcatttggggttctcaagttctaagattattttattttttaattttgatgatgacggcatgtttgcaaagggtccttgaggaaatgtggggatgaagaacaagatgagacaggatgggaagatgagggcagattctcaagagctttgaatgtatatgagtaacagaaatctctatagggtgttaagattaagggctgccatggatggaaggaaagagttaaagctacattttcatagcactttacatagtatgaggaagtgtcaatgtccaaattgtagaatagggttgccaatggagattataaggttttcctttaatacactctttggtttgttcattgcattcaacactgcaatgaaattgtgtttttatcttaagtgtgatgggaagctgctattgttttaaagcaaagattgacgtgcttgtgtttctgtgctatctttttggagtgagaagacattggaggcaaagaggctgttccttataactaacattttttgctttatcagcttggggtacaacatgaggtcatatatcttttttctttttctcttcttttcttttttttttttttaagacggagtctcgctctgtcacccaggctggagggcaatggcatgatctcggctcactgcagcctccgcctcccaggttcaagcaattctcctgcctcagcccccaagtggctgggattacaggcgcatgccaccgtgcccagctaatttattatttttattttttagtagagatggggttttgccacgttgttcagactggtctggaactcctgacctcaggtgatccacctgcctctgcctcccaaagtgctgggattacaggcgtgagccaccgtgcccagccaaggttatatatcttttaatattaaatgaaattattctttgacctcatctcatctgcttataatctcatctgtttattccaagagtacctttttccctttctattgtcccatagccccacccccaccccctgcctcaagtcaggtgcaggaaatccagtggtctggtgaagtccctacccactgcatcaaaattcaagagggtgaagtcaatcgttgctctttgctttgatttgagccccagctttctggttggaggatagaaaacggaaactctgaggaactggagatatcagggagatagtgagagggggaacttggaaaagtaatgccataaagttatgaactccagagctcacctgcagactgtgtctgtcaggggtggaggagtctgctccttattcacataccaaaggcattgaatggggtgacatgaacaaaagcaggtagagtaaggaactctggaattctgccccaccataaaagcaacaacaaagttggcaaaaactgtcagagtctatatcttgtggcactctggaaattaagcaatggcttattaagcaacctagggcattcttatttaaacaaaatggctggatcttgataagaaaagtgagctttgtgacattttaacttagccctgtcctatcctctgctctccagttgagtagtcaccttgaaaacaacaacctgcattcctagtaccagtaggagcagaaagaatctcatatgcaaagaattataattacttgttttgtaattacagggcagctccttgaaagcctagctgaaaggttcgtctgtatttcacctgagttggaacaggcccagtactaaagcttctagttagaaggggtggaggaagggttgtcaaaaacatttacaggcaaagggtttagtgcttgctccctgaggtgacggatgacagctggggcaaacaatagactaaccaaaaaactagggagaaaaactgatgtccataagagctttgaaaagctctaacacattcctgggaatttagaaagctatgtgcatgcatagggctgtgtgtatactcaggaagacctgagaaggctataagctcatttctggctgacttgatcttgaggctctgtgcaagcaggaagtgaaagctaaagcaaagatgtaaactgcctgagtgttgaagatgtgcccctatatacacatacagcttctcagaaaagactagaagattttgttgtttttgttccacacatttaaggaaatctctaagtattaactgaccactaagctaataaaatacaaacttcagtggccacacaacataaagaatatagactttacaatattatttcagaaaaatcactaagcaaacaacaactacaaaaatcactaaacaaacaacaaacaacaactacactaaacaaacaacaactacactaagcaataacaacaagcctgagaggggagagaatctgatttctagaattgccacattataatactcaacatgtccacttttaaataaaaatgacaaaacatgcaaagaaataagaaactatggtccacacacaggaaaaaggacaatcttaaaaaccatcccttaggaatcctggatattagatgttttagcaaagagtttaactcaactattttagctattttaaatatatttaaagacctaaaggaaatcatctctaaagaactaaaggaaagtatgagaaggatttttcaccaaataagggactatcaataaagaggtggaaattatatcaagtagtagacgaggtctcaaaaaaaaagaggtagaaattatatatatttttaaaaaaataggtcaggcacagtgactcatgcctgtaatcccagagctttgggagaccaaggagggaggattgcttgaagccaggagttcaagaccagcctgggcaacagagcaagacaccatctacataaaatcatttttaaaactggacaggcatggtggtgcatatcatggcaactggcagagcatggtggtgccggtagtcctagctacttgggaggctgaggtgggaggattgcttgagcccaggaattcaaggctgcagtgagctgtgatcttgccactgcattccagcctggacaatagagcaagacagtgtcaaaaaaaaaaaagaaaaaaaaaaagaaaaagaaagaaatgaaggaagggaaggaaattctgacattggaaagtacaataactgaaatgaaaaattcactctagaggcccaatagcacatttgagcaggtagattaaagaatcagcaaactggaagataaatcagttaaaaattacccagtctaaggaacagggggaggaaatgaagagaaattgaacagtctgaaacctgtagaacaccatccagcagaacaacataggcatcatgagagttatagaaagagagaagggaaactggcagaaacaatatttaaagaaataatggccaaaattttacaaatttaatgaaagatacgaatctacatatccaagaagctcaatgaactccaagtaggataaactcaaggagatccataccaattaacgttatagtcaaactgttaaaagccaaaggaaaagaatcttgaaagcagcaagagagaagcaactcatcacatggaaaggatgcttaattagattaaaaaagctgacctctcatcagaagccaggaagaccagaagaccttgggatgacatagtcaatgtgctgaaagcaaaacaatgtccactaaaaattatatatgcagcaaaactatcctttaaaaatgaaggataatttaagatattcccagataaccaagaactgagagaattcattactagcaaacctactatgagggatactaaagatagtttttcaggcagaaatgaaaagacataagacaataacctaagatccacatgaagaaataaagaggaccagtaaatttaactacataggtaaatataaaaggcattataaatgtattttttgtttgtaactactttttattttctacatgatttacaagacaaccacataaagcaatcattacaaatctatgttgatgggtacacaatgtacaaagttgtaatttgtgataataacagaataacatggggggaggatggagctttataagagtaaactttgtgtatattattgaaaataattggtgttaggccagatgcaagggctcacacctctaatcccagcactttgggaggcgaaggcaggtggatcacctgaggtcgagagttcaagaccagcctggccaacatagtgaaaccccatctctattgaaaatacaaaaattagcctgtgtggtggcacatgcctgtaatcccagctactcaggaggctgaggcacgagaatcacttgaacctaggaggcagaggttgcagtgagctgagatcttgccactgctcttcagcctgggcaacagagtgacactccatctcaaaaaaaaaaaaaaaagtaattggcattaaattaaagtagactgttataaattaagatgttactgataatccccagggcaagcactaagaaaataactgaaaaacatatgataaaagaaagaacaagagccaggtgtggtagtgcatgcctgtagtcccagccactcaagaggttaaggcaggaagatcacttaagcccaggggttcaaggccagcctaggaaacatagcagggccccatatcttaaaaaagaaaagaaatactaagtgaattaaaatgatacactagaaaatacctatttaacacagaagaaagcagtaatgatggagttgagggacaaaaaaaaagacataacatatagaaaataaatagcagtatggcagaggtaagttcttccttaccagtaattatattaaatgtaaatagataaagctctctaagacagagactagcacaatgaatatttaaaatatggtgtaattacatgctatctgcagagactcacttcagattcaaagatttttaaagttttaaagtaaaaggatggataaagacatttcatgcaaacagtaataaaaaaatagttggagtggctacacctatcaggtaaaatagactctaagacaaatattgttactagagacaaagaaggacatgatagacatgatataatgattaaaaaggtaactatatcaaaaagatataacaattataaacatatatgcacccaatagcagagcctcataagatatgaagcaaaaactgacagaattgaagggagaagcagatagttctcaaataatagttgtaggctctaatattcaactttcactaatattagaactagacagaagttcattaagaaaatagaagccttagccaatactatatgccaactcaaggtaacagacatcagtagaacactcaatgacagcaaaatatatattcattttataagcatatggaacattttccaagatacatcatctgttaggccataaaacaagtctcaataagttttaaaaagatttaagttaaacaaagtgtattctcaggccacaacaaaataaaatgataaattaataacaaatgaaaatttggaaaatttacaaatatgtgacaattaaacaatacactcttaaataatcaatagatcaaagaagaaatcacaagagaaattagaaaatacttcaaggcgaacaaaatgaaaacacaatataccaaaatttatgggatacagtaaaagcagtattcagaaggatatttataactataaagacccacatgtaaaaagaagaaagatctcaaagacagtaagaactgaagtaatgaccagactgctaccaaggtcccagactgactactgggctgcacgcacataggtcagatctcaatagcactacaaagactttgaaaactgaactggcattggaatcacagtccacagaaagcatgtcagaacttgcagcctgaaactaaccaggttgatcacctgctaaaacaaaacaaatcaacattctccatgaaaattaaacaagattcagagtcatgtggtataatattcaaaatgtcaggctacaatccaaaatcatttggagtatgcagaatatagaaaatctcaactcacctggggaaaaaagacaatcagtaaatgtcaatgtcaagataacacagatgttgaaattatctgacaaaggctttaaagcagctattaggaaaatgctttaacaaaattgcaaaggctctggaaactaatagaaaactagaaagtctcagagaaagaatagaagatattaagaaaattcaaagaaaattttaccaaaaaataaagtaagtgcaatgaaaaattcattggataggctcaatagcaaaacagggattacagaggagagagtaaacttgaagatattacaacagaaaattactcaatttgaacaagagagtaaatgggctaaagaaaaagcccaaagcctcagagaagtgtggggcaataacaaaaggtataacatttgtattataagagtcccagaagagaaagagcatgatgcagagaaactacttgaagaaatcactgaaaacctcccaagtttgatcaaagacgtaaacccacagattaaataaatgtagagaatgctaaacaggactaactcaaatgaatccatatcaaatgaagggccacaaactaaagacagagggaaaaaaattgacagcaaagaaaaaaattgaccagagaaaaatgatacattacttactggagaacagtgatttgaatgatggcagatttctcatcagaaaccttggaggtcagaaggaagtagcactatgtttttaattttaaattttatttattttttgagccgaggtctcctgtgttgcccagactgaactcaaacacctgggctcaagcaaccctcccaccacaacctcccgagtagctgggattacaggcacaggtcaccatggcctgcattatgtttttaaagtgctgaaagaaaaaaatgatcaacccagaattacatactcaacaaaaacattcttcaaaaatgaaagtgaaaaaaaaaatcagacaaagaattcattgctagcagaccaattctaaaagaataactataggaaattcttcagacagaaggaaatgataccagaattgaacttggaacatcaaaaatgaaagaagagcatcagaaataataaatatgttgataaacataaagatgagtcttctctttctgagttctttaaagtatatttgacagtcaaaagcaaaaattgccatactgtctgatggcattttcaatatatgtggatacaatatatgacaactgcagcacaaagggctatgggaaagggacctgtatggtagtaatgttcctacattcaaattgaagtggtaaaatactgatgctatgtatactgtgaaatgttgctatctatttgtaatccctaaaacaaccactgtaaaatgtatagtaaatgctgtggtcacttcccacctcatttcctgaggccatcatcaccatgataccaaaaccagacaaagacaattgaaaaaagaaaactacagaccaatattcctcatgaacatagacacaaaaattcacaacaaaatactagcaaattgagtctagccacgatcaggtagtttatcccaggaataaaaggctaggtcaatatttgaaaacaatcaatgtaatccaccatattaatgatttaaaggaaaaaaccctatatgtttctagcaattggtgcagaaaaagcatttgatgaaattcaacatcatgatgataaaaatacattttataaaagtctctcagcaaactaagaacagaagagaacctccttaatctgacaaatggcatttacataaaatctatagctaacatggtgaaagacagactgctttctccctaaaactgggaacaaggaaggatggccactctcaccacttcaacagtgtactggaagtcttaggccatgcaataaggcaaggaaaaaaagtcttctgtcttggagagaaatacataaatacataaaaccattcctatttatagatgattatctatgtagaaaatcacataaaatctttaaaaaacaaaatgaaacaaatgaaaacgtcctagaattaataagtgaatttaacaaggctacagagtacaaagtcaacaaaaattaatcttatttctatataccatcagtgtgtaattgaacattggaatttttaaaataataccattctcacagagctccaacaaaaatgaaatacttaggtataaatctcgtaaaatacgtatgggatctatatgcagaaaactacaaagtgctgatgaaagaaatcaaagatcacttaaataaatgggaggatataccatattcatgtattggaagactcaacgtggcacagatgtcagttctccccaagtttatctgtagatttaacacaataccaatcaaaatcccagcaggatattttgtagatataggtcaactgttgttgttgttgttgttgttgttgttgttgttgttgttgctgctgctgctgttgttatagacgaagtctccctatgtttcccaggctggtctcaaactcctgagctcaagcaatcctcctacctcagtctcccgaagcactgggattgtaggcatgagccactgtgcccagctatgtcaacttattttgaaaattaaatggaaaggccaaggaactagactatgtaaaacaattttgaaaaagaagaataacattagaggaatcacactatccagttttaaggcttactgtgaagctacagtaatgaagacagtgtggtcttggtgaagggtccaacacatacataaatggaacagaataaagagtccgggagtagatctacccaaatagagataattgatttctttccccaaaggtgcaaaactaattcaacgacgaatggatcatcttttcaactaatggtgttaggacagtttgacattcttatgcaaaaaatgatctcaacacatacaaaaattaactaaaaatggatcatagatctaaacataaaacacaaaactataaaatgtttggaagaaaacataagagaaaatcttcacaacttgggaatagacaaaggattcttcaatgcaacaccaaaagcataatcatgtcaatcatatatctgacaaaagacttttatacaaaatatctaaagaactctaaaacccataatatggaaaaaatggcccaataaaaaaatgagctaaggattagactagacacaccagagaggacataaggttgttaaatatgtacataaaaagatgctcaacatcattagctatcagtgaaatgaaaattaaaaccagaatgagatatatctacacaccgaatacaagagctaaaaataaaaaaaattaaaaataacaatagccaagaaggatgctgagcaactggaatttgcatacactgctagtaggaataaaaaattgtacagccactctgaaaaatggttgggcagttgcttataaagttaaacatacatttaccctatgaatcagcaatctcggctatttaactcctaggtatttatcctacagaaatgaaaacatgttcacacaaaacctgtacatgaatgtttatagcagctcttttcatacttgccaaataatggaaacaacccaaatgtccttcaacaggtgctgtggcacatccatattagaaatatatctttgccaggcttggtggctcatgcctgtaatcccagcactttgggaggctaaggcaggtggatcacctgaggtcaggagttcgaggccagcctggccaacatggcaaaaccccgtctctactaaaaatacaaaaattagtcaggcatggtggcgggcgcctgtgatcccagctacttgggaggctgaggcaggagaatcgcttgaacctgggagacagaggttgcagtgagcggaaattgcgccactgtactctagtctgggcaacagagcaagactccgtctcaaaaaaaaaagaaaagaaaagaaaagaaatctttaagagagcatcaaccttaattaaagggaaagccaagtgaattacttggatctggaatgcttctgtattctgtaatgtgctgaaaaatatttttcactctgtgctgaaaggaaagctggattaagacttagaaagctacacaaataacttctttgctgattaatcatatctcactatgagctctatcatgcatgatggattctcttgtgtttttatgccattcaatgtgtaaatagatgtggggctcttgtcaaattgattcctagatagcctttctctgtctgaaatggaaaccactctttgtgtgggtgtcaaggtttgtgaaacatgttttaaataattatgggaagtcaccaaccatggttaacaaaggagatagatcctcatttatttgtcctttatgttaatcatttcagatgtaagtgaacttaaactcatttttatctttcttctttcatacgtactataaaactcaatgcaacttcccatcgtttggcatagctgtttaaaatttgctgtatccacgttgtagctgttcacaagctccaaacaagcaactgacaatttctctgaacccagggcacatcattaagcattgtttcttccacagcttcaatgaagggagcagcagtagggatgggagatttgagacaccaaaaaaggagcttggtaactgattcaatgcagaggggaggggagaggagagaagtgaggggagggagttagtataagggagaccaaagaatccaatgactttgaggtttgtttttcatatatgagtggctgagagtgctgttatctgaattaggtaataaaggggaaaataggtaaaactataaaagatttgaaaggaaagatattcatcttcatttcaccagtgtatttatttagaaaagtttgcacagcggcaatatctcttactgtatgtttgtaaaggaactcaagtttgactagggcaatgtggggttttttttgatacaaaaggaataatcagggtaatagaactgaacggagtagggagcctttatttatttatttatttatttatttatttatttatttattttttgagatggagtctcgctctgtcatccaggctggagtgcagtggtgcgatctcggctcactgcaacctccgcctcctgggtgcaagcaattctcgtgcctcagcctcccaagtagctgggattacaggcacacaccactgtgcccagctaagttttgtgttttcagtagagacagggtttcaccatattggccaggctggtcttgaactcctggcctcaggtgatccacccgccttggcctcccaaagtgctgggattacaggtgtgagccactgcgtgcggccaggagccattatttttaatgaagaacaccaagtcttactcagaagtaatggaaagttaatagtgaaaaattcttctgttggtctctgaaatgcaagaggagagagaacccttagaacctacagtgcctgtgatacagaggctttaaaaaaaggaagccaggacttctcatgcatggtgaatttggtcctccctggtggcaaacgtccaggaagccagacccttcctgctcaaatgatgtggtttcctatagtacatataaatagttctcaccccaagaaaagagttaagaatagaagccaaggaaccacacatacaaacacagacacatcagagcacagttgtcaatgtggtcaacagaagagtggcattagcaaaaaaaaaactctgggaggtggggcaaggtagccacagaagcagcagggtgggggtggagttcaggagatgcagtcaagcacagagctgacttagcgatgcaaacagtggcaggcaatctgctcagaagacaaaagagcggggtggctgaccaccgtgaaatggatggataagaggagagccagcagtacgagtgaggacatgtataaggatgtgcagagaaggtagcaaagaccttcgtaggtcatacagactgcaatgcaagccaagtctccctatgtttttaagaaagctgggagaaaataaaagaataatggaatcagacctaagtgtttgccatcacacagggatgaaccagccagaacacagtagccaggactcctagctccatcctggggacaaattcaacttttagaaagcaatcctcaatcctgggcataccttgcctcttagagttaaattcctattgaaataattcatactgtatgtagtaaaatataaaacaaagtctgtaccagtggattttaggccaggcaacattatggtttcataggctgttgcccgatcttctaagaactgaaaaaaaaaaaactaatagcaggcatttataatctcccatgctcttttttgtgtgtaaccttaaggaaatactaattattaaatataaagaataatttaaagtttttggtattcttcagacaattaaatcacctactatcctttaagcaaactatctgataatctgaacttaattattaacagtttattttctgaatcccttgaacctcaataaggattttaattttatttattttgttataaccattcactgctgacagccatagtcaaagctctaaaaacgaagcactagtagcttctgttattactacaggcagcatgatgtaccagctaagagacaggcaccggagtgagtgctggagctaggctgcgtgtgctcaaattcctgctccactgcttcctacctttggggaaattacttatacgctccatgacttaatttcctcacctgtaaaatggagatgataataatagacctacttccaaggactgttctgaagattaaataagcctaggattgaacctcagtaagtacctgttagtgagaacattatgctcttagaacaatgactgagcagtaagtactatatgcattaactatttatttccattattttctggtggctcctcatggtaattcgagtagtcatgttaggggattgtgaagcttgtaaatatactcaaacagttccatatgtattaaaattctgaaaaatcacatagcaatgacattatcttttgatttttaatatccacttaatctcagtttaataaatctatccctttatattcaccagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacaggacaaatcagatgttcaaaacactcagctaacagtggaaacgacaaatatagaaggcactatttcctatcccctggaagaaaccaaaattacacgctatttccccgatgaaacgatcaatgcttgtaaaacaatgaagtccagaagcttcgtctattcccggggaagaaagctggtcggtggggttaaccaggatgtagagtacagttcaatcacggaccagcaattgacgacggaatggcaatgccaagttcaaaagatcacgcgctctcatagcacagatattccttacattgtgtcggaagctgcagtgcaagctgagcaaaaagagcagtttgcagatatgcaagatgaacaccatgtcgctgaagcaattcctcgaatccctcgcttgtccctaaccattactgacagaaatgggatggaaaacttactgtctgtgaagccagatcaaactttgggattcccatctctcaggtcaaaaagtttacatggacatcctaggaatgtgaaatccattcagggaaagttagacagatctggacatgccagtagtgtaagcagcttagtaattgtgtctggaatgacagcagaagaaaaaaaggttaagaaagagaaagcttccacagaaactgaatgctagtctgttttgtttctttaatttttttttttaacagtcagaaccactaatgggtgtcatcttggccatctaaacatcatcaatttctaaaaacattttccttaaaaaattttggaaattcagacttgatttacaatttaatgcactaaaagtagtattttgttagcatatgttagtaggcttagttttttcagttgcagtagtatcaaatgaaagtgatgatactgtaacgaagataaattggctaatcagtatacaagattatacaatctctttattactgagggccaccaaatagcctaggaagtgccctcgagcactgaagtcaccattaggtcacttaagaagtaagcaactagctgggcacagtggctcatgcctgtaatcctagcactttgggaggccaaggcagaaagatagcttgagtccaggagtttgagaccagcctgggcaacatagtgataccccatctcttaaaaaaaaaaaaaaaagtaagcaactgtgtaagaaagagaaactaaagagaaagcaaacatgaaaaaagggaggggtggaaagaagaaaaataaaattatgaggcacaataagtgggaaggagccacaaatatgtttttatggggtctttgttttctgttttaatgttttattttaaactacacaatgggaaaaaaagtacacaattatatcaaacatcatactctaataatttagggtgacctagagttttgttaatgtgcaaaaataaagtatccaatatgcattttcttcttgtcatagagtccttaatagcaaatacaaattagttgtacctgtctatgcaatgctttgtacaaagctgtagctaaaacctaaaggatatatgttcacaagtcacagagactgctcttagctgagaataccaggtgttgtgcttcacctcaaagttcaaacaaatacccacaagagtaataggacccccatgcgaggcttccaagaggggcctctgtctaggaaccctgaaggccaccccaccatcaccactcttaactatacaaaaagaaacagaggtggcagaaaggggtcttctccggctagagcagaagttagagttagactctagcccctcaccatcccccaagagaacctcagggtactcagatctcaggaggtctctgatgcacagagagagggccagcctcgagttactggcagctgatacatcatgaagcaaagtgcctcatacccagaaaggaccactgggtagagtaaccaggaattggtggtggtagggttgggagatgtgtcagacagaaatgggtgatgatcacaaaaaatgagaccgccatccccattctcatctgaggtgtagattgtagcactgccagaaactggcaaaggagtacagaaagagacagaaagacagaaacacacagagggagacccagaaacagatagaggaagattgtagcctgttctacaacagaggctcattgcagttatgccaaaggtagtgatcagaggtgacaataccaaaatgtgattttgcatctttttcctcaaaatacgactgagattgtaatagtcagattagaactcttgaactgggctgaatttatcaaaaaagactgatataccattgcctgggttgtggggtagggctttaatatttcaaaagtgataacatttatttaacataaactattacttatttgcatattgctatattaagactatttaatctatcctgccacatgtgtttatttgactcaatacttaacctattacattttatctcactcctaagtctttcctttgagtgtcaaaaaactttcggccttttaccatatcctagaaaagagatttctcagaataagctggggaatctataacacctcagcagagctggtctgcagaagataaagcctgtctttggaattctccccatatcttcattacacagtctccctttaccaaggtccatcccaccgtgcctcaggtgtgggactcaagttccatttccttaagtctcactaagatctgtgactcctgtcttatgccaaggtgtcagctgatgtaggattttctaagcatgtttgtcttacggatccaaatggatgaattctaacagtgtgatttcagaacctgtgactgggctgactattcttgagacctttcttgtataccttaaatcataccatatagttgattagtactttaccaacccagcacaactcaaatattgacagtgttctatgtaggacacaatgccagaccgcttggtattacattattaatgattacattattattcccaatgtcattacaattttgtctaaatatggacaaccaaatattgagaactaatacccaatctaatcaaatctagcagtatttaatacattaaaataagaatactgcatatggtcaaatcatttaatatagaactatcagtaaatgaataagaattacatttctgtgctatgtaaaacatagtaacataagaaggcttttattattttatccccaaaactctggcatactcataaatgagttctaatatattatttggtataaattaagcttgttttggactttgatcaatggcaatcaagacttgaactatcaaaggacctcataatatgtggctctctcctttaaggctgtttgactgcttacattctgaatacatatatatgcttcatcatcatgaggttcctatagtcttccatagtttaggttttaaaatctaaaaatcaaactgtcaatgttgtcatatagttattcaacaccaaaaatgcatttttgctaaatatatattagaaataaagtgaaatgaaatcatcttactacctcctacacacaaaaaaagacttttaaaggttttatcttaagataaaaatgcagaaaatcacacaaaataaataactgacttaattaattattgtaagctgaatatccttgtaaccaccactcagattaatagagttttccagctactccaaaagtctcagaagtccctatctcaaccacctctgttccctgaaaagtaactatatttttatagtaatcctttccttgctgttccagttactatcactgtattattaatacaagtgactccaaaactgggtggcttaaaatacccatttgattatgctcatggattccgtgggtcagaaattcagacaggcgcagcaggaatgcccctgatttgcagtgtttgccgatttccatggtgtaagtactcctaccatggccaacttcaagctacggcatcactgaatatggagttaggaagacatactgacaattggttcttgcaagccagtacaggctggctatagcacactactgtctactccatgatatttggggcctcagctgggaagactcactgtctagagggaattcaacagctggaggctgggattatctagatatgtctttattcacatgtctgaaaatggataatggctctcaactgggatctcaatctcagtatagagcacatacacatgcctctccaagcagcctgggcttcctcacagcatggcagccgcagagaaactggatttcctatatgatggttcagggctccagacgtgagtgtcccattgagcaaggaggaaatatccctttttatggccaatcctcagaagtcttgcagagtcactaaggccagctcggattcgagggtaggggtcatatagaggggaatgtttaaaaaatttgcagatatgttttttgttttttttttgagacggagtctcgttttgtcgcccaggctggagtgctgtggcgcgatctccgctggctgcaagctccgccttccgggttcacaccattctcctgcctcagcctcccgagtagctgggactacaggcgcccgccactgcgcctggctaattttttgtatttttagtagagacggggtttcatttcaccgtggtctcgatctcctgacctcgtgatccacccgcctcggcctcccaaagtgctgggattagaggcgtgagccaccgcgcccggcctgcagatatgttttaaaatcactatacttgtatttcattatagttgtatcacttgaatgttccttagcactatagtttagccttactcttttttatttgaaggtcttttaaatctcttttaatctggtattacctttctctctttctcttccttaacaatttctttgttgaagaacatgggccacttgtcttgcaaagtttcccacagtctaaactttacttattgaacgctcataggcagtttgacatattctgctgtttctgcaggttggcaagaggagtcagaggcttattcaggcttaggtctgatccctttggcaagactccttagatggtgtagcttctttctaagacacaaggaggcacatgtgtctacttgtctctctttttgtgatgtcagcaactgttgatactcaatgcctagatcacttaatttatagagggttgaaaattgtaatactcaaattctattatttataaagagattattcttttcacctactacttgattacacagtggtatagttcatactacacagcagaaataatgactgattgatttttcccatttgccagttttaaaaataatgaattggttctctaccatcctccaaaggatgaaggtggtctacaggccaggcagagagccctcaccagaacctttaccttgctggtatcttggtcttacacttcccagcctctggaactgtgagaaagaaatttctgttctttaagccagagtctgtgtactttgttatagcagcatgagcacactaatacaactagacatctggaaaatgtgacatttcagtcaataacaaatctggaaatcagagtttttccaggtgactgatagtttagtttatttaaacaccattatgacttcatggatttaaatatatgtgatgtattttaatccattgtaattttttggtttttgggtttttcttttttttttttttgagccacagtctcactctgttgcccaggctggagtgcaatgtcgtgatctcagctcactccaacctctgcctcccaggttcgagtgattctcttgtctcggcctccaaagtagctgggattacaggcatgtgccaccacgcctggctaaatttttgtatttttagtagagacggggtttctccattttggccaggctggtctcgaactcctgacctcagatgatccacccacctcggcctcccaaagtgctgggattacaggcttgagcgctcggccataattattattctctcacattttctttccatgagtaccttaaatatgttactccattttcttctggcataatgcattgctgccaaaacgtctggtaatatctaattttctttcatctgaaagtcacttgctttttttgtctaaatatccaaagaaattttcattgttgtttcttcaaggcccagtaggtttagaagaatgtgtcttagtgctggtaagcccagatcaatgttctcaggtgcaatgtgttctttcaatatgcagtttcaaatattttcttttaatttcaggtaagttttcttaaactacagtttgtagtatttgttctgtttccttatctcctccctctttttgtttcccccaggaactcctattatctatttgttagttctcctttgcctgttttcaatatctagactttctttctaatctgtttaacttccttcattgatttttgattttttagaatttttctccttttcatcttctcttaaagaataatcaattgtgtttattcatccttgggtttcttttattcttaatttcagattctgatttctgattctattttgaatttattcatttcattttgaatgtttctagttctgatttacatagttcttttcatgtttcatatcattttcttagtatcttttggctcattgtgaaatagtggatgttagtttttatctgttttgtgggcatcctttctggtatgcttttattgtggatatgagtgctattctgttcttattgtctttcattacaataattttctatgtgatttgacttccatactttcatgtgattatttttatgtgaaattggttttcttgaactttttgaaggaggcagttttaaggatagtttttcttttttctttttttttttttcttttttttttttttgtggtggagtcttgctctgtcgcccaggctggagtgcagtggcactatctcggctcactgtaagctccgcctcccgggttcacgccattctcctgcctcagcctcccgagtagctgggactacaggcgcccaccaccatgcctggctaattttttgtatttttagtagagatggggattcaccgtgttagccaggatggtcttgatctcctgacttcgtgatcagcctgcctcggcctcccaaagtgctgggattacaggcgtgagccaccgtgcccagcctagtttttctaacttcatagagaacttccgtttttactgcttagtgttgtgggtttcgttcttttttatttgaaaagttggcttacttttggagatttcctagttttccatttttacctagaacttctttttcctttctctctattgtctctatttagctcaattttgtttccatgcccaacagtttgccagcagtgtaggtctctttcctgcaaggaagcctagtagattagtttcaagagttcctgcagctacattactccagcccctccagactttaccaggaggctcgtgcattctcacgtttttagagaaggcaaataccctttcctgtttctgctgctgttctcaacttgactggctggaccttccagggaacactttgcagctattttggggttctccagatgcctcattgattctctatgctgataccacaagggtcttattacttattattgccatattattgctattggtttgttcccacgcatttatatttttgagatcaaggggataccatttcatttggatttgttatagatgttgtccttgggttttggttttgccatatagttgctttgtctgtttttatgcagagattgaaaaagtatgctgctgttgtcatctttccacaattctccctcaagaaacagatgtcttaaattacttagtagtcatcttaaaagaccacatactcaagccatggcctcgttttgcaaacattatgtataaccacttctaactacttcccctgctaccaccatcaccttctcttatctggactgttataacaggccccaactggtcttccaaaggccaccctgctgcacactacagcagtcaaaatgattattttaaaacacaagtcagatcatagcactcttacctcaaaaccttataaaatcttctcaatttttggggcctctgtgatctggcctgtgtttccctctgccctcctccctgactgcattaggctgctttagccacactggcctcaaacacccctcgaaggcgctcacctcaaggcatttgcacagctaatcttctctgtcccaaatgctcttcctcctcatgtgtacttggccttttcccttactccttttgtctctgctcaaatgtcctatactcagaaagtccttccctgaccatatccaactccccactgaaaaatggaaccacctttctctcactatgttttatttttcttcacagcactcattaccacctgacatgctatatattaattttttatctttctaccgagaatgaaaatgccatgaaagtagaaactttgtcttagtgtccggaatagtgcttggcacaatgttagtactcaatacaaattcatgagttcactgaatgagtgctgaatgaatatataaagttcctagcacctgatcagtattcaagaaatgttagctttattttttcttgatagggaaaaggaagtgatctttagagaatgctaccattcccaatgatagaagatccaataatggaaacagaggtgtagtcagaaaaatgggtgatgggaggccgagtccagcagttcacctgaggtaaggagtttgagaccagcctggccaacatggtgaaaccccgtctctactaaaaaaacgcaaaaattagccaggcgtggtggtggacacctgtaatcgcagctacttgggaggctgaggcaggagactcacttgaacccgggaggcggaggttgcaatgagccgtgattgcgccactgcagtccagcctgggtgacagagcaagactccgcctcaaaaaaaccaaaacaaaacaaacaacaaacaaaaacagaaaaatgggtgaagcaggacaaaacagtgacattagagccaaaagcagggggtaggcaataacaccaaacatacagcgtagtcaagggcatcagggtctgagaagaggttataaaactagttctacggactgaattgtgttcctccaaaatgctaatgttgaaaccctaacccctggtatggctacatttggagattttaggaggtaattaaagttaaataaggtagtaagagtggggctctaatctgataggattagcgtccttacaagaagagacatcaagagatcccagagagcatgttatataccctccccgcactgtgtgaggacatggtgagatggcagccatctgcaaatccggcagagagccctcacctgtctgcctgccacaagttaggcagatccctaccttgccaacacctggatcttggacttcctatactccagaattgtgagaaattaatgtctgctctttaagccatcaacctgtggtattttgttatggcagcctgagcagactaatacaaccagatatctgggaaatgccataaaatttagtgttaagacaataataaatctggaaatagagtttttccacttttcagttgtatggtcacatattagaattgcagatcctaagaaaacctgtacagaaaaacccaaatcacagagtcatttaagtgtaaagaaaaagccaattattgcttaaagagtatttgtagaaaatatccgttgaatatagaggaataacagcatattcataaaaattttttaaaaagtgtgcacgacagtgattttaacacttctaatccaatggaactaacattttaaagtacaattatggccaggcacggtgcctcatgcccatagtcccggctacttgagaggctaaggcacgtggatcacttgagcccaggaggtggaggcagcagtgagccctgatcatgccactgcacttcagcccaggtgatggtgtgagaccctgactctaaaaaatacaattatggttacggttcttgggcagagtggaattcaaacaggttaacctgaaagatcagtagggttctaaatccaggataaattattttcagaaaaagaataactttttgaatctttatttaaattgttaaatgttcctgtgagtaacactcatcagcgtgattgtgactggtatggctgcatggaagcttccctgtggcattaatcataaaatgctggattggggtttgattcttcaaggtataagaaggacctagtctcaagtaatagattcaccaaaatgtaacaccactagccccctcccaccaaaatctgctccagtcagaattaccgtaagagctcagaagtgacctgtgcttggcggcaccggcccactttcccagtgccggttcctcgcatcctgggcgcagacggggtgaccgcctgacccctggacccgagtcacctttccctgccctgagctcctccttgagagcttcaaaacaatgctcgcccaggccggagggcgaagtcggcccatgtgtaagtcaagggaactgtcccaggactgcagcccggccagaagacgccccgcgccgccgtcccaggcagccaccgctgccgccgtggcccccgcaggccgccgtaggcccccgcgggccgcctgacccctgcgggccgccgtagaaggaccctccagaggccgcgctcttgagatggccgtcgggctccgctccccgcggcgccccggctgagggcccgccagcgggcacctggcgccaccgctgcgttccggcactagcacgggacacggtcagggagcggcgggccgcggccttgcgcgcgccgtctctcggggcggggcaccgggccccttccggggatgggccccggcgcccgcgtcggcctggctgtgcccggcccctccccgctcgggcgggcgctgcgccgtatccccgcccgtcagtccgcccggctcggctggccgcagaaagggcctgggcggccgcactgagagctttacgcccggaggcgtcggcgctgccactggcccgcgacgggaacggggcgaaaaggcggcggcaccatgttctccctcaagccgcccaaacccaccttcaggtcctacctcctgccaccgccccaggtaaacaacccctccccgcgagcgcccgactctcctctgcgcttccgtggagcctccaggccgacccccgggaactggaggaccccaggaggctgcgcgcgtctccctgccca

SEQ ID NO: 161 - DNA, 5371 bp, Homo sapiens
ctctcttccagggtcagaaatcttggatagagaaaaccttttgcaaacgggaatgtatctttgtaattcctagcacgaaagactctaacaggtgttgctgtggccagttcaccaaccagcatatcccccctctgccaagtgcaacacccagcaaaaatgaagaggaaaacaaacaggtggagactcagcctgagaaatggtctgttgccaagcacacccagagctacccaacagattcctatggagttcttgaattccagggtggcggatattccaataaagccatgtatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacaggtgttatcagccacgtaggggatgccttgaaagaccactcctccaagtccagaggccgggtttgtgctataggaattgctccatggggcatcgtggagaataaggaagacctggttggaaaggatgtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctgcagaagatcaacacaagactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaagtactgtgaagaaggcggaataataaatgagtccctcagggagcagcttctagttaccattcagaaaacatttaattataataaggcacaatcacatcagctgtttgcaattataatggagtgcatgaagaagaaagaactcgtcactgtgttcagaatgggttctgagggccagcaggacatcgagatggcaattttaactgccctgctgaaaggaacaaacgtatctgctccagatcagctgagcttggcactggcttggaaccgcgtggacatagcacgaagccagatctttgtctttgggccccactggccgcccctgggaagcctggcacccccgacggacagcaaagccacggagaaggagaagaagccacccatggccaccaccaagggaggaagaggaaaagggaaaggcaagaagaaagggaaagtgaaagaggaagtggaggaagaaactgacccccggaagatagagctgctgaactgggtgaatgctttggagcaagcgatgctagatgctttagtcttagatcgtgtcgactttgtgaagctcctgattgaaaacggagtgaacatgcaacactttctgaccattccgaggctggaggagctttataacacaagactgggtccaccaaacacacttcatctgctggtgagggatgtgaaaaagagcaaccttccgcctgattaccacatcagcctcatagacatcgggctcgtgctggagtacctcatgggaggagcctaccgctgcaactacactcggaaaaactttcggaccctttacaacaacttgtttggaccaaagaggcctaaagctcttaaacttctgggaatggaagatgatgagcctccagctaaagggaagaaaaagaaaaagaagaaaaaggaggaagagatcgacattgatgtggacgaccctgccgtgagtcggttccagtatcccttccacgagctgatggtgtgggcagtgctgatgaaacgccagaaaatggcagtgttcctctggcagcgaggggaagagagcatggccaaggccctggtggcctgcaagctctacaaggccatggcccacgagtcctccgagagtgatctggtggatgacatctcccaggacttggataacaattccaaagacttcggccagcttgctttggagttattagaccagtcctataagcatgacgagcagatcgctatgaaactcctgacctacgagctgaaaaactggagcaactcgacctgcctcaaactggccgtggcagccaaacaccgggacttcattgctcacacctgcagccagatgctgctgaccgatatgtggatgggaagactgcggatgcggaagaaccccggcctgaaggttatcatggggattcttctaccccccaccatcttgtttttggaatttcgcacatacgatgatttctcgtatcaaacatccaaggaaaacgaggatggcaaagaaaaagaagaggaaaatacggatgcaaatgcagatgctggctcaagaaagggggatgaggagaacgagcacaaaaaacagagaagtattcccatcggaacaaagatctgtgaattctataatgcgcccattgtcaagttctggttttacacaatatcatacttgggctacctgctgctgtttaactacgtcatcctggtgcggatggatggctggccgtccctccaggagtggatcgtcatctcctacatcgtgagcctggcgttagagaagatacgagagatcctcatgtcagaaccaggcaaactcagccagaaaatcaaagtttggcttcaggagtactggaacatcacagatctcgtggccatttccacattcatgattggagcaattcttcgcctacagaaccagccctacatgggctatggccgggtgatctactgtgtggatatcatcttctggtacatccgtgtcctggacatctttggtgtcaacaagtatctggggccatacgtgatgatgattggaaagatgatgatcgacatgctgtactttgtggtcatcatgctggtcgtgctcatgagtttcggagtagcccgtcaagccattctgcatccagaggagaagccctcttggaaactggcccgaaacatcttctacatgccctactggatgatctatggagaggtgtttgcagaccagatagaccgtaagagtagaattcatactccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacaggacaaatcagatgttcaaaacactcagctaacagtggaaacgacaaatatagaaggcactatttcctatcccctggaagaaaccaaaattacacgctatttccccgatgaaacgatcaatgcttgtaaaacaatgaagtccagaagcttcgtctattcccggggaagaaagctggtcggtggggttaaccaggatgtagagtacagttcaatcacggaccagcaattgacgacggaatggcaatgccaagttcaaaagatcacgcgctctcatagcacagatattccttacattgtgtcggaagctgcagtgcaagctgagcaaaaagagcagtttgcagatatgcaagatgaacaccatgtcgctgaagcaattcctcgaatccctcgcttgtccctaaccattactgacagaaatgggatggaaaacttactgtctgtgaagccagatcaaactttgggattcccatctctcaggtcaaaaagtttacatggacatcctaggaatgtgaaatccattcagggaaagttagacagatctggacatgccagtagtgtaagcagcttagtaattgtgtctggaatgacagcagaagaaaaaaaggttaagaaagagaaagcttccacagaaactgaatgctagtctgttttgtttctttaatttttttttttaacagtcagaaccactaatgggtgtcatcttggccatctaaacatcatcaatttctaaaaacattttccttaaaaaattttggaaattcagacttgatttacaatttaatgcactaaaagtagtattttgttagcatatgttagtaggcttagttttttcagttgcagtagtatcaaatgaaagtgatgatactgtaacgaagataaattggctaatcagtatacaagattatacaatctctttattactgagggccaccaaatagcctaggaagtgccctcgagcactgaagtcaccattaggtcacttaagaagtaagcaactagctgggcacagtggctcatgcctgtaatcctagcactttgggaggccaaggcagaaagatagcttgagtccaggagtttgagaccagcctgggcaacatagtgataccccatctcttaaaaaaaaaaaaaaaa

SEQ ID NO: 162 - protein, 1626 aa, Homo sapiens
LFQGQKSWIEKTFCKRECIFVIPSTKDSNRCCCGQFTNQHIPPLPSATPSKNEEENKQVETQPEKWSVAKHTQSYPTDSYGVLEFQGGGYSNKAMYIRVSYDTKPDSLLHLMVKDWQLELPKLLISVHGGLQNFEMQPKLKQVFGKGLIKAAMTTGAWIFTGGVSTGVISHVGDALKDHSSKSRGRVCAIGIAPWGIVENKEDLVGKDVTRVYQTMSNPLSKLSVLNNSHTHFILADNGTLGKYGAEVKLRRLLEKHISLQKINTRLGQGVPLVGLVVEGGPNVVSIVLEYLQEEPPIPVVICDGSGRASDILSFAHKYCEEGGIINESLREQLLVTIQKTFNYNKAQSHQLFAIIMECMKKKELVTVFRMGSEGQQDIEMAILTALLKGTNVSAPDQLSLALAWNRVDIARSQIFVFGPHWPPLGSLAPPTDSKATEKEKKPPMATTKGGRGKGKGKKKGKVKEEVEEETDPRKIELLNWVNALEQAMLDALVLDRVDFVKLLIENGVNMQHFLTIPRLEELYNTRLGPPNTLHLLVRDVKKSNLPPDYHISLIDIGLVLEYLMGGAYRCNYTRKNFRTLYNNLFGPKRPKALKLLGMEDDEPPAKGKKKKKKKKEEEIDIDVDDPAVSRFQYPFHELMVWAVLMKRQKMAVFLWQRGEESMAKALVACKLYKAMAHESSESDLVDDISQDLDNNSKDFGQLALELLDQSYKHDEQIAMKLLTYELKNWSNSTCLKLAVAAKHRDFIAHTCSQMLLTDMWMGRLRMRKNPGLKVIMGILLPPTILFLEFRTYDDFSYQTSKENEDGKEKEEENTDANADAGSRKGDEENEHKKQRSIPIGTKICEFYNAPIVKFWFYTISYLGYLLLFNYVILVRMDGWPSLQEWIVISYIVSLALEKIREILMSEPGKLSQKIKVWLQEYWNITDLVAISTFMIGAILRLQNQPYMGYGRVIYCVDIIFWYIRVLDIFGVNKYLGPYVMMIGKMMIDMLYFVVIMLVVLMSFGVARQAILHPEEKPSWKLARNIFYMPYWMIYGEVFADQIDRKSRIHTPCGENLYDEEGKRLPPCIPGAWLTPALMACYLLVANILLVNLLIAVFNNTFFEVKSISNQVWKFQRYQLIMTFHDRPVLPPPMIILSHIYIIIMRLSGRCRKKREGDQEERDRGLKLFLSDEELKRLHEFEEQCVQEHFREKEDEQQSSSDERIRVTSERVENMSMRLEEINERETFMKTSLQTVDLRLAQLEELSNRMVNALENLAGIDRSDLIQARSRASSECEATYLLRQSSINSADGYSLYRYHFNGEELLFEDTSLSTSPGTGVRKKTCSFRIKEEKDVKTHLVPECQNSLHLSLGTSTSATPDGSHLAVDDLKNAEESKLGPDIGISKEDDERQTDSKKEETISPSLNKTDVIHGQDKSDVQNTQLTVETTNIEGTISYPLEETKITRYFPDETINACKTMKSRSFVYSRGRKLVGGVNQDVEYSSITDQQLTTEWQCQVQKITRSHSTDIPYIVSEAAVQAEQKEQFADMQDEHHVAEAIPRIPRLSLTITDRNGMENLLSVKPDQTLGFPSLRSKSLHGHPRNVKSIQGKLDRSGHASSVSSLVIVSGMTAEEKKVKKEKASTETEC

SEQ ID NO: 163 - DNA, 21338 bp, Mus musculus
ctcttctggtaacttgttaagaaataggatttagtttcaggtaatcagggaccagaggatttggtgctgcatttccttgggtattagctgaatttgatggtctctgaacagcctttttatttacagctgctgcagcctgttgcatggttttagctttcttttttccttgtcagtaaaagtgccacacatatcagaatatgtttttgtatactgaattctcattggtttactgtaaaactgaaacacttagaactgtctcaaagcatttgtggacatgtccagtcccttaatataacaaactcctattccctcatcttcatggtctttaaaggtacaatataccatatgtccaaacttagaaagcaggacatataggtatctattcacttcttattttgtaattttgtcatgcatgttgttgatataaattgtgagatttgttctgatatccatatttgggtgaaacccttcaaatagcctaaagcctgtgccggttgcttgaaccctgacatttcaattcttaacatttatgccccaaatagaaagacaccttcctttgtaaaggaaagactactatagtttaagttacatattgactctcacatactgatagggggagacttcaataccacactctcagaaatactggagctaacagacataataaacatagcgatctaacagatagttacagatttaagaaagttttcccatgctcatggatcaataggattgacattgtaaaaatggccatcttaccaaaatcattctacagattcaatatcatccccaccaaatggtaagacttccagtaattttttcattgttcatcattgttttaactatcctttatttttttcctatatgttgaaaactgtccttttaaggtcagggaaggattgtgttggaattttgatgggagataatgtcagggcaatacagctgggtttgagggggcatttgaggaatgattgaaacctactgtagtagaaacctaaaatatatgaatgtgattgtactgagatcttcttatattggaagatatggagtcacaactggccagttcttttcatcaaatgaggcttccagtagctggattgagttatattcaattgcgttgttgaccaaggaggtcctattgaagtcacaagtcctccaaactaaactaggctgttgctaagataatgggctgatagtgccactccttgccaaaagaaaatagcaacacaactcactgaacatggagaagttgtgctgatatccatatggaaccttcatccctatgttctagtctttatgctgtgggaaggtactctacagggtactaaaagagaaagataaatgccaaaccagtccaaaaaaaaaaaaaaaaacaaaaaccctttgacttacaatgtatcttgactgtaagatataatagagcagtggtggcacagaacttgtgggagtagccaatcaatatctgatttgacttgacttaaggatcactctgtgagataatacccacacataacattgctagggtaactaagaacctagacatcccagatatgtagggtaatatcaaacactacttatctaaaaaataagtatcataaaatgactcctactgatatttgaatatattcatgggtcagtgccttattcagtctgcatcagagaggtttcctccatcagcagatgggaacagatggagaaacccataatcagactttacagggagagaaagtctaaatgggatgtctccatcaattagttctcctcactattcagggaaccctgctggagtagaagctgaaagaatgtaagagccataggagatggaggacataaaaacaaggtcctctggatgaactaagtaaggcatagagactgaagcagcaagcagagggtcaccatgggtctaaacaagttcttttgcctatatatgataacttacagcttagtatatttatgtgattcctgagtatgagaacaagtaggtctttgactcttgtgcctgctcttggaactcttttcttcctgtggggtttccatgtccaacttcaatataatggttttgctttatcttattatattttattttgtcatgtttggttgttatatctaaaaccctgtccttttcttatgagagacagaaagggagtggattgggagtgagaggaggaggatctgggaagagcagaggtaatagaaaatacagttggtatataacatatgagaaaagaatctattttcaataaaaaaacaaggaaaaaccaatgacaaatacataatagagatatgtggataatggagattgtatttatgccattcacacagactagaggaccctgagctgtcttatacttagagacacacagttacaaccacagataagcacttttggtcctatcttacaggtatttatgctgcttaccattatggacaagatggagtcaagacccctaagctccacctcatttgtgggtcctagtactgacattggattgcccttacagatcaactttgaaattactagatcatgcttctctaaagttttaaaaccatttagcagtctgacatctacaaaacatttgcccctgctcagagccatggggatctctagcatcctaagaatattatgcaggacatcagaccaccgtgcttccacctattacatctgtatcaccattgttctccgaaactcagggaagaatgttgctacatgtggactgaactaggtcccatcttcattcttggcgctccactgatatctgcttattcctagcacactgttcctttcatgtgactcccaacacttagccttcccattcaaggacagaactcaggactgtggttctacaataacttcacataggttcaactaggagataagtattgagagaggtgactggaaatattacctaaaattggtggtctggggacagcttcatttgcatatagtgattacaatctctgtggtcaaggcacagaaaagtgtttcttccttacagccctacataatgatagactttttaacttacaggattcagacatcagactaatcattcgtgggtgcatagctttgatctaggatggggtgatacatggattcagtgtgtacagcttgttagccccaaacaatcatggcccacatcttaggactggagctattttgtcttctgtgttcttcgttccatggtatttttcacaactgttcataagtttcagaatatggtaccaccatatagtatggggagctgatgaagacctgagccagggccatgtcaaagacatcaattcctcagacccatggaaatggcaagtctcccccttttcaggtgcaaggtgatggaaggacttatattagtttgtgtacaaatgttaattgtatgttcaaaaagtaccaacaacagctgcttcctccctgactactacaaccaagacttgtgccttatggggatttgctattaagaattgctaaacctgcttccttgtttatctgtacaccataaagttacttttgcctcctcagttcagatgcataagatcaatactgagggtttcttggatgctgtatgccttcatgagagcacaggaccctccaaatgtcagcttttctggatgtgtagctatgtgcatgtatcttcattccttcattacccaggcaagtcaagttcaaaatatccaagtcatggcaacacaatcactagatagaaataccagtcccacacaactattttgctgagaatgcagtaacaattatcagacttatagttgctgattaactggatactcagttctgtttaggtcctgagaacatggtggcctacaggacacatctgtagagcagtgccagtagatgacataggacaggaacaaacacatgatactctaatagatgatactatacactctgaagagggaagaagatgacactagctgtatgttcacaaagagatacagacatcttcaaataaaggaggaatgaatgagcaggtacttggggaggagtgttcttagcaagagaaactcccaattacaaagaaccatggacgagagcattgaagtaagacatagaacaaatgaatggaatgagcatcctcaggtccttgaagacttgaccttagcattatgtattttgtttccaccttccagatttatctcaaggaatacatgtggaacacaccagcctcctgaatttctagagttagattattctcccaggtcagatggagtgagctaagtggcttcctgtgcgaatagaggatataaaataggcttctggtgaatgactacttggaattgtctagttcttcctttgctgtcttcccagtaaagtcttgtatatcaatgttccttaaacacactggctgtggtagtctgctctaacctggatatctgggaagctgggctagtatatacaggtgaactctgatatattctctctcagagtagaaggaccaattaacagttaaccaagcatgcagcccatgcttgtgcctatatattaccctttctataattctttcagcatttagtgagaacccaggtaaagcccagagttgtcactctgaggtctttgaacttctcattacactttatccttcactttgtcttttccttgcatgagtcctatgtttgctgtgtatcattaggtgtcgtctgctacacaggtgccattgcatcctttggttctgcatggacttgagctcttcttcgttctaagtgagggcatggaatcctctagagccaaggatgggactttgagcatagagtgaaaagatactgcaaggatatcacctcaaggtttccatctgcagctccacgccctatttctcatattgaagttgcccagttgatagaaaatatgggcgatttgtctctgattttcatttggaatatgtgagcatctcttaattagagtcactaaccaggattcttttattaataaattacagaattatgataaatttaaagagttctccaattatactaatgttcaaagaataaacatctttgccatattgagtcattgaatctttgaatgttttctatattatcactaatagtttttaataaaaatagtggatgcctagaaatattactatattttaataagtagtttactgatagcttaatgcaaataaaaattttataataaagaatatccttttctattaatttctgggtatataaaatttgttaagtttatggtttgaaattagatctgagaaatttgctgtattttattaggtggtatacatgctacatatttgtgagatttcttagctatagtaagtagcaattttattggtcctttctcaattcctgtctcttttgtttcacctcatcccttttatacttgcaaggaagacaatggccatgggcaacttgtcttgctggagttttgaagcatttttttcctatggagtgtagtgtttgcaataggattccttcataattctctcaccagattagggaatttcctttatgttccttgtaaaatatgagctattttattagatattgggtctttaacaatagtattctgccttttttaatactgtcatttgtgtagacttacctacttgaaccaaatttgtttttgtctaagtctcagtagcttgagaatccaggtgtgccactctgcatttaggattcttactgtaggtggaattaagttggtcctaaaggtatattttgtagtgtttcacagatataccttatcatcacaagttgttgaaaagaaatgtctttttgctgttatccaacaagtcagggggccatttgagacaggtgttattatgaatctttccaggatataggagcctcatgttgtttgtaagcacaaaagagaaagccattttatagtacaccaggaactacctctacagcagtattaggtggtgctggtctgcatatgagagcacagtaggggagaaaggtctcatggggttctggcatggccagaatgactaaaatgttacatctctaaggggaagccagagtaaggcaggctgctaggcctcttctgccacagccactgccccagaattggtggcagacagtgagatgcagcaggcagataggagccaaagtcaaagtcagtgccactgagcaggaagtggctgtagtcaagcacacacatttgacttattgggtgggatcgaggtccaaaagcttcaggagagaaaactcttccatggagtgttatagctggttaaaacaggcaatatctcatgacgttgttccttgaggacaaggaaataataaacactttggggtgggttgggatctagggtatatccttcctattggattggttagggatgctctgtctgtatggggaaaggacttcatgttgtctctatgtgactgattgtcatgctccttcatgtggtcacatgccccaggacattaatctggccgagagctaactccaactcatgaagttctcagttatgggttttattggggttctgaactttactacaaccttaccattcttctctttggtggcatggtccactgccccacaaggtagcaacagcaaagatatggggtactgtgcattatttggccctaccaaatttaaacaacttttaatgtactctatatcttagttagggttctattactgtgataaaacacccagatcaaaatcaacaggggagaaaagggtttatttcagcttacaactctcaggttatactccatcagtgaggcaagtcagggcaggaactaaggcagagaacatggaggaataccacttgctgtcttgctactcacgacttgctcagcctgcttgctcatatcactgaggactacaggctcaaaagtggcatgagccataatgatcttgcccctcccaccccaaacaccaatcaagataattcaccaaaagctcccacaaaggacagtttattgggggcattttctcagttaaagttctctcttcccaaataacttctagttactatcaagctgacacaacactagccagcatttgtgagaacaacagagtttttttttttttttaaaacaagagagaaaattgttaatctcaacatactggtttaaagacacaacatgccccaagttattgatatgagagtaggctgtagccttttcaactctttgaaataaagtataattgttaattttgtgagttattaggactgtgtgtaaatacatcagcaatgaaagtatttcacaatgtcagaactggtccctcctgtgatgtaaaagtcaagaacatttaaaacattctttgtgaaatatacccaatcatttttacatcagttaaaacatgatgcttccctgaaagaacaaagagcaaatgaatacaagcatcattgttgtgctaagtcagttataaatctcctgtttgtttgggtgtccactgatgctgcaattttcttttgaatccagtacagtgtgtccaagcctttactcttgaaagatttactgctgttggtttcacaagaagcactccctctgggccagtcattttctctgtcagttaatcttccaggaattgtgatttttttttgtgttatctgcaaagccctaccactagatttgaataattgcataggactgtaaggtgaactatttactttttaaccatttagtttcattcaacttctcttcctgctttaattagttctttgaaaattccatacaacatattttgatcatatctgtttctaaactcagatctaacatccttccctatctaccttgatttgtgtctttttttttgtttttctaacctatcaaagacagttggtacattctacatactcttggatacgtagctttccacaaaattcatacttcatgaattaaaaatgaatatttggtcagagttaaaatagaaaattcagatgaccaaataaaatattactgcccttccaggtattcatattgaatatatgcatatagacagtaatcatagatccagatacagacatgaatgcacccatagtcacatttttattcatgtgtttacatatgtgtgtaagataaatcttcttatgcagacaaagctaatcttagaacttccatctcagattaccctactgctccatcctccagtggttgtaattataatcatctgccatcatgccctgctcaaatctttggacctctttgaagaaatattctgtataccattttacaaatgtattttaatttcttctcagagagtatttgtagagaatcttgtttcttacatcagcccattcatttcttccttaggtagaaagcctgtagtcattcactgacaaatcagaaaacacgggaaagctcaaaggctcatttctactgggaagaactttgagagtacattttatggatctatttagactattatctagaggaaatcgtgtctttaaacaaaagtgagatcttttcctgggtctgtaggacagtgttcccttctgttgatacccgtccaggtcattctgcaagccactgaaaccacatgtaccctagtcatccataacatgtcccaccaaaacaatgaactctcgtctatgtttccacatgctggttctgtgattgcttcatgattgattgccaaaataaatatttttggataataggaagggtgtttacaaccttctagacataaggaacaaagtcagtgtgcctgaaaggctagataatatacctctgaaccacagattctgaagaagtgagactggtgcttgcttattcaatcacctgtttctgttcaggtgagaaccttgtgctctacctaagttgcttactcctttgtgctctgataacccacatgaccactactgtctggtcacacagatctttgggacatgaccttccaggattcaagtgtttaatattgagcttggtatatggaggcagccaagggttagcatcacaaagaatgtgaatgaaagtacagatgaggtataaagggggctctgttgtccctaacatttagatgcacaacctacactttcaaaactggcccctgaccctccaatgacacacctgcccctacttgccatgccttgctgctaatggacttggtttcagttcctattatttctctttttctgtgaccatgagtttttgtttcagttatcacagatttaattttagcttgtggactctcaagggtggcagctgcagtcatagcgagctcagtaaagcaactaggttcatctctctttcccaacctcctccacagagcttgtaatgtcttcttactattactatatatcacacttcaagcattgctgctttaccaagtgtagaaccgattttcctggccaattccatcatatagtaaatctattgcttcccaatagtgtacatttatcgtgtaactgctcattggtcataggaatctgaagctccagggaagggaagttacccttctatggcaggcctatgtaacatctcaggagatgatagtggaaactagagattagcgaggatctccactgaccagagacactctaagcatctcctcaattaatctatgaccccacactttcctgaacagattgataatcactccctagtgaagacagggaaactgaagttcacagaggggaagttaatttctcagggtgaagttctgataaagaatgagcaagtagcagctacccctgtatatcaccttgagtcttctataaaacacgtatctaggctctgcttgattctttgttgctgtctagccacacccttagcttcttgtagatggttgatcatagtacctgtatgtcagcttctcctcaatgtcagctgtcattgctggttgatttttgctctgctcactttagcatgatgaataaaaatctctctatgtgagagtgtccattgcctggaaggaggcagcactccatactgtgtgagcacaggcaggtgtcttactccaatgaatatgtttccttggttcataatgaaaggttctggaatagaattgaagatagataggagttgggtggtgcatctggtagcaggagaagatgacggtctccacaggagttcctcataattttcgcttgttggaagaacttgaagaaggacaaaaaggagtaggtgatagtactgttagctggggccttgaagatgatggagacatgacacctacatggtggacaggcatgattattgggccaccaaggacaaactatgaaaacagaatatatagcctgaaagtagaatgtggatctaaatacccagaagttcctccatcagttagatttataacaaaaattaatatgaatgggatcaataattccagtggaatggtggatgcacagagcataccagtattagcaaaatggcaaaatttctatagaattaaagtcatacctcaagagctaagatgtcttatgaggtccaaagaaaatatgaagccaccagaaggacagatgtacaacaactaattttagtggatctcaaacttgtcttaaatctgcaaccttatactcatgttaatgtcttgattaaatatcaccatgcacaatagtcacacaataagtaaaagattgcagctggtaaacatgacctggacagttgcaagaatatatttaatatatgcacacctattatgttttcaggtaacaagagacgtgcagcacaatttttctttctcttcttttttttagatttatttatttatttattatatataagtacactgtagctttcttcagacactccagaagaggtagtcagatcccctatagatggttgtgagctaccatatggttgctgggatttgaactcaggaccttcagaagaagcggtcgggtgctcttacccattgagccatctcaccagtccctttcctttctcttcttaaatcactgtcatttaaacatgaacctgaagtactcaaaatggaattcaggctttcaatacaaaagcatgacaaaagagtgtcagatggccatggaaacatctgtttttctggaaagtaaagtctcaagaagaacagaaatggcatgctttatcatatttagagctgcagttgaaattgtttaaaatagaagatacaatgattagtcaacaattgtgttaattcttgaagtggtgtgggtgctgactactattagtcttaaacatatgttcaggattgttttgatacctgtatttataataaaagatgtttggggttttgaatttctgttaaaagctgttcctatttgtaacatttgtaacagacatgataatttttttacagtctttgtttagtaaaacatgcttagatgttttaagtggagttaacaaaaaggaaatcagtgtatggatatgtgattttaatatgaaagttagtcttaaaatttaaataaaatatggaatgtgtcttaaaaaaagatggataggagcccattctgcctgattctggagatttcactgcagtggaatgaaggtcctaggtattggcttcataggattactaaatgcctgttctgattttgaatgttccaagttttgtaaatggtatagaagacagtaaagctcaagacattgacacctttcaaattggtagatatggccagaatgaaacttttattgcctctatttcaggccttttgatctaggccctggtgtcacaaatatcctgggctgtgagatttgtaaatctctggttcctgtcccaaactagaaattacattcaagatttagttcctcatcagtagccaaacctcttccctggagctgcctcaaatgaagagcttttgctcagtctccctgtgcagactttaactgtgttgaattactctttctccttgcaatagggctcacatctctgctctcctctctttcctttcccacatgtggcctagttcttagcaccacccagccatagtactcagagtttagggactttctgtgtggagagtagggtggtaggtcaggaacagtgggacataagattgtgggatagaggtaaaatgatgttgaattcactgctcaggctgcagagagaaagtccatagtactcaccctctatttccgtggccaggccagtcacccaagttgcccttcatacatttgccttgtagtcttggggtataactcctgggctctgctctaggatcttgttatgaccacacatgacctacaatataccaatgtcatagcagatttgttctgtagtgtaagctcttgcatcataggatcagctagcttccagaatgcaaattggaggaaacacttttgagcacacattggaaatattaggtgatgttcatagttaagtagagagccaaactttcgcagactcatgggtggccatgtctggtggaaggtaaagtggaagcacttctcataaaactaaagtgatgtcaatggactttcatttcttggaggaaaggaagggtggatattgaaacatggagactttgctgtttacatgttagttgttaatctcaggctgccacaacctctgctgcatatggatcaatccttctgtcctagcttgagtccctgaaggcctgatttctcatctcgtgcagttggactggtggagcttaagaatctcagaggtcaaaattagttgagaaacttcagccagacccaggcctggcatcaggtgcttttacctctgtgggtagatttagggcaaatccagcttgcagtcttagcttggaaatggtttcaagacccttcactatgttgctatctgccctcagcaccatttctcattttgaaggtagtcagaatatttagataatggttgattgattttaagaagcagagtctcctgtttttgcaggtcttgctccttatttaaggatcctgttgtgaatactgggtagcacagacacaaagccaacattggtatcaccaagatacataaaactcataaagtacctgagtggtgaggttggcagaaactagatgaagggcttgctggatcaaatgaaacactgtctggtggttggaccaacttcagggaagatgagaacaatgtaaaaccttggagctttgtgttttggataatgatgagaatctcattgttcatctgatttcctttcctttctatgcatagaacaaagtgtctattattatcatcctgctgcacagagagaaaactgaggctaaacatagtcaaaagtaagtttctatttacttttggctattagaacattatctttgggaaaccctagttggtgttattacagccccttcatactatacatactttatttctccacaaaataatcccctctgtcttaggtgatattgtgcacttatctcttagacatatttatcttttaggtttctgtattctaagcctgataacactagattgtcccacacttgctatacgcttgtaacttaacaggtgctcttaatatctgattctattatgggattgcctcatgtgaatatgttgtccacatgcgattagtttcacctggctgagcccttccacataataactgctcttggatgtctcagggcacacaggatttctgagattgttggggattgtcctacaatttttttgtttttgtttgctgcacagatcaaatcagggcataactttgggggttgtggacaatagccttcccttagtcactgatcagtcttcttgacctttatattttcttcagtcttttaaggccagcactaaatagttgaaaataggaggattgtcaatttgagacatgtcacagatacatgagttccaagaacaggaagaaggagatggagccaatatggcaggcataaaactgagaatgtcccaaaaataaagagttttttttgggggtcataatgcttaaaggacactagccgaggttgttctttagagggattatgtggacttcctagaaaaatcaataggtttgtagtcctcattgaccttgtgacttttcagagaactcaaacaagtatgaccttgatcaggctactgtacaccgtgtttctgtacttgtgtttccaagccttgtctgaaattcctcaagatatcttcacaggagtttggtttccgtatatcatctcactgaggacctcatgtgcaatctttgaaatatctgattcttagggattttgtagaaatgttgttgggaatgatacagatgctacccagaggtgcagatatgggtcctttttctctgctaattaaagaattagttaccagaaactttgttactagaaatattgaggaatccaagtatgacactgggaaattgaggttcccctcttagggtccttagttgtattacttaaaaaatttaagaacaggcacaaacagaaacttgacaatctatttaagtttaaaaggaaccctactgtagagcatagagcctaaggtttgggtgaaatgttaagtacatggacaacagttgggatgacactggacatcaaagatgcagctttgtatttctggttgtacacaatgggttatttccagagacccctggtcagaaataactgggctcttgattcatcaagcagaagagaaattaaggatgaggcaatataaagccaaattgtcatttagtaagaaatgaacagtagcatatactcatagtgtgagtgtggaactctcaagacagacttacagctgggcatgtcagtgcttgtatacacccccaggtactttggaagccaaagctgaagcagagggagttcatggccagcttaagcaatgtatcaagcatactgtctcacaataaaagtaaagcataggtcttgagatgaaagtcagagataaactctggcttaccatattaaagtctcagggtccaaccccaaataatgagagggagtttgtttaatgtcttactggtatctacaaatgtgatttttatagcttttgaaatgtttaaagtgaaaagtctattcctacacttatacaattacgttaaaatcttttcatatctttattttcatccaaagggtttttgttttataaagcagattatgagttggtttatgtgatgcactgtccagcttcacacagagtaaaaaagcagaagaaaagtgtcacagtaacatttgttgtgcttagtcactaagcaatcatgacatgatttcattataaacatatttcatagtattgtttataagactgttttctttctaaattatcaacagcattttaataaaaactttattataaagagcttacaaattaaaaacacatcctgcagcaagagtagatagaccaaaggtgctgatccacacactggattttacacctacactatcaaatacattttacacacttgccaatctccaaaaaaatctaaaaatcagttaccgagctaaaaccatgaaaaaagtagctttatatcgtttcctgatcatgttcataacctatattgagttcttcctcactgcctactatttaacctttcctgttctcctttctagatattataatgttcccacatatatacttgtttacatatataatacataagttttaatattataaagcactaaaataatttggcataatctgggattcatatgtaagagagaatgcgaattctttctttctgagattgtataacctcacttagaaaattgtccattttatgtctataaatttacctgaaaagttcttattacattccttttcagagctgaactgtattctattttacatatgtgccaggttttaatcatctattcatctgttgatacccaactattttggttttgtcttttcactatagtgaataaagcatcaatatgtatgagggtataaatttccttacagtaggatattttcaggagtgaaatgattacacattatgccacttctattcttaatttttaaagatttttataacatactttaattgaaatagagttacatcatcttactcctttctttcctcacacttggtgaagtgctgtctcaaaatagttttttatttgtttttttcccccaatgtctaagggtattgaacactctgaaaaatagttattggtggttgtgtttctctcttcaaaaaacatcaaattcatgagctcatttgctggctggctgatttatttacttgatatacaatttctgaaattctattaaaattctggatattagttttttgtttcaaagatttttctccctttatgtagattgtttgctctaatgatagcttctcttgcttgtagaaatgttttattttcttgtagtcccatctgagcagtcttgagattaatgtctgcccaattattattctgttccaaagtacttgcctactccaaatttgaggggtaccctctatgttttcttttacaaactttaccacattaggtttcaaattaagtttattgatacattttaaaattgattttggtatgaggtgaaagatatgaatctactttcattcttctgcaagtagatacagtcttgacagcacaatttgttaaattcagaaactatgaataacttaaatggaccttaatgattccttaaatggaatcaaatctgtaatcaaaagccccccccccccccagaaacagaggttaatgtggattcattgttaaaatataacaggctataaaatgatataataccaattctttttaacttattctttaaaatacaaagtaacaaattctctacatgtggttaatattattttgattgccaaattagataaagatacaacaacaaataaatagatcaatttctttggtgaagagagattcaaaaattctcaacaaagcatttgaaaacacaattaagaaaaatatgttaaaattatacattataatcaggagtgttttttctcagaaagacaagattgattcaacatatgtaaatcaataaatgtaatatatcatataaacaaagttaaggacagaaaccacataatcatcttgattgatgctaaaaaatcacttgacatagtacaatatgatttcttttcttttttttgccattttctttctttttaaaatttttttactagatattttttaaatttacatttcaaatgttatcccctttgctagtttcctctcagaaattcctctattccctcacccctgcccctgtttcccaacccaacaactcctgcttcctggccatgcattcccatatactggagcatagaaccttcacaggaccagaagcctctcctcccacctttgctacatatgcagctagagacatgagtgccaccatgcattttctttgatttgtggtttgatttagtccaagggagctctgggggtacttgttagttcatattgttgttcctcctatagggctacagatctctttagctccttgggtactttctctagctccttcattggggaccctgtgttccatccaatagatgactgtgagcatccacttttgtttttgccaggcactggcagagcctcacaggagacagctatatcaggctcctgtcagcaaaaactttttggcatctgcaataatgtagcctcccccagccttgaggaggctgattcagacttgaccttgctgccactaaggagattacctcgggtggagccttccaacctagatggctctattgttctgtcacctgccactgctctcctccaagacactgctacctgctgagaggcccctgagatattccagaggaacatcctatcctgcacgtcgcctgcagactggctccagacaccaagaatggactggtgggagatgggccttcccccttataagcacactctcttagtaaattcttgagccttgaacagagaatcatcttggcttcattatctctctcgccatctaagtctttttcagccccaacctgcctcccaggtgtacccagttcaagtaggccgcgggctgacatacaacagattgctgtccgagacagggatcttgggaacggtgggaaaacccggagggaatcgcatcttgtatggagctccaagggaatgaaagaatcagagaatcttattgggctcggtgagcaacaggtatttatgcgagcgttggctttaaacttcattttttaaaagtgttgctggagatgcggaaggatatgggttaagtttggaacagtgctaacccggcgctttttccatttaggatttgacagcgaaatatgtgtgggactagaaactgtgaatcaggcggttgtctgcagcttttaaaagctgtttcaggccagaggaatagggtttaaaatgatgaaaaagggggttgtccacagtcgagaagcgcatcaggctagaggaatagggcttaaaatgatggagtaaaataaaatagagggaaatggattttgaaactcttccagagacagagagaaaatcgggggatgccctgcctttttctctctggcccctgcagcagaagttctctgccctctttgtgttgtctaatgtctgttgcaccaaatccgtttacatgtcaatccatgtgtgttttgtctcgttgtctgaatgactgaatgttctgtgtttcatgttggacaataaaaatggctaagactttatctgctgatttagcagggccgagagtggccaagctttagccaaggatcaggcacagcagggtagccactgctggataagcttctttcaaagaaagggagtctgcagcctcttagttttggggcaaaaagctgatagatgttttttatgcaatcgtgattaatatgtttggcaaatgataaagtgctttttttatcttataattatagctagaaaaattaaaattcattgattggtctaaattcataagactcgtgtagccactttatttgattttttactggtcttagaggtgtaataggctctgcgtgtcttcattgtagagtattagcttataagttattgggtatgatcaaaaatgtgaaacactggttactagaaagttcgctttaaatcggtaactcaggtttggagtctttccaacacttggcataaagcaggccaaaaaactaggcctctaagggatacttctagttgagataatatgtaatgtgattcttatcctaaaaggtagacttaaagataagatttaaaataatgtctctttaataaagcattaaaatttgcactgtcatacattcataagtataaactggcagccaacttttgtaacatgatagtgatgtttctaacattgattctaaggtgataaattgttttgaaattgggttttgcttttgcaagattgtagatattattctaatgttgcaaaagaaacttaaaaatcatagttaaaactgccagtgttccattgactgcagcttgcagtttgatcacaaatttaagattttctactcactcatatattgttaattaaggttattacaagagtgatcatcttatgagagcactacaaaactaagacagtgttatctgagtttgttttgtacatatattagacccttagacagtagattttggctatggttgctgcctggcaggagactacagtacaggcattttttttttttttttacagcactaaagttataaagtaagttttaactataagttatcttaagaaagactatccaaaattagaggagtggacagttgaattgttcccccagaatctgtcctcattgcaggagggccaagatgctcagattaaaaaaaaattatgtttgagtcaatgcaaagtttggagcagcctctgggaagcttgtgcgatgtttcttttgtttcacaaaccttggctaaggaagttcttgggacctcacccctccctgcctccagggaaaattccttttagctaaaagaacactatccagatgttgcagatctatccagatgttgttctaaataaagttctaattcaaagtttataaaaggtcgatcagactgtagaacttataaaggcattacaatctggcttgcctacttcatgaaaagttattataggtttaaaggttcgatttttccttttgcatggtaaagtgttcgcttctagtgaacttgtaaccactggaaaattttgcctctaggtatggctaatatagctttatattatgtaagaaaaatttttattgtctctgcttctatacaagaagctaagagtttgactctttcagtgtatattatttcctaagtggaaagtattttattagctaatgtttctcaagggaagtttacttcaaatctttgttctcacacaatgagttttaaagttctggggagtagttgttgctccagaaaagattcagaggcaatatctttataatatttagggttttagttatgttataaagttgtggtacagaaaatctaagaacaaaaacttgatttgcttcaaaaatttattttcaaaagcttccaggagaggttaattggctaaggcctcaccttagggtcttaaagtgacttgaacctttgttggatgttgtcttgagagacacaaattaactggcaaagaacaaaaggctttgcagaaaataaagaaagcttttataattgttatcaattatgatcaatggtaatcaaatattagctgcttattttagttagggttattaaatgtgcccacagcaattctttggcaaaagaaaacattaatgtaaaatcatctttcttcacctcaaagcaaagttttaacatcctattaaggctgctgtggcactaataaagaattgtaagataaatttgtatattttagaaaacctataacaaaaaattgtgccttaagaacctgacaaagtgtctgttccttattccaaacagcaattaatttggttattacagaatattgatatttgtcctattgcataccatcattttaaataaagttgataattactatcctaaagataagttgaaaattgtttttatgcatgcttttgtaccttctataaatttattcatgcatacattccaattactgtgtttaaaaacagcccttcaatgggagaacagtatatgtgaattggatcacacgcttattcttttgagtttcctcctgcttcagcacagataattaaattgtgtgctgtagatggtgttttaaaatgttgaataatcaagctttaatttgtatattaattatcaatatatatctcagagcttacaattgcttaaaattgattcatccctcagatactataaattctcaaatttgcaattgtttatgcatatacaactcataaaaaataatgctgctcttttagaggcccattggacttgcaaactttatatgccccagtacaggggaacaccagggccaaaaagggggagtgggtgggcaggggagtgggggtgggtggatatgggggacttttggtatagcattggaaatgtaaatgagttaaatacctaataaaaaatggaaaaaaaaataatgctgctcttttaagaaaactgtttttggacatttaaaattttgttcttgactgcctggacaagacctcttaaggcaa

SEQ ID NO: 164 - DNA, 1132 bp, Mus musculus
aggagttcctcataattttcgcttgttggaagaacttgaagaaggacaaaaaggagtaggtgatagtactgttagctggggccttgaagatgatggagacatgacacctacatggtggacaggcatgattattgggccaccaaggacaaactatgaaaacagaatatatagcctgaaagtagaatgtggatctaaatacccagaagttcctccatcagttagatttataacaaaaattaatatgaatgggatcaataattccagtggaatggtggatgcacagagcataccagtattagcaaaatggcaaaatttctatagaattaaagtcatacctcaagagctaagatgtcttatgaggtccaaagaaaatatgaagccaccagaaggacagatgtacaacaactaattttagtggatctcaaacttgtcttaaatctgcaaccttatactcatgttaatgtcttgattaaatatcaccatgcacaatagtcacacaataagtaaaagattgcagctggtaaacatgacctggacagttgcaagaatatatttaatatatgcacacctattatgttttcaggtaacaagagacgtgcagcacaatttttctttttcttaaatcactgtcatttaaacatgaacctgaagtactcaaaatggaattcaggctttcaatacaaaagcatgacaaaagagtgtcagatggccatggaaacatctgtttttctggaaagtaaagtctcaagaagaacagaaatggcatgctttatcatatttagagctgcagttgaaattgtttaaaatagaagatacaatgattagtcaacaattgtgttaattcttgaagtggtgtgggtgctgactactattagtcttaaacatatgttcaggattgttttgatacctgtatttataataaaagatgtttggggttttgaatttctgttaaaagctgttcctatttgtaacatttgtaacagacatgataatttttttacagtctttgtttagtaaaacatgcttagatgttttaagtggagttaacaaaaaggaaatcagtgtatggatatgtgattttaatatgaaagttagtcttaaaatttaaataaaatatggaatgtgtcttaaa

SEQ ID NO: 165 - protein, 135 aa, Mus musculus
GVPHNFRLLEELEEGQKGVGDSTVSWGLEDDGDMTPTWWTGMIIGPPRTNYENRIYSLKVECGSKYPEVPPSVRFITKINMNGINNSSGMVDAQSIPVLAKWQNFYRIKVIPQELRCLMRSKENMKPPEGQMYNN

SEQ ID NO: 166 - DNA, 75839 bp, Homo sapiens
  misc_feature (1)...(75839): n = A,T,C or G
agaggaaccagaagcctggaggccggaggaagcccttgacccagggctgggtcttttggaaactgagagacaggcggtcaagggtttcggagaacagcaacagtctctttttactcaccctggcggaggctttgatggtggatgaagtcgtcagcagtgggagagtctaggagattctctgggacttcggcaggttcagggaaggggagagactggccaggagataggtgataggggagggagggggagagagagagagaaagagagagtgagagagagagagacagagagcgagagccggccagagtctatccccttcccggtttcggcaccagaatgtaaggtcagccaagagaaaggaaaaatagacccaaagtcaggcgagcaagtttttattaacctgccggctgaccccttaacagtcaagggaagcagcaccaagcttacagaatgaggggtttatattggggaaagtagcttgagggagttctttggtatggccgcatcctggggttgtttgctggttaattttgccacatatcaccttgtgacgtttattacaggagggtgtaggtaaagtttgtttatgcttcccacaaccttcccctatgcggtctgagtggtttgtaattggggtttgcttatcgcagcaaggtctgataagtgaaagtcggctggcttcaccatggcccttgataagggcttagaaatgtaaagagacttggggaagggtgggtggcacagagaagagttgcagagcattagggggaggggtgggcagcaccaaagaagctttctttgggcagtttgtccctaacaatatccaaggactgagaactgaggagagcaaagatcacctggtggctatcaagtggaccatccagaggcaatactccttatctgaggaattcataagtaattagacttcccctttttttttttttgagatggagtcttgctctgtcgccaggctggagtgcagtggcacaatattggctcactgcaacctctgcctcccaggttcaagtgattctcctgcctcagcctcccgagtagctgggattacaggcatgttccaccatgcccagctaattttttttttgtatttttagtagagacggggtttcaccatgttagccaggatggtcttgatctcctgaccttgtgatctgcatgcctcggcctcccaaagtgctgtgattacaggcatgagccactgcgcccagcccagacttccctattatctaaagccagcatctggtaccaagcttctttacaaaaaacttataagtaagtatgtagcaggatgagccacagacaaaactcctcagacactgggttaaagaaggaaggagctttatacggtcgggagcatcggcagactcacgtctcaaaaaccgagctccccgattgagcaattcctgtcccttttaagggctgacaactctaagggggtccacatgaaagggttgtgatcgattgagcaagcagggggcttgcatgcaccagtaatcagaatggaacagaacaggacagggattttcacaatgcttttccatacaatgtttggaatctatagataacataaccggttaggtcaggggttgatctttaactaccaggcccaggccatggcaccaggctgtctgcctgtggatttcatttctgccttttagtttttacatcttctttctttggaggcagaaattgggcataagacaatatgaggggtggtctcctcccttaactagaatttctatacgtctctggaatgtatgcatgttgaaactcattgtgcaacccttgctgacatcatggcaccaaaatgtctacagatgtaatcacttatcatgacatgtgtggctaagatggtccaaattatccttagtctcccactttaaggtccataaatactcctaagtaaaatccactgtgcagctcagtcctctcttgccgaagcgccctgttgcagtctgctgcaatgtgttatctaatataactttccttttcaaacctaaactgttgttggtaaattattttaccacctgcaagccaaccactctctgctgctggggctctgataaggccactaagaactagtcctcaatggctgggtgcagtggctcatgcctgtaatcccagcactttgggaggccgaggtgggcagatcacgaggtcaggagatagagaccatcctggctaacatggtgaaaccctgtctctactaaaaatacaaaaaaattagctgggtatggaggcgggcacctgtagtcccagctacttgggaggctgaggcaggagaatggcatgaacccaggaggcggagcctgcagtgagtggagatcacgtcactgcactccagcctgggcaacagagggagactttgcctcaaaaaaaaaaaaaaaaaaaaaaaaaaaagaactagtcctcaatactatgaattcatgtagaagaggaagactcagaataaatggcaagtgaagtagcagaaggaccaggtgtttctctgtattttgatgcattgacgacttgaggccttgtggacccttgaaggatggcccctctcagtgttagctaattcctagagatagtaaacagcactttgtggattgagcctttcaaatacaaaccaaccgagtgcgctccctcaccaccttcattattgagctctcacactctggacactattttcccaacttaatcattcaaggacaaagtaaccgacaattagggacagcccttatgcctcagagcccgcttagcattggcttagcagccaatgctaagcctgcttgtcattcctttcctgttccttcccatggaaaatacaattaaggctgttacccacattttcctcttgctcctgcctcctgaccaaacctactacctttaaaacactaggacatgcctgtaatcctagcactttgggagaccgaggtgggcggatcacttgagctcaagagtttgaggtgagcctgggcaacatggtgaaacctgtctctacaaaaaatacaacagattagccagacattgtggcatgtatctgtagtcccagctactcaagaggctgaagtgaaggatcacttgagcctgggaggttagggctgcagtgagctgtgatggtgccactgcactccaggctgggcaacagagtaagaccctgtctcaaaaacaaaacaaaacaaaaaaacactatgaaagtgtggtagctttgaagccaagtgaaaaattggtcctccagaaaaaacaacccacagaatgggagaaaatatttgcaaaccatacatctgaaaagagcttaatatcaaaaatatataaggaactcaaacaactcaaaagcaagaaagcaaataacctgatttaaaaatgggcaacaggctcagcacagtggctcatgcctgtaatcccagcactgtgggagtccaaggcgggtggatcacttgaggtcaggagtttgagaccagcctgaccaacatagtgaaaccccatctctactaaaaatacaaaatgagccggacgtggtggcgcatgcctgtaatcccagctgcttggaaggctgaggcaggagaatcgcttgaacccaggaggtggaggttgcagtgagctgagattgcgctattgcatgccagcctgggaaacgagtgaaactccgactcagaaaaaaaaaaagggcaacagatccaaaaagacattccaaaaagaagcagaggcttatgatctaataattaattaaaggtcgtacctcttaacattgttgcattggggattgtttcccacacttgatctttgggggacacattcaaaccactgcaaatattattcacaatagcctcaagatacagaattgacttgtgtccatcagtggatgaatggataaagataatgtggcatatatgtacacagtagaatactactcagtcttaaaaagaaagaaacagtcatttgttacaatgtgggtgaacctggaggaccttatattaaagtgaaataagccaggcacagaaagataaatattacattatctcacttacttgtggaatataaaataatttcaactcaaaagtaaggaatggaggccaggcatggtggctcacacctgtaatcccagcactttgggaagccgaggtgggcagattgcttgacctcaggagttggagactagcctgggcaatatggtgaaactgagaggagaggagaaggggaggggaggggaaaggaaaaaggaaaggaaaggaaaaacagtggttaccagggtgtggggggattggggagatgttggtcaaaggatacaaaatgtcagttagataggaggaataaattcagatctatagttaataacaacgtactgtattcttgcaaatggctgagaatagattttaagtgtccttaccagaatatgatacgtatggtaatgcatatgttaattaagttgatttagccattccgtaatgtatacgtatttcaaaatatcatgtcgttaaaaaagaaagagagaattggccaggcgcagtggctgacacctgtaatcccagcactttgggaggccgaagaaggcgaatcatgaggtcaagagattgagaccatcctggccaacatggtgaaaccccgtctctgctaaaaatacaaaaattagctgggcatggtggcgcatgcctgtagtcccagctacttgggaggctgaggcaggagaatcgcttgaactcgggaggtggaggttgcagtgagccaagattgcgccactgcactacagcctgggcgacagagcaagactctgtctcaaacaaaaaaaaaaaaaaaaaagagagaatttagttctcagataacagaattgttgattgctctagaagctgctggcaggtcaagtgggatgagcactgggaattaaccatcagattccataattggatggcaccgtaaacagggaaaacataatgaaagtggagaagagtaagctttagaccaaacactttaagtggttgaactttgtcctcaacaggagaaagaagcccagttccaaatttaaattacaggggagatagcatgaaaatgtcaaggcaacaatgttcccagggcgcataatgggtttttctgtgtgtgcatgtgtgtgagtgtgctttgatcgcaggtactgagcttcctgctagtgggagggtccatgaatgtcttggctattgaggccccacaactctgagggttaaaaagtcaagtggattaaaatggatctgattttcatgttacagagagaacatattagtttttttgctgtactaacttcttagtacagactaaaagagcagatcagtttaatgaaaagacaagaaaaataaatcaggaaaggattcagagaagtgggatttcaatttggccttaagggaggacaggatgttgaaaggtggaggagagatgtggtatctcaggtggagaaacaaccagggcagtggcaatagtgcacctgagaggcggcttggctgagtgtgggcatccactggagagagatgggaaatcattcaggaggtatcagtggaggctgggttctggtaggttgtgaaaatcaggccgtggtgtttgggcttggcatccttggccagggtggtaaatggaccattttctgctataactacctatggtagttacaccaacatgggatgacaagactttttttctgctgaacttggatatggtcttagaaatggctcttcagataatcattactggcaatcaatatgaaacttactaccaatctggtggtaggcaaaaggaagcaaatgcaggttttctcaatcagtaaggacataataaatgtggtgtttaagaaatattgatatttaggataggtcagctagaggctgttgctaagtatataatgctgaggtcactagaactcagcagacaaacttggggaaagtttaataatttgatgataatattagagtttttctctgcactggtaagaaatttcagttaggttattgtgtcaggtccctttgtgagaaaaacagtctcattttggcttgtcaagttacagtggcttgagagtagataaggatagtatattatgattcttctttatttcctcttctgttttttttttttgttttgtttttttgttttttttttgaggcagagtctcgctcttgtcatccaggctggagtgcagtggtgtgatctcagctcactgcaacctccgcctcttgggttcaagcaattctctgcctcagcctcccaagtagctgggattacaggtggccgccaccatacctggctaatttttctatttttagtagagggagggtttcaccattttggccaggctggtattgaattcccgaccttgtgatccacctgccttggcctcctgaagtgttgggattacaggcgtgagccaccgcacctggccccctgcatttttttttttaagacagtgtctcattctgttgcccaggctgtattacagtggtgccatcataactcactgaagccttaacctcctggctcaagtgatcctcccatctcatcctcctgagtagttgaggctacaggcacgaaccagaatgccagcttttttttttttctcttaactactttttctcctttttttttttttttaatttaaattctggggaacaggggcagaacatgcaggtttgttacagaggtatacacgtgccatggtggtttgctacacccatcaacctgtcatctacattacgtatttctcctaatgctatccctcccctagcccccaacccctgacaggccccagtgtgtgatgttcccctccctgtgtccatgtgttctcactgttcaactcccacttataagtgagaacatgaggtgtttggttttctgttcttgtgatagtttgctgagaatgacggtttccagcatcatccatgttcctgcaaaggacatgaactcatcctaatttatggctgcatagtattccatggtgtatatttgccacattttctttatgcagtctatcactgatggccatttgggttggttccaagtctttgctattgtgaacagtgccacaataaatatacatgtgcatgtgtctttatagtagaatgatttataatgctttgggtatatacccagtaatgggattgctgggtcaaatggtatttctagttctagatccttgaggaatcgccacactgtcttccacaatggttgaactaatttatactcccaccaacagtgtaaaagcattcctatttctccacatcctctccagcatctgttgtttcctgactttttaatgatcaccattctacctggtgtgagatggtagctcattgtggttttgatttgcatttccctaatgaccagtgatgatgagctttttttcatgtttgttggctgcataaatgtcttcatttgagaagtgtctgttcatatcctttgcccactttttgatggacttatttttttcttgtaaatctgtttaagttctttgtagattctatatattggccctttgtcagatggatagattgcaaaaattttctcccattctataggttgcctgttcactctcatggtagtttcttttgctgtgcagaagctctttagtttaatcagattccatttgtcaattttggcttttgttgccattgcttttggtgttttagtcatgaagtctttgcccatgcctacatcctgaatggtattgcctaggttttcttctagggtttttatggttttaggtcttacgtttaagtctttaatccatcttgagttaatttttgtataaggtgtaaggaagggatccagttccagctttctgcatatggctacccagttttcccaacaccatttattaaataaggaatcctttccccattgcttgtttttgtcaggtttgtcaaagatcagatggttgtagatatgtggagttatttctgaggcctctgttctgttccattgatctatatatctgttttggtaccagtactaggcaattttttttactgtagcctcgcagtatagtttgaagtcaggtaggtagtgtgatgcctccagctttgttccttttgcttacgattgccttggctacgtgggctcaatacccctgatgaacattgatgcgaaaatactcaataaaatactggcaaaccgaatccagcagcacatcaaaaaagcttatccaccaagatcaagtcggcttcatccctgggatgcaaggctgcttcaacatatgcaaatcaataaatgtaatccatcacataaacagaaccaatgacaaaaaccacatgattatctcaatagatgcagaaaaggcttcgacaaaattcaacagcccttcatgctaaaaactctcaataaactaggcattgatggaatgtatctcaaaataataagagctatttacgacaaacccacagccaatatcatactgaatgggcgaaaactggaatgaaggattctttttattttttatttttttttattttgagatggagtctcgctctgtcccctaggctggggtggagtgcagtgtcgccatctcggttcactgcaagctccaactcccgggttcacgccattctcctgcctcagcctcccgagtagctgggactacaggggcctgccaccatgcctggctaattttttgtatttttttttttttagtagagacagggtttcactgtgttagccaagatggtcttgatcttctgacctcgtgatccgcccgcctccgcctcccaaagtgctgggatccatgcccggccaaaagcattccctttgaaagccggcacaagacaaagatgccctctctcaccactcctattcaacatagtattggaagttctggccagggcaatcaggcaagagaaagaaataaagggtattcaattaggaaaagaggaagtcaaattgtctctgtttgcagatgacatgattgtatatttagaaaaccccatagtctcagccccaaatcttcttaagctgacaagcaacttcagcaaagtctcaggatacaaaatcaatgtgcaaaaatcacaagcattcctatacactaataacagacaaacagagagccaaatcatgagtgaactcccattcacaattgctacaaagagaataaaaatacctaggaatacaacctacaagggatgtgaaaaatcttttttttttttttttttcagttttatgtagagactaggtatcactatgttgtccaagctggtctcaaagtcttgggttcaagccatcctcctgcctcagcctcccaaagtgttaggattacagaagtgagcttcggcgcccagcctgtattactttcctttttctttctttctttttttttttgaaatggagtctccctctgttgcccaggctggagtgcagcgatttctgctcactgcagcctcacctcttgggctcacgtgaccctcccacctcagcatccctagctgttcaaatttattgtccaactcttttgaatcgtttatcaacgcaaatctgtcaatgcccacttatttttatttatttttttgaggcggagtctcgctctgttgtccaggctggagtgcagtggcgcaatcgcggctcattgcccctccgcctccccggttcaaacgattctcgtgcctcagcctcccaaatagctgggattacaggcgcgcgccaccacgtccggctaatttttgtatttttagtagagacggggtttcgccatgttggccaggctggtttcgaactcctgacctcgggtgatccgatcgcctcggcctcccaaagtgctgggattacagacgtgagccaccgcgcccggccctcatgaacttattctttagcgtttcattttgagagcgggattcacaagggaattgcggaaacagcagcgaggccccgcgacccctcggcccacgtgcgcgctgtccctcgggtcgccccgcgcccgccgggggcggagtccgctgtgacgcgtgcagggcggcgcgctcccggaagtgacgcgcgacggttcgtgcgtgcgtgcgggcggctgcgtcgggctgcaggagaagatggcggtctccacaggtcggttcccgggccgggctgcgtgattttccgctccgacccggctctgcccctccgtctgctgctggcgcccgagcgctgaccgtgcgggagaagcccgagtgcgctgtctcgaatgccgcgctctccgcagagcgtagcctgggaccgggtgggaccggcgccgaggccccggcggccgtcgggttggcgggtcgtgctcgcgcgtcggccgcgcgccggcgggctgggggcggggtggctcccgcgcgggcgcccccgtaggttccggcgggcgcgggtccgagttgtaggctgaaggctctacgggagggaggcgaggaggcccaaggtgggcgggtgtcaacctccggcaccgaagatgggtcaggccaaccggcaccgaagatgggtcaggccaagaggtgtcctggatcagagtaggggtcccattcctttggactctccttgacatgggttggggagtagaggacgattgctccttaaaataagagcgagaggatctttcttacctgactgaatacgtgtgatctttttattatttatgaggaaaactgcagtgcaaacaaaataaaagaccagagcaagatgaaagctaattgaagaacaagtggtttcttagataagctgttcaactcctctttcctactgaatacaatgtttggtttcctgtgagcacacaagtattaacgttgaggttttagacattagaccatttcagaaatgttaaaaacgttaagctttagtttacatttaaaaatgttaacccgtgtgatctgcctttttcttttcttttctttttttttttttttttgagtcagaggctcaccctgttgcccagttggaatgcagtggtgtgatctcggctcactgcaacctccacctcccaggttcaagtgattctcctgcctcagcctcccaagtagctgggattacaggcgcgtgccaccaggcccggctaatttttgtatttttagtagagacggggttttgtcatgttggccagactggtctcgaactcctgacctcaggtgatccgcccacttcggcctcccagagtgctggaattacaggtgtgagccaccgcgctcggcctgatctgccttttcctagtcttcgttgaaacaagagtatagagcagtgtgatttaatagtttatgccatcattgcataataaaatgaattttcaaatctatatgtactgaaatggaaggctttgaatatatgttgtaattgttgctttagagtaatacctcaggatacattctgcatacattttaattaagtggtgtcttttacatctttattacatataggtgtcataggttttaagatctttagcagttctagtgttggggtagtatacatacttgggtcagctagctagtaaggcaaggattgttttaaaagtggaattttagtgttatgactttactgtgcttgctgaaatctaatctgtgctcgttaacggggccatatctttataacagttgtgcttaggacctcttatagatttttgaaaatttagtaataaaataatgcattttaatttaatacttttcattttccttttgtgggttgcattattaaacacaattttttcataacactatacatgagtgtatgttaatattttgaaaagaccaaaggttagatgatattaatggcaaatactttttgttaatcacttttagttgttttggaagttgaatataaattataaagattactgataaattattagcatattgtacatagggagtctgtattttttttttttttttgagatggagtctcgctgcattgcccaggctggagtgcagtggcatgatcttggctcactgcaccctcctcacctcaggtgatccacccgcctcagcctcccaaagtgctggattacaggggtgagccaccgttcccatctactagttttttttttttttttttttgagacgcagtcttgctctgtcacccaggctggagtgcagtggcgcgatctcggctcactgcaacctccgcctcccgggctcaagcgattctcctgcctcagtctcctgagtagctgggacaacaggcgcgtgccaccatgcccagctaattttttgtatatttagtagagacggggtttcaccatattggccaggatggtcttgatctcttgacctcgtgatccggcctcccaaattgctgggattacaggtgtgagccactgcgcctgggtttgtttgtttttttttttttttgagactgagtctctcgcttctttgcccaggctggagtgcaagggcatgatctcggctcactgcaacttccacctccctggttcaagcaattcctctgcctcagcctcttgagtagctgggattacaggtgcatgccaccacgcccagcaaatttttttgtatatatatattttttttgtatttttttttttttttttagtagggacaggttttcatcatgttgtccagactggtctcaaactcctgaccccaggcaatccgcccaccttggcctcccaaagtgctgggattacaggtgtgagccacagtgcccagcctattaattagttttaattttactattagctatacttttgtttgctttttggtaacatgggaagtaaatagtacctgtgtatttgtgaaagcagcatgatacagcttaaaatttaaaattagatgagctacatcgatgtaatgcacgtgtttgtttgaaacggagtctcgccttgttgctcaggctggagtgcaatggtgcgatctcggctgactgcagcctcttcctcctgggtttaagcaattctcctgcctcagcattctgagtagctgggtttacaggcatgcaccaccacgcccagctaatttattgtatatatattttttctagtagagatggggtttcaccatgttggccaggctggtctcaaactgctaacctcaggtaatccatctgctccggcctcccaaagttctgggattacaggcataaaccactgagcttggtctaatacacgtgttttttatttaagccaaagtatctcgataacagttgtttaagaggccaaaaagaaaaaccctgacaaatatgttttgatctttagttcagtgtgcatcatataccttagcccctttaacccttccttctactggaagagaattttggaaggaaaaaacttttaattagactgagactttttgagacggagtcttgctgtgttgcccaggttggaatgcagtggcatgcgatcatggctcactgcagcctcgacctgctggggtcaggtgatcctcctacctcagcctcccgagtagctgcgaacacaggcacgcattgccacacctggctaatttttaaattatttgtagagacagggtctccgtatgttatccagtgtagtctgaactcctggactcaagtgaccctcctgccctggcctgaggttaggattacaggtttgagccactgtgcctggccagacggagacttctaagcagaaacatttttggccatcccatctggtcttcttattttgcagatgagaaaactgaggctcaaacaagtaaaaggctatacataggtggttactagtacaggcaagactagaatccaggtcttttacccttagtctgatgcgctctccattatgaagaactctgaatttggaatatttctcagaacatgaatcttaattactccctttcacacttcccttcttagcacaatccttgtttcagactcttagatccttcttatggatgaaaggggaacgtagccctcaccagctaggttctccttttccaagagacagagttacccatgcaattcaagagtatttcacaggacagaggttaagaagctactctcgggaatagaaatttgatactgtttagtactcatgattcaaaattttattagattccagcattaataataacaattagtttagatagaaaagtatgtgcaggccgggtggggtggctcacacctgtaatcccagcactttgggaggccgaggtgggcggattacctgaggtcgggaggttgagaccagctggaccaacatggagaaaccatgtctctactaaaaatacaaaattatccgggcgtggtggcacatgcctgtaattccagctactcggaaggctgaggcaggagaatctcttgaacccgggaggcagaggttgtggtgagccgagagcacgccattgcattccagcctgggtaagaagagtgagactccatctcagaaaaaaaaagaaaaaaagcgtgtgcaatagttttaaaaaaatacaatagttttagttttacagaaaagttgtgaagatagtacagaaagtttccatgcacctcacattcagttttccctgtcaatttcctttttttttctttcgggatggagtcttgctctgtcgcccaggctagagagcagtggcgtgatctgggctcactgcaacctctgcctcctgggttcaagtgattctcctgcctcagcctcccgagtagctgggattacaggtgtgtgctgtcacacccggataattttttgtatttttagtagagacagggtttcaccatgttggccaggctggtttcaaactcctggcctcatgatccgcccgccttggcctcccaaagtgctgggatcactggtgtgagccactgcatctggcttcgctgttaatttcttatattggtatggtacacttgtcacaattaaggaaccaatattgacacatttattattaactaaagttcagatttccttagtttttctttaatgtacttttgctgtcctaggacttcatccaggataccacattacattgtaacgtgaaactttttttttttttttgagatgaagtctcgctctgtggcccaggctggagtgcagtggcgtgatcttggctcactgcaagcactgcctcctgggttcatgccattctgtggcctcagcctccgaagtagctgggactataggcgcctgccaccatgcccggttaattttttttgtatttttagtagaagtggggtttcaccgtgttagccgggatggtctcgatctcctgacctcgtgatccatccgcctcggcctcccaaagtgctgggattacaggcgtgagccaccgcgcccggcccacatgaaacgttttacatttatcacttaggtaatattaatggtacagtgaagctctagtctctgactgtagatgcctggaaaatgtctttgagtaatgagaaactcagaaaaaattgatgaaagaatatgttttctgctatgtaggcagaaaacaaaaccaaaatataacctactaattgccttcttcagaagtgggtagcattgtatatactggaagaactagtttagcagtgttctgagttccctgctgcccctgacagactactgtgccaccatgggcatgtcagttaatcactaaacattgcttttcccatcccatctgtgaaaagattggacaacatcatcttgttttcctctttagatgaagatacttggatatggacagaactcgggtgtggtgatagaagagaattacatagtttaaatcataacctagaacttgggaactaaacgatagaagagctgaactatggtagtctagtgtatttccctcttgaggcttccataactggcctggttgatttttctaggtcatttgggagcctgaattctcttgataaacatgcttttgataatatggtacaacctcactgtacaggcagtcctttgaacggcagttggcagaggtaaaaatggccatgcaaaaaactacccaaagcagtcttaataattgggaaaattatggttattctgagaccttcaaaaatgtcaacacattaagaactctccctgtttagaaatatgcaggaaagggccgggcatggtggctcacgcctgtaatcccagcactttgggaggctgaggggggcggatcacgaggtcaggagatgggagaccatcctggctaacacagtgaaaccctatctctactaaaaatacaaaaaattagccgagtgtggtgatgggcgcctgtagtcccagctactcgggaggctgaggcaggagaatggtgtgaacctgggagtcgaagcttgcagtgagctgagattgctccactgcactccagtctgggcaacagagagagactctgcctcaaaaaaaaaaaaaaaaaaaatgtgcaggaaaatgaaaccagtaaaattaatatttagtatgtcataatttaaagtatcagatattaagaattaaaatgttttatttcattaaaaaaagcttgttggctgggcgtggtggctcacgcccgtaatcctagcactttgggaggccgaggtgggtggttcacgaagtcaagagatcaagaccatcctggctaacatggtgaaaccccgtctctaccaaaaatacaaaaaactagccgggcgtggtgacaggcacctgtagtcctggctactggggagactgaagcagtagaatggcatgaacccgggaggcggagcttgcagtgagctgagattgtgccactgcactccagcccgagtgacagagcgagactccatctccaaaaaaaaaaaaaaaaaaaaataaggcttgtcaagagtagcttgaggctgggtgcagtggcttccacctgtagtcccagcactttgggaggtcgaggtgggtggattactagagcctaggagttcaagaccagcctgggcaatacaagaaaatcccatctctacaaaaaatgcaaaaattagctgggtgtggtgatgtgcacctgcagtcccagctacttgggaggctgaggtagagtatgggttgagcctgggaggttgaggctgcagtgagctgtgatcgtgtcactgcactcctgcctgggcgacagagcaagacactgtgtcaaaaaaaaaattaatttgaacaatgcttgctaatgttttgaagtacattatctgtacattgtggaatggttaaatctagctaattaccaaatacattatctcacatagttatcatttttgtggtgagaatacttaatagctactgagtatttttcaagaatacagtatgttgttaactaatcaccatgctatacagtagtgctcttaaacttgttcctcctgactgtaattacgtatcctttgtctaacatcttcccaatccccacccccgtaaccccaaccatcctaacctctggtaaccaccatctcctgtctacttctgtgagatcaattttgactccatatatgagtgagataatatgtatttgtctttctgtgcctgtgttatttcagttaacataatgttctccaggttcatccatgttgttggaaatgagagaatttccttcttttttatgattggaacagtgtcccactgtatacgtataccacatgttctttatccatttgtctgtgtggttttttttttttttttttttgagacggagtctcactctgtcacccaggctggagtgcagtggcgcgttctcagctcactgcaacctccacctcctgggttcaagcaattctcctgcctcaggctccctagtagctgggattactggcacccgccgccaagcccggctaatttttgtattttagtagagatggggtttcaccatattggccaggttggtctcaaactcctgacctcaagcaatccatctgcctcggcctcccaaagtatggggattacaggcgtgagccaccgcgctcagcctatccatttgttggttgatggatacttaggttgattctatatcttgcatattttgagtagtgctgcaataaaatgggagtgcaggcctctctttgacatactgattttattttctttggctatatatgcagtagcaggattactggatcatacggtagctctgtttttaggtttttgaggaactccatactcttctttctccatatggttgtactaattcacattcccaccaacagcatgcttagattatcctttatcaccacatactcaccaacacttgttatctgtcatctttttttttttgagacggagtttggctcttgttgcccaggctggagtgcaatggcatgatctcggctcattgcaacctccacctcctgggttcaagcaattctcctgcctcagcctcccgagtagctgggattacagccacgcaccaccatgcctggctaattttgtatttttattagagacggggtttctccatgttggtgaggctgctctcgaactcccaacctcaggtgatcttcccaccttggcctcccaaggtactgggattacaggcgtgagccgccgtgcccagcctttttttttttttttttttaattgagacagagtctcgctctgtcgcctaggctggagtgcagtggcgagatgtcagttgactgcaacctccacctccaggttcaagcgattctcctgtcttagcctcccgagtagctgggattacaggcacccgccaccatgcctggctaattttcatattgttagtagagacatgatttcaccatgttggccaggctaggctggtctcaaacgcccgacctcaggtgatccacctgccttggcctcccaaagtgctgggattacaggcgtgagccactgcgcttggcctcatctttcatccttttgattatagccattttaatgggagtgaggtgatacctcatgtgggtttttttttgcatttctttgatgattagtgatgttgagaatttttttcatatacctcttggccatttgtatgtcttttgagaaatgtctattcagatcttttacccatttttacatgaggttattttcttggtattgaatggagttccttatatattttggttattaaccccttatcagatatatagtttacgagtatagtgaaccattctgtatgttctctctctcttttttttttttttggtggagtttcgctcttgttgcccaggctggagtgcaatggcacgatctcagctcactgcaagctctgcctcctgggttcaagggattctcctgcttcagcctcctaagtagctgggattacaggcatgtgccaccatgcactgctaattttgtatttttagtagagacgggatttctccatgttggtcaggctggtaataaactcccgacctcaggtggtctgcctgcctcagcctcccaaagtgctaggattacaggcgagagccaccgcgcctgccagttctctctttattgtttcctttgcagtgcaggagatttttagttttatgtgatccaaattgtctgtttttgcttttgttgagtgtgcttttgaggtcatatcctccaaaaatcattgcccagaccaatgccattgacttttcttcctgttttctagtagtttcatagattgcctttttttttttttttttcctgagacagtctcaacctgtcacccaggctggagtgcagtggcatagtcacggctcgctgcagcctcaacttcccaggctctcacctcagcctcccgagtagctgggactacaggtgcacgccaccatacctggctaatgttttgtatttttagtagagatggggtttcgccatgttggccaggctggtctcgaactcctgacctcaggtgatccacacgcctcggcctcccaaagtgctgggattacaggtgtgagccaccatgcccagctgcacaatgcccaattttgccacttctgttcaacataatactggaagtcctagaaagagcaataagacaagagaaagaaatacaaggcatcttaattggaaaagaagttaaactgttcctgtttgcagaagacatatgatgtcagtgtttattgttataaaaacttctgtcttaaaactgcttttgctgtattccataggctttgtatgctgtgtgtttcagttttcatttttttcaataaacttcctaatttgttttttaatatcttcattgacctattggttgttcaagagcatgtgtttaacttccatgtttttgtgaattttctgaagatcctcctgttaatgatttctagttttataccattgtggtcagaaaagatatttgatatgatttccatcttcttaaatttgttaagacttattttgtggcttgacatatgatctatccttgagaatgttccatgtgcagcttaaaataatgtattatgccactgttgaatggtatgttctgtgtatgtcttttaggtccatttgttctatagtgtagcttaagtctcatgtttccttgttggctttctgtctgcatgatctgtgcattgctaattgtgaggtgtgaaaatctcctactgttactgtagtacaacctatctttcagatctgttaatatttgctttatatatttaggtgctttgatgttgggtgcatatatatttacaattattctcttgctaaattgacccctttgttattacataatgaccttctctatcttttttttacagtttttgatttaaaaatctattttattgggggccaggcatagtggctcatgcctgtaatcccagcactttgggaggccgaggcgggcggatcacttgagatcaggagttcaagaccaacctggccaacatggcgaaatcccatctctattaaaaatacaaaaattggaccaggagcggtggctcacacctgtaatcccagcactttgagaggccaaggcaggtggagcacgaggttgggagttcaagaccagcctggccaaaatggtgaaaccccatctctactaaaaatacaaaaattagccaggtgtggtggcgggcgcctgtgaccccagctacttgggaggctgaggcagagaattgcttgaacctgggaggcagaggttgcagtaagccgagatcacggcactgcactccagcctgggtgacagaacaagactcctgctcaaaacaaaacaaacaaaaattgggcgtggtggtgggctcctgtagtaccagctactcgggaggctgaggcaggagaatcgtgtgaacctgggagtcgggagattgcagtgagccttgattgcgccactgccctccagcctgggcaacagagcgagactgtctcaaaaaaacggcagggcatggtggctcatgcctgtaatcccagcactttgggaggctgaggctggcggatcatgaggttaggagtttgagaacagcctgaccaacatggtgaaaccccgtctctactaaaaatacaaaaattagccaggcgtggtggcacatgcctgtaatcccagctactcaggaggctgaggcaggagaatcacgtgaacctgggaggtggaggctgcagtgagccgagattgcgccactgcacttcagcctgggtgacagagctagactccgtttcaaaaaaaaaaattagccaggcatggtgccatatgcctataattccacttgggaggctgaggcaggataattgcttgaactcaggaggtggaggttacagtgagccaagatcctgcgactgtactccaacctgggcaacagagtgagtgagactctgtctaaaaagaaaaacaaaaataattttatctgatataagtgaagcaattcttgggctttctctctctctgtctctctttttttttttttttgagacaaggtctccctatctaggctagagtgcagtggcgtgaacatggctcactgcagccttgaactattgagatcagtgattttcctacctcagcctcctgtgtagctgaccacagatgcatgccactatgccttgctaattttttatattttttgtagagatggggtctcaacatgttgctcaggatgctttcaaactcctgggctcaaacaattttccctccttggcctttcagaatgctgggattatagggtcttgttctctcttgatttccatttgcatggcatatctttttccattccttcaccttcagtctacatgtgtccgtacaggtgaggtgagtcttttattggcagcatatagttgggtcttgttttttttaaccattcagtcactctatgtcttgattaaataatttaattcatttacatttagagtaattattgatagatgagttaatactgccatcctgttaattgtttcctatttgttttgtagctcctttcttcctctcctatggtcttctttggtggttgattttctctagtagtatgtttttgattcctcgcctttttattttttgagacagtgtgttgctctgacctggtcatagctcactataacctccaactcatgggctcaagccgtcttcttgcctcagcctttggagtagctaggactataggtgtgtgccaccaaacctggctaattttattttcttgtagatacggggtcttgccatgttgcgcaagcgggtttgaactcctgggctggagtgatcctcctgcctcagcctcctgagtagctaggaatgcaggcatgtgccacgatgcccagctaattttttttttttttttaatttttgtagagacaacgtcttgctatattgcccaggctagctttgaactcctggcctcaagtgcttctcccaccttgggctccagagcactggggtttcaggcatgatccactctgctggcttgttattgctttttatgttttatctattataggtttttttttttttttttaagatggattttcactcttgtttcccaggctggagtgcaatggcgtgatcccggctcactgcaacctctgcctcctgggttcaagcaattctcctgtctcagcctccttagtagttgggcttacaggtggccgccaccacgcccagctaattttttgtatttttagtagagacagggtttcactgtgttggctaggctggtctcgaacccttttttttttttttttttttgagacggagtctcgctctgtcgcccacgctggagtgcagtggtgcaatcttggctcactgtaagctctgcctcccaggttcatgccattctcctgcctcatcctcctgagtagctgggactacaggtgcccaccaccacgcccggctaatattttgtatttttagtagagatggggtttcaccgtgttagtgaggatggtctcaatctcctgacctcgtgatctgcccgccttggcctcccaaagtgctgggattacaagcgtgagccactgcgcccggccggtcttgaactcttgacctcaggtgatccacccacctcatcttcccaaagtgctgggattacaggtatgagccaatgcgcctggctctctttttttttttgagatggagttttgctctgtcacccaggctggagtgcagtggtgtgatcttggctcagtgcaacctctgcctcctgggttcgagcaattctcctgcctcagcctcctgagtagctgccattacaggtatgcgccaccatgtctggctaatttttagtagagaccgggttttaccatgttggtcaggctggtctggaactccttacctcagatgatccacctgcctcagcctcccaaagtgctgggattgcaggggtgagccaccacgcctggcatataggtttttgctttgtggttaccatgaggcttacagaaaagatcttacagttacaaaaggttattttaaactaataacaacttagccttgatggcctaaaaaatcctttatacttttaccctactctcccattttgaatttttgatgtcacagtttggatctttttttttttttggagacagtgtcgttcttgtcacccaggctggagtgcaatgatctgatcttggcttactgcaaccttcgcctcccgggttcatgtgattctcctgcctcagcctcctgagtagctgattacaggcggctgccaccacaccccactaatttttgtatttttagtggagatggggtttcaccatgttggctaggctgctctcgaactcctgacctcaggtaatccacctgccttggcctctcaaagtgctgggattacaggcatgaaccaccacgcccagcctgcatctttttatattgcatattcctttacaaattattgtagttactttcaatagttttgtcttttaaccttcctactaaagatacaagtaatttacactccaccattacagtattagtgtattctgaagttgaccttgtgtttacttttcccagtgagttttatactttcagatgtttttgtgttactcatcagtatccttttctttcagcttgaagaacttcccatagcatttcttgtaaggcaggtcttgtggtgataaactccttcagcttttgcttgcctgagaaagtctttatcctttgtttctgaagaacagctttgtcctgggacagacagctttgtctaaaggacagattttttcctggtcgcatttttttttttttttaaagagagacaaggtctgttgcccagactggtcttgaactcttgggcttaagtgatctgcctgcctcagcctcccaaagtgctggggttacaggtgtgagcccagcccctgcgagcgctttaaatgtatcatctcactctcccctggcctctaagttttctgttgagaagtctgctgctaggtatattggaagtctcttatatgttatttgcttcttttctcttgctgccttgaggattctctctttgtctttgatctttgacagtttggttataacatgtcttggagtagtcttatttgggttgaatctggttggagacccttcaacctgtagccatatacttataactttctccatatttgtacagtttttttgctactttttctttagatatacttttttttttttttgagacagagtattgctctatcgccaggctgtagtgcggtggcgcgatcttggctcactgcgacctccgcctcctgggttcaagtgattctcctgcctcagcctcctgagtagctgtgactacacgcacgcaccaccacgctcagctgatttttgtatttttagtagagacggggtttcaccatgtttgccaggctggtcttgaattcctgacatcaggtgatccacctgcctcggcctcccaaagtgctgggatcacaggtgtgagccaccatgcccagcctaacatgaaacttgatagaagtggatatgaggcattcaaactagaataaacagtaacattcagtgttcaggctgggcgcgcagtagtggcttacgcctgtaatcccagcactttggaaggccaaggcaggaggatcacttgaggtcaggagtttgagaccagcctggccaacatggtgataccctatctctattaaaaatgcaaaaaaaaattagccaggcatgatggtgcttgcttatagctccagctacttgggaggctgaggtgggagaatcacttgaacccaggaggcagaggttgcattgagccaagattgcgccactgtactccagcttgggtggcagaatgagaccctgtctcaaaaaaacaaacaaaaaaaatcaatgtttgaaagtttgtttcaaacgtagttcactttttcaaaggctctttttcaaagagctgattaaaataagtttgacatatgtaagatgggacttcaggactgggtttgggagtgctttattcttgtttataaagtcttagctgatttgtgtgagagcagatggtattttcagtaagctggaactcagcagctgtttcaagccttagaaggagataaatccttgtggctgtgtataggtacttttaaatagaaatagaaaaaacagtttaatagaatatatgttatggattgcctggactctagaccaagttcattttatagatgagcagtagaaatacagatatgaaatggcttttgcaggattttttagctagatgttgagtccagagctggtatcttgatttaagactcttggctgggtatggtagctcatgcctgtaatcccagcactttgggaggccagggtaggtggatcacctgaggtcaggagttggagaccagcctgaccaacatggagaaaccccgtctctactgaaaatacaaaattagctgggcatggtggcacatgcctgtaatcccagctactcaggagactgaggtaggagaatcgcttgaacctgggagatggaggttgtggtgagccgagatcgcgccattgcacaccagcctgggcaacaagagctaaactccgtctcaaaaaaaaaaaaaagagattcttaaatactgcttctgtatcacactgtatcctacgtatgccttggttgcttttatttcctggaaacccagtgatgttattttacagataaatgctgttaaggatcaagacaaaatacttgatagagtctaaaggcattaatagaatattaaaactccatgttcttttaaggtgtgaaggattttattgaaatgagtaacaaaaatttagaaaaagcgatttcagtggctaaatgctggtcaatattcacataaatcttttttgtaagcacatatttggtattgcaggtaaatacatatatattatttgttcccttactgatttttttttttttttttagaacgagtcttgttctgttgcccgggctggagtgcagtggtgcaatctcagctcactgcaacctccgcttcctgggttcaagtgattctccagcttcagcctcccgagtagctggaactacaggcgtgtgccaccacgcccggctagcttgttgtatttttagtagaaacggggtttcaccgtgttagccaggagatggtctcgatctcctgaccctcatgatctgcctgcctcggcctcccaaagtgctgggattacaggcgtgagccaccatgcctggccagtgattcttataaatctgtgattttcttttcttttcttttttttttttgagatggagtctcactctgtcatccaggctggagtgtagtggtgcgatctcggctcactgcaacttgtgcagggttcaagcaattctcctgcctcagcctcctgagtagctgggattacaggtgtgcaccaccacacttagctgattattatttttttttttttgtattttagtagagaaaagggtttcaccatattgaccaggctggtcttgaactcctgacatcaagtaatctgcccgccttggcctcccaaagtgttgggattataggcgtgagccaccgtgcctggcctaaatctggattttcttttttttttctttcttttttttttgagatggagtcttgctctgttgcccaggctggagtgcagtggcgtgatctcggctcactgcaagctccgcctcctgggttcacgccattctcttgcctcagccttccgagtagctgggactataggcacccgccaccacgaccggctaatttttttgtattttttgtagagtcggggtttctccgtgttagccaggatggtctcaatctcctgacctcgtgatccgcctgccttggtctcccaaagtgctgggattacaggcgtgagccaccgcaccgggctctggattttctatctgaggtttatctaagggaggcgagggaaagggaggttattgggagtgttttaagtgtttgatagaaacgtatctctgtatcagaggtagaatttacaacctgatgagttatcctaaacatttcagtattgcagctgttattcctaaagtgaccctttagaatatttagtactgttcctttctttttttttttcattttattcttccttttacctacttccccaagtaggctgcctctagataaaactgtatattatcgggtaggaagaacttggttccaggagttttgggactgggaagattggacaacagctatgtaacccgggcttcttattctctctagggcttatgaagtggttactaaaatctaaagttctatggaaaagggccagtttcctctaggatttgaccacacctttgagggatgcttcataagaaagctgaacttctggtggatggagatgtaaatgaatattgagtttggtttcagggagctgttgtttcaagacaactttactgagatataattcacataccatacagttgtctatttaaagtgtacaattcactgatttctggcatgttcacagatatatgtaactgtggtcattttagaacattttatcacctcagaaagaaactctgtaccctttagctctcactgttctatacctccaaacctcagcccctgactactataatctgtctcaatagatttacccattctgtactttcatatgtgtagatttatatattatgtggtcttttgtgactggcttctttcacttagcgtaatgtttttaagggtcatccatgttgtagcatgtatcagtatttacatgtttttatggctgaagaatattccagtgcattggatacaccacatttttgtttattcattcatcatgttggtggtgttttccaccatctggctattgggaataaggctgctgtaaacatttatgtacacgttccacccccgccccgcttgagtagatacctaggagtggaactgctgggtcatgttaactatgtttagctgtttgaggaactgctaggctgttttccaaagggagacttcttttttttcgagacggagtctcgctctgttgcccaggctggagtgcagtggtgtgatctcagtccactgcaacctcagcctcttgggctcaagtgatcctcctgcctcagcctcccacgtagcttggatgccacgtagcttggatgacaagcctgcgctaccatgcctgtctaatttttgtgtttttagtagagactggattttgccaagttggccgggctggtcttgatctcttgacctcaagtgatctccctgccttgaactcccaaagtgctgggattacaggcatgagccactctgcccgggcccaaaaggagaccattttatattcctaccagcagtatatgaaggtcccagtttctccacatccttaccaacacttattatctgactttgattgtagccattctagtgggtgttaagtggtatctcattgtggttttgatttgcatttccctgataactagtgttattgagtatcttttcatgtgcttactagtttttatttatttatttaattttttgagacaggttcttgttctgttgtccaggctggaatgtagtggtgcagtcttggcttactgcagtctccacctcctatacccaagtgattctcctgcctcagcctcctgagtagctgggactgcaggcacgcgcctttatgcctgggtaatttttgtatttttagtagagatggtgtttcaccatgttgcccagggtggtcttgaattgcttggctcaagtgatccacctgcctcagcctcccagaattgtggcattacaggcgtaagccactgcacctggccctttactggctatttatatatcttctttggagaaatgtctattcagattctttattcattttttttttgtttttgagacggagtctcgctctcgcccaggctggagtgcaatggcgcggtcttggctcactgcaacctctgcctcctgggttcaagcgattctcctgcctcaacctcccaagtagctgggattacaggtgcccaccaccacgcctggctaatttttgtatttttagtagaaatgggatttcaccatgttggccaggctggtcttgaactgctgacctcgtgatctgcctgccttggcctcccaaagtgctgggatttacaggcatgagccactgtgcctggcccctttactcatttttatttatttatttatttttgagctggagtcttgcattgtcatccaggccggagtgcagtgtcatgatctcagctcactgcaacctccatctcccaggttcaagtgatcctcccacgttagcctccagagtagttaggattacaggtgtgtgccaccacacccggctgttttctttttttttttttttttgagacagagtttcgttctcgttgcccaggctggagtgcaatggcgcaatcttggctcactgcaacctctgcctcctgagttcaagcaattctcctgcctcagcctctcaagtagctgggattacaggcatgtgccaccacacctggcgaattttgtatttttattagagatggggtttcaccatgttggtcaggctaatctcgaactcctgacctcaggtgatctgcccacctcggcctcccaaagtgctggaattacaggcgtgagccactgtgtccagaccaacacagctaattttttttgtagttttagtagagacggagtttcaccatgttggccaggcttgtctcaaactcctgacctcaagtgatctgcctacctcggcctcccaaagtgttgggattacaggtgtgagctactgcacccgacccctttacccatttttaaattgggctgtttgtctttttattgttgagttatcggagttctttatgtattctggatacaagtcctttatcagatgtatggtttgcaagtattttctttcattctgtagattgtcttcactttcttgatgttgtcctttggaacccaaaagtttaaaattttgatgaagaccaattaattttttttctacttcatttaaatgcagattctggctttttgtatgtagctcatcatctagctggtactttgttttaaaaacaataatgttcaggccaggtgcagtaggaggccaaggtaggcagatcacttgaggtcaggagtttgagagcagcctgggcaacgtaccgagatcctgtctctacaaaaaaataaaaaaattagctgggcacaatgctgtgtgcctatagttccagctcctcaggaggctaaggcaggaggatcacttgtgcccagaagttcgaggttgcagtgagacatgattgtaccactgcccaccagcctgggcaacagagtaagaccctgtctctaaaatgaacacacaaacatcagagaaccatgtttcatgcaggatatggtcagaaactaaaatataaatgaataaaaacaacctgatgaagtactgtgaattctagttgatgctctggttgtgattactgtatgacagaagggcaggagtctgagctcttcttgccaggtgaggtttaatctcactaaaaaaagttcgatagccagataccatgcatactgtaaacagttttattctttggaagtagtataattatgccagaggtttttcaatttatggattggaatgttcttgaaaagtacagacagtgcattgcttggtgtactgctcttcatgccattgtcatctgctacctaaattattgattgttgtttactaaacagtactgatgtaaatggttatgtcctcagaggaaatacttatgttattgagaagtctttaattttctcaagtttttacctcataaacagtgatttggagagatatctgtttattttgcttaatatggctttctgactgtggaagccagctacagcttcctggactcacaggtgagcagttatgcccatttaatagtctccgttagaagacctcacatcttttaaagtgcatgccatcctaattttacttagaaattaaaactagagaggaaccagaatatattagcttacttaactttcttccactccctagtgtattctaagggaagtctcccttgatagttctgcaataaacattcttagctacctcactggagaatgtgaagtaactgctacattcattggcttatctcattgggatatctgtagtgtatccaggtgaaatcttctgcaataacttactgcattatatttggatgtattcacttacatggttgtcttccccacgagatagtaatgtcctggggaaaggattctgtgttcagtatcagcaacatctgctgtcagtttatacatattgagagaaagattaaaaacaaacatttgccataaattcaccaggtgtttatcaagtgcctgttgtgtcatcattttctatggtacagtttctttctatgtcagagatttaataatgagaaaataaaggactcaagtaaaacctagcttttcaggctgggcgcagtggctcacgcttctaatcccagcatgttgggaggcccaggcaggcagatcacttgagcccaggagttcgagaccagcctgggcaacatggcgaaaccctgtctctactaaaaatacaaaaattagctggatgtagtggcatgcgccagtggtgccagctacttgtggggctgaggtgggagaattgcttaagcctgggaggtggaggttgcagtgagttgagatcgtgtactccagcctgggtgacagagtgagaccctgtcccaaaaacaaaaaacaaaacaaaaactggctaggcatggtggctcactcctgtaatcccagcactttgggaggctgaggtgggcggatcacttgaagtcaggagtttgagaccagcttggccaacacggtgaaaccccgtctctactaaaaatacaaaaattagccaggagtagtggtacatgcctgtagtcccagctatttgggaggctgaggcgggagaatctcttgaacctgggaagtggaggttgcagtgagctgagattgcaccattgcccttcattgtggctctgggccacagagcgagactctgtctcaaaaataaaaaaccaaaacacaaaaacaaaaattagccaggtgtggtggcaggcacctgtaatcccagctacttcggaggctgagccaggagaagcacttgaacctgggaggcagaggttgcagtgagctgagatggtgccactgcactccagcctgggtgacagagcaagactctgtctcaaaacaaacaaacaaacccccccaacaacaacaacaaaaaaacaacttagcctttcctttttgtagattgtaatatttcactgttttatttttagtttgcttttctgaagtaaaactactaaaagaatattttagttcatatatattcattaaatctaaaatcatgaagccgcttattttccccttatctagctgagttaatatctaacaaatagattctaaatgaactctccatataggtggtgattttttggcagtggctgggggtagggtggttttggttacaacctaaagagtaacagtagtatgattaatttctcctgtatgtaatgtattctccacaccacagaattgagatactttgcaaatcctctaatccagaggtttttccacttgtgtttgaaagtgtagtacagatgcttcagatgtacgaagtttgacttgaatttgtttttttcttttttgagacggagtcttgctctgtcacccaggctggagtgcagtgatgtgatcttggctcactgcaacctccgcctcccaaattcaagcgattctcctgcctcagcctcccgagtagaggtgtgtgccaccactctcggctaattttttgtatttttagtagagacgggggtttcaccatgttatccaggatggtctcaatctcctgacctcatgatccacccgccttggcctcccaaagtgctgggattgcaggtgtgagtaaattttgtttttataaattacatttttttctgctatatttcatcaattctaaaacacattgaaatatccgaagtggatatatgtgttgtagtttaattggtagagtgtttaaattttttaaaattatggtatcatgtagttggttatgccatcttagatttgatcaaagacagtatttaaaaaaactgttaagatgcccacattgaggtgaatatataatagatttcaaatactggattctacaaacatactgacgtgttctcatttgttaactgaatactaagcaattgtgatcaatttaaacttaaatgtattctattgaaatatatttttaatctcatacaattttttgaaatattttagaggctaaagttgaaaattggtttatctggtaaaccttcatttcagcaaaagaatattaccttctgattttttttggtgaattatataaatatagtttttagtattaaatctatttgtataaattcacagtgtctgaatgatggatgtatttcaaatttaaagttcagaaaaagtgtagctgggcatggggctcacacctataatctcagtactttgggaggctgaggcaggaggaccccttgagcctgggagtttgagaccagcctgggcagcctagcaagaccttgtctctactaaaaatattttaaaaattagctgcgtgtggcggtgcatgcctgcagtcccagctactctggaggctgacgtggaaggatctcttgagcctaggaatttgaggctgtagtgagccatggcgacagagtccctgtctcaaaacaaacacgcagacacacatgcacacacaccccagcatatgctttgatgtcaataattgtgtattattgacattattgacattattaatgtcaacaaatagtgttcttgagagtggggttgtaactgatgtttttgaaacagccagtgggggttatgggcccagttaggattctggaacagttttcctgagtgtagaactgtggtggggcttatgattcatactcatttctttgctggatgagtgttaaaagcggataggatggcagacccactcagcaaggaattccactgaggatgccttgaaaggagcaggggcataccatccagagcacaagacagagtaaagttatcacatgaaggactcatttgcttgaaaagacttgacttttcttagtgtcctcagatattctaacaactttacaaggcaaaaagactcagtgattttttttattctttttccattttttttttcctgagacggtgtctttctctgttgcccaggctggagtgcagtggtgtgatgtcagctcactgcaacctctgcctcccaggttcaagcgattctcctgcctctgccacctgagtaactgggattatgggctttcaccaccacgctggctaatttttgtatttttagtagagatggggtttcaccgtgttggccaggctggtctcgaactcctggactcaagtaatcctcctgccttggcctcccaaagtgctgggactacaggcatgagccaccacacctggctcattccttgtttttttaaaataaaatttattgtgtgtatttaaggcatatatatcatgttatgagatatataggaaaatggttactatagtgagtcaaattaacatattcatcatcttacagttacctgttttcctccctgtggcaagagcaaaaatcctgactatagcaaactcttattaaaagtcctcatggctgggtgcgggctcatatctataatcctagcactttgggaggccgaggcaggctgatcacttgagcccaggagttcgagactagcctggggagcatggcaaaaccccgtctctacaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgtgatctttcattgtgtgcatagaatgtatagatcaaatctcagggtatttgtggtatccagattcttgactcatgacagatagttaatatatatgagctggccaggcgcggtggctcacgcctgtaatgccagcactttgggaggccaaggtgggcggatcacaaggtcaggagtttgagaccaagcctggccaacatggcgaaaccccgtctctactaaaaatacaaatattagccatgcatcgtggcaggcacctgtaatcccagctacttggaaggctgaggcaggagaatcacttgaaccctggaagcaaaggttgcagtgagccgagatcgtgccattgcactctgtcctgggcgacaagagcaagactctgtctcagaaaaatacgtatataggttatgaagttttaggaagtgacattttgggcatcacagggattggttgtttcttttagaatcagtctatgaaaggataaggctttagaaataatgtgtttcagcagggattctgactagggatagaggtgggggaaggaagcaaagtgataggatttctcctttcttttgcctcttctccccagggcagtgggttgccttcctgtactaggctcttgtgtgttggtcattgagatatattggggtagacaaaaagttgtatgtataccactgatacagtttagtagaagtatgcaaagtataaaaagaaagcactttgctcagtcatctggttaggttcttagtagagcaaaactctcgctttatgatgttacctcctccttcttacgcttctccttctctaattgtggtttctgtgtcttgatgccctgctgaactttaagctccacaagagcaggactttgactatcatggctagatcatgggcctagccacaattctttggctcacagtagacatttggtgctgttaaaatggaaataaataaataaaaccaaagaattacaacagtaaaatgaaccacaactttgtctcagttaactgagtgcttaacacttcttccctgatcatcctgtttcttggtcttttataacagctgatacttttctcctcctcttacctcccaatccattcccacgttgcagcaaagtgaagtttatgcttaaaacccctccctgaatcctcattgctgcagataaaggctgaattgctaagggtgcccttccaggccatttctgactctttgctctcatactcagttgcagtccccaaacattgcccagcattctctctctcttttgtaatgtcctccccacgccttttttggctccacccgtccaatcctcccttttctttttaaataaaatatttcaaacaccaggaaaatacgtgaatacacatatacccaccctggctattcacattctaataaattcttgcttcagattgttttttggaaacagaacatttctagtacatttaaagtcctattttcacttcttagtcctaggccactttctctttgcccagaggtcatcaatatcctgatttttattatttgtatttatttatttattttgagacagagtcggactccgtcacccaaaatggagtgtagtggcgtgatcttggcttactacaacctctgcttcctgtgcaagtgatcctcccgccttagtctcctgagtagctgggactacaggtgcgcaccaccatgcccagctaattttttttttttttgagacagagtttcgctctgtctcccaggctggagtgcagtggcacaatcttggctcactacaacctctgcctcccaggttcaggtgattctcctgcctcagcctcccaggtagctgggactacaggcgcacgccaccatgcttggctaattcttttgtgtttttagtagagatggggtttcaccatgttggccaggctggtctcgaactcctgacctcaaatgatccgcctgcctcagcctctcaaagtgctgggattacaggcgtgagctaccatgtccagccacccagcgagttttttgtatttttagtagagacagggtttcactgtgttgaccaggctggtgttgaactcaagtgatttgcccatctcagtctcccaaagtgttgggattacaggcatgagccaccacacctggcccaataatcctgattttttttttttttttttgagacagagtcttgctctgtcacccaggctgaagtgcagtggcgtgatcccagctcaccgcaacctctgcctcttgggttcatgcgattctcctgccttaggagaatttttagtagagatgggtttgtatttttagtagagacgggtttgaccatgctggccaggctggtctcgaactcctgccctcaggtgatccacctgccttggcctcgtaaagtgttgggattactggcgtgagccaccgtgcctcgcccgacccctgatttttaaatatcttttccactaacacctttatactttttgctacatatgtatatatgtataaaaactatgtttatttatagcttctataccagtttattctaatctcagcagtgaatgaacttccaatatctacacgtttgcccagatcaagaattatcagacttagtatttgtcagtttggtggctagaataagccgttatgattccctgattactgatgaggttgaacatatttttatgtttgttggtcattactgttttctgtaaaccttattcctaatatgttctcattgttctctagggttttcttttccttgttgatttctaggaggaattatttctgtattttgaataacgttcttgtcttctatatgttattcacatcctttttcagtctgtggcttatcttttcatttaatctgcctataattgatttttatgtatactatgagatcagattgggttctaattttattttttcatattggtaaagtgttccaacaccattaacttttcctactttttttttccttctcttttgagacagggtttcactctgtggcccaggctggagtgcagtggtgtgatcacagatcactgcagtcttgacctccctgggctcaggtgatccccaccttctgaatagctgggaccacaggcatgtgccagctaccacacctggctaatttttgtattttttgtagagatggggtcttgccatgttgcccaggctggtttccaactcctgggctcagttgattggcctacctttgcctcccaaaatgctgggtttacaagtgtgagccgccaccatgcccagccttttctacttttttttttttttttcttttgaaataacttcagatttgcagaaaagttaacataagtagtacgaaggattcccatataccttcatgcagatccatcaaatgttgatgtttaacatttttgcttgctcttgtgtgtactctctcttcccccctcccttcacattcgattttgttttttgggggaaccattcaagggtaagttaacagatactgtctcttcacccctacattcttcaactaggacattttcttacaatagaattatcaaaatcaggaaattaatgttgatagaggactattatctaccagccctattcagatttcaccactactgttctttaaagcaaaataatgataataatatttttcctgataccaagattgcatttggttgtcatgcctctattctctttactgacttttagtgttgcctctactaagaagcacattttcatatatgatatgtctgctttggggcttttctttttcattagtctgtccatttctgtactgattccatattttcttaatgatttctttagctgatgaggaagtcttaaaatctaggaaagtgtcccctctgttttttctttttttgttttgtttttgtttttgagacagtctcgctctgtctcccgggcaggggcttgatctcggctcacttcagcctccacctcctgggttcaagcgattctgcagcagccttccaagtagctggttgggattacaggtgtgcaccagcatgcctggcttatttttgtatttttagtagagatggggtttcatcatgttggccaggctgggttttttttttttttttttttttttgagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagccgggcatggtgttgcacgcctgtaatcccagctatttgagaggctgaggcaggagaatagcttgaacctgggaggtggaggttggctcggctacagagcgagactctgtctcacacacacaaaataacacagcaggtgtatgaggaacattaaatgtctttcctaacttactgtatgcaaataaaagtagatacttaagaaattgtctaaaaatatttagtaaacccatttctacacagacaaattaaaagttctgagaaatcaggctaaaatcacctcaaatttataaggtttgattaataaatatttacctttgcatatacacgaaagcaaaaaaaggtaggaatactttcaatttcagataacaataaattgaaatcaagtacaaattttgactccccttcctaaactgaataaactcttaaaaagcagacacactttacttgtgtaaacactcttcttttttttttttttaaatggaatttctctcttgttgcccaggctggtgtgcaatggtgtgatcttggctcaccgcaacctccacctcccgggttcaagcgattctcctgcctcagcctcccgagtagctgggattccaggcatgtgccaccatgcccggctaatttcgtatttctaatagagatggggttcctccatgttggtcaggctggtcacgaactcccaatctcaggtgatctgcctgcctcggcctcccaaagtgctgggattacaggcccagccgtatccactcttttaaatttaggcatccatgtcactggaattatgtttttcacaggatcacttttaaattcattaagaagtttctttatgtatataagcctattcattttacttgaaaggttttctgtcttcccaaagtcaaatccttactaactaaaattaggaattttgaaaaaccatccatgaaaatctcacaaacacattaaaaaatgtattatctaaggtgcataaaattaaactccatattaccaatagcatttaagaaactcatataaaatgataatgttttctttaaagagacatactgaaagccaagtcagttgttcacaggaggtggttttgcaccattatttgaactttgatgtgtgaatttgctttagaagtccatggtctgtttactctctgacagattctgttttcacatgcccctcacatgaaggttcactcctcattcttttttttttttttttgagacaggttgggtgggactgcttcaggattctaaaagacagtaccttctggtgcactttctaagatggaacataattctactctttgaaaatcattagagagtatatattaatgaactttggcttctatgaactttctgggcatgcctgtttgattggtgcagagtccttggctgtaacagaaacatcaaatagggaaaacgatttccttatggttgattgacttacatcagtataaaattgatgaggaatttatatacacgttgtatactgctgttaatgtttggtacagtgctttctttagtgttttcattttgaggggttattagattcagcattttctggagcagaatgctttttaaaggggatttggtctttttgggaaataatttataaaggttaatttggaaaaagctgaatttaaatacgtgtagctcttataattatgagctttttacatttacactgacgttcttttgtataggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaagggtcagtgttataaattatattttttctattaatacttattgttaaagttagcatttaattttatactattgatattaaaataagcaattatgataacttctaaaatagttcctttttattttgtttacatttattgatgcttcccacgtgcaggatataatgctcgattacgtagaggattggggggaggaaggttgatatggtcattgccatcaaagttttgcagtttagtaagggagaaaaaatcagtacaaatgacagattctaaatatgacagagcaagttcactacgggactttagaatatgtttcttctagctggaataattgaggaaggctgaacagtggaggaagttgcctttggaatgatccctaaaggactgactggtaggatttcagaaggtggtgatggggatggagaacattccagatagagaggagaaaaggtgaggaaatggagggggtatgtggggagagcagtcattttgacgtaacatgttacctcttgtgtgaacctgagggtttctaaattggtttgcattgagtgcatgttgctatttgccctctgacacttcacatgccatagaaatgctgtaggtctcagcttcttcatctataaaaagtctatgattcttacatttttttctagtatggttggcaactggcccattgtactttgtctttcttgggtttatgaagttttatttttactcaaagtcttttagtctttttttctagcttgggatttttttttttttttacattgcattccttacttaatggtcccatccactgcactccctgcagtgaatctttgaaatttgtctctctaatgtttttggcttgttggaaagagcacacatttgaagggttttttaagtctttggttttgtatactggttgctaccttatgatgagagcattttaactgttttgctcttgggtagagtttagagttcctcctgatgatgatgatgatgatgatgatgatgattattgagacaacatcttgttcagccacccaggctggagtgcagtggtgtgatctcagcatactgcaatctcagcctcctgggctcaagcgatccttccacctcagcctcctgaggtggtgtgcaccaccactgctggctaatatttgtagtttttgtagagatggggtttcaccatgtcggccaggctggtctcgaactcctggcctcaagtgatccacctgccttggcctcccaaaatgctgggattacaggtgtgagccactgcacccagcccctcctgattattacaaaagaaaaatgtatcaggtaattagcaacattaattatagagaatgaattagtgtgtgttttatgttgttttctggtgttcctttgcaaaattcatgcacactcctaaactgataggctccctgtttactcccttgctctattttttcctgaagacattttaggaaggaaatataatgttgatatgttgatggatagagttccatatgacttggtatatataatggaagccttgattttcactgcctgtgaacatcattactgtggtctgtttggtttaaaaaaagcgcttataattgatgaacattctgacttactgatttgaagatttaacagtcagaacttggtagaatataaatttgaaattatttagatttcgtttttctctagccactgcctgcagcagactttaagaatgttttggaacttgtgatgagttcatcagtggtcttgtgggctgacccacagcacagttcctagctgtcgtggaccggttcctgcttggtctttcacccggttggggtcccctgcaggatgccccaactagttgccattcctggtgtcaccgaacctcaggaaactctatccactgggatgggggtgaaggctgcttctctgcaactctctcccctctcagggcacacagacaaaatgctactgtggtcctccattccctgtgggtggtggttttggagctgcaggagagaaaaggtcataatagcctttcctcacttgtctcaagcttcacgctgaggcacttataataaaaagcagagaaaagcatacaaatttatttaagttttacatgacatgggaacattcagaaaggaagacccaaagaaacagggaaaccgtgtatttttatgctaaatttgatgaagagtggacagtgatgcaacagcgtgattggatctgatggtaacacactaggtaataaactgggggaacttaccagggcctgtttgttcacattattcctgtgtctttggatttcattcctttcttggcataagacaagacccctttggagtggttctcatgacctacctacttcgtggggaggtcagctagattttagggtctgcttcaggggagaagggggcgaaggtaaggtaagagtaaccttgcttctgctgttttcttaagtgccaaggtgccgtattttgggatagtatgtcctgaacctcatcagagaccccctcacttcctttgagtgccaggcagaggtaggagggtgtgccctgcaaaggcacaggcttcttctggaactggcctctgctcaccacctgatgatcttctctgcatcaccttctcagttctcttgaaggcaggtcacagcaggcatattcagttgccttttcataaaacaggcaggagttggtatcttaccacagttgttttctccttagaaggtgcaatgttgagaacaattttgtccccagggtagagtatctacatctagccaggagaggaggaagacttttttgtttgtttgtttttgagacagagtttggctcttgttgcccaggctaaagtgcaatggtgtaatctcagatcaccgcaacctccgcctcccaggttcaagcggttttcctgcctcagcctccctagtagctgggattacaggcatgtgccaccactcccagctaattttgtatttttatttttttttttgagacggagtcttgctcagtcgctcaggctggagtgcagtggcgccatctcggctcactgcaagctctgcctcccgcgttcataccattctcctgccttagcctcccgagtagtgggactacaggggcctgtcaccacgccctgctgattttttgtatttttagtagagatggggtttcaccatgttagccgggatggtctcgatctcctgaccttgtgatccacccgcctcggcctcccaaagtgctgggattacaggcgtgagccaccgcgtctggcctaattttgtatttttagtggggacagggtttctccatgttgctcaggctggtctcagactcccgacctcagatgatccgcccacctcggccttcgcaaagtgctaggattacaggcgtgagccgccgtgcccggttgagaggaggaagacttttaacatgttacatggttcgttgttttttatttttattttattttattttgagatagtctcactctgtcaaccaggctggagtgtagtggcccgatcacacctcacagcctggaccccctgggctcaaacaatcctcccaccttagccttctgagtagctgggactataggggtacaccaccatacctggctaatttgtgtgtgtgtgtgtgtagagatgggggtctcactgtgttgcccagacgggtctcaaactcctgggctcaaatggcccacctgccgtggcctcccaaagtgctaggattataggcgtgaaccactgtgcctggccagttgttttttattttttgtactttattgactaaggtccctctttttttttttttttgagatggagctttgctcttgttgcccaggctggagttcagtgacactatctcgggctcaccgcaacctctgcctcccaggttcaagtgattctcctgcctcaggctcctgagtagctgggattacaggcatgcgacaccatgcccggctaattttgtatttttagtagagatggggtttctccatgttggtcaagctggtctcgaactcccaacctcaggtgatccactcccttcggcctcccaaagtgttaggattacaggtgtgagccaccatgtccagccagatccctcattttttatgttgttctagtatttatttggatttatatgattagcagttttgtttttctatgtttttgtgttcagttttctgaagcaatatttgttgtcactagagtttagtactttttcaagttttctcatatttaatgaaggtactgtccccatctttaaaatagaaacagtgtgagaattaagtgaaataatgattagataataggagaatacctgagtacttgacttagtaaatattagtttgtttttctcctcttttttttgctcttgctttttattagataacagaaaaacttgactgttaattaaaattttttttttttttgagacagtcttgctttgccacccaggctggagtgcagtggcgtgatctcagctcactgcagttgccacctcccgagttcaggtgattctcctgcctcagcctcccgactagctgggattacaggcgtgtgctaccaatttttgtatttttaatagagacggggtttcaccatgttggccaggctggtctcgaactcctgacctcaggcagtctgcccgcctttggcctcccaaagggctgggattacaggcatgagccaccacacccagcctgttaatttaaaatttagaggggataaaatcaaaggtgtcagaagttagggtgatatttactgtaagaattggattagattaataggctagctttgggattaaatttttttttgtttacataaaatctttcagaaaagagctttgggttttttttttttttttttttaaacaaaaggaattgaggtagaatttacatgtagtgaaatgcacagatgtgccatgagtttgacaaatgtagcttgttacccctactgagatacagaacattcctgtcattccagaaagctccctttgcgctttcccacacctgagagatttgcgtgttgtagagctttggtaagtagggtcatgtagtgtgtacacttacggttctttactcagcatgaagtctgagcaattcagttgtgttatctcatgtagtaggagtgtgtttctttttattgttgaatagtattttactgtatggatataccacaatgtgtttatcacttctttttatggacatttggatttaatctactttcttgcttttacaaataaagctgctatgggcattcttgtagaagtctttttgtgaacatgtgtttgtttccatttcgcttgggtaaatgcctaggaatagaattgctgtatcataggggagtctgatatgcatccagattggagaatcacagccaagataatcatgagatctatctgattttagtcatttttatatattgaaagtgctggggatattattaatatttgcttgctattaatctcagatgagttttatatagctctttttttcttaaagtattgaaatatttaataacatacatataacattgttgcataggttttacattagagtagtttaatactgcaaatctgacctccatttggatagctcttgtttatggggatgggatcagtttgagtaggtgagatctgtagatggttggttagcttcctccctctctggtcttatacagcagccagcagatattaaatttttcactttcatttatttatgtatatatttttatgttattttaattataatttagaaaatttaaagtttcaataattataattctctttaaaacaatttttttttctttttaatctcttgagtcaaggtgaggattcatttattttttactttgctgttttaatggtacactaataagttaacagagtgaacaaaagccatagcagaaagaagagttaatttataggcatgaaaataagccctggataatctagaagctttaagtttgatacctatttgaaaatgatgtgtaaacataaagtttgccattgtatctctgaattcagataatgggatttaatgaacctcaaaattaatgaagtggcaacgtaagtataactaacaggggacataaaataattatgttttattgctgcaaaatagtataatatggggttttctcttttgctagaagttattgattgccatatttagtaggataatcatataatttgttatccaacaagacccttttgagaatgaaaggaggcactgttaatagtcaattctgggacaataggaataagcagaactgttctgtaaaacagaaaccttcatatatgtttaacacaagtctcaagtagcccctccctctacaatgtaaactttttagcaaaatctaaatttaagtggtttgctttttcgtttttccttcttcgttctaatttgttacaggcatcatttttatcacaaaagcaacttgggatcatattgataatactttgtagaattaattttgtaaaatctcatggaattaattttgtaaaatctcaatttttaagtatgcttattgcattttttctcaccatataggtgaaataaatttgaatgtagaaaaataaattcttaatcataaacactgtcttacgtacattcatattgtactttcccttttttttttttagcacttagacattaatattttaggtattgttattttgattatctttttgttttttgccttccagacaaattatgaaaacagaatatatagcctgaaagtagaatgtggacctaaatacccagaagctcctccgtcagttagatttgtaacaaaaattaatatgaacggaataaataattccagtgggatggtaagttaatatagtcattttggttttatataacataatgtatagagttatatattatacgtacacacaccataatatatgtaagatattaatatgtagttaggagaaagtttttaaaagaggacctttgttaagccaaaagtctaaagaaggttgcattatgttgtttttcttttattaatataaattaggccatccttaaaaaccttaatgtacttgcctagaatagatgcatgtggtggttaaaactttttttttcttttcttttttttttgaaacagagtctcactctgtcacccaggctggagtacaattgtgcgatcttggctcactgcaacctctgcctcccggcttcaagtgattctcctgcctcaacctcccgagtagctgggattacaggcacctgccatcatgcccagttaatttttgtatttttgtagagacggggtttcacaatggccaggctggtctcgaactcctgaccttagttgatccgcccggctcggcctcccaaagtgctgggattacaggtatgagccactgtgcctggccaaaagttttcttagggttttaattgccttaatagtcatatttcagttgatctttatttggtaaaaagatgaccattattgggcggggcatggtggctcacgcttgtagagattgtgccactgcactccagcctgggtgaaagagcgaaactccgtctcaaaaaaaaaaaaaaaaagagatgatcattatttctctttgaatgttacttttctgagggttaaggtacatttggtgggattaaaaggatgactgttcatgaaaaggatgaatattcatgaagggtttttttctttaaagagcaaatatgtctgtgttgaaacagtcatggctgagcatcattgtctatttatttttgggtttcactctgtcccccaggctgtagtgcagtggtactcccccacttcctgtggcctcaagtgattctcccacttcagcctcccaagtatgtgagactacaaggcacatgccaccaagcccatctaatttttgtattttttggtagagatggggtttcgtcatgttggccaggctggactcaactcctgacctcaagtgatctgcccaccttggcctcccaaagtgctgggattacaggcgtgagccactgtgtccagcccattgtctctttaaacaaaatgacatgccctgcttgacccacacaagttagttagtagaaacagctgaatttccagtatgagtagattgttaagttcatgataagtctttgaagcctaggctctcttggtgccatgttgagagcacgccacatacaaaatacattttaggaagcaaaataacatatcatcatcataaaatgagtatcatccatcttaggaaatagggcctcagtatccttgatttctcatcccatccctgcgttccctctctctaccagtgtattttgtactacaaatgtatcacatatgtacacaaattcatcctcctttcttctctccttctctctttccttctcatctgtttaccatctgttaaaaatcacgagtttatactaacaactcccactaattttattctaaaactatagggtttgttctatgattcttcctttccagttgagaaacctggctcccatgcttcccagtgcatttacttatttgctcaatttccccttcatataactgtacttctggcaacaagttgaatcttggattcacagccagctccctgcccctcaaccccaacctaatacgcaggtctgaggcggggccccagattggctggtgcatccagcagggaggcaccaggccaaataaagcatgaccctgagaaaggaagaagctgggaaaggtcattggaaaccttagccctgcacctgctgggccattaacacccccccacccctgtgccaactcagagctgggacctgagagtctctccagccctcacagtcctcagttggtcagtctttgtgatttactgggagcatttagtccatttacatttaatattcttaattactgacatgttcaggtttaaacagatcatcttatttggtggtttctatttttctacatgtttcttgcctacttttggaatggttgttctcaacttctttcattctgtttgtgttctttcagtgattattctagaaattatgcacacttatctatttttaagaaatttgataggagcaggattataaagcatatgagtacacagaaaagatattatttagggaatgtcctgtgtgacacacagcattgcctttatgaagaagacctttgttagattttgctactagacatatctggttttctccactactgttttgtttttacattatagcttctgtaaattaagtaactaatggtgtgttctacattgtcatggaagctaggaaatttagattaaatttcagacctacctctaataagcttatctgatctcttgggcttttggtccagtagttgatattttgcctccctctctacctcccttcccccaacccatttatcattaagccttgtcagttttatgttccaaatgtgactggatttaggtcttatttttctatttacattgccaccaagtgaatattggccatcatttatttcctggactcttgcaacaacgtctctgattctactttttaaaatcccttccagtctttccaaagttagcagccagagggatcctcctaagagacaaattgcgtcgtgtcatttctgcacttcagattcctttaggggcatcagcctcagcatgcatgcttcttgccatggctcactgggagtgctcaaggtgcacactggcctgcatgcctttcgtttggtctcaagacctttgcacttctgttcttcctccttcctccccagtctggctaactcctatgggtccttcatttctcactgtaaattccactttcttttttattgagacagagtctcactctgtcactcaggctggagtgcagtggcatgatctcgctcactgcaacctccatctcctgggtttaagtgattctgctgccttagcctcccaagtagctgggactacaagtgtgtgccacaacacctggctaatttaatacagatgggggtttgccatgttggccaggctggtctcagactcctgacccgcgttggcctcccaaagtgctgggattacaggcatgagccaccgcacccagcctaaattccactttttagtatctttattgatgttccaacttgaattatgtcccttctattgctctgttagagtcactcttattcttttgttgcacttaactataaatttatttttttgtttttaaaagaaatgtttctaacataatagaagttttagagaatgatagaaccagcatctatgtgtccttcacctagctttgtcaaatgttaacatttgtcttatttgtaacagatcttttaatttttttttttttttttttgagatggagtctcactctgtctcccaggctggagtgcagtcacgcgatcttggctcactgcaacctctgtctcccaggttcaagcaattctcttgcctcagcctcccaagtagctgggaccacaggcatgtgccaccacgtccagctaatttttttgtatttttaatagagacagggtttcaccatgttggttaggctggtctcaaactcctgacctcaaatgatccgcccgcctcggcctcccaaagtgctgagattacaggcgtgagccaccctgcccagctagatttttttcttattagtacaaagactacattataaatagagttaattctgtgtgtggctttctcttgtttccccttcctgttttttttttttttgagatgaggttttgctcttgttgtccaggctggagtgcaatggcatgatctcagctcactgcaacctcttcctcctgggttcaagcgattctcctgccttagcctcccgagtagctgggattacaggtgcctgccaccatgcctggctaatttttgtatttttagtagagatggggtttcaccacgttggccaggctggtgttcaactcctgacctcaggtgatctgcctgcctcggcctcccagagtgctgggtgggattacaggcttgagccaccacgtctggccaagtttaaaatttttaaattaaaatgttctccgtcagattgctataaaactttctaagttcttactctcaattgcaatgtgtatcttgtcaaggagcaatagaattcagttcgtggcctgcccctttccatggacacaccttgagtagtgctgctctcgggaatacatctagaagtgtgccgtggcgtggggctttcttcagcttgaatattgccaagctgctttcctcccggctgggtcaatgtcagccccaccagtggtgtataacaggaccctctgaatgtatattcccaccaacccttcttactgtcaatctggaatggggactgggaaatagaaaaataaatactgattttaatcattattggagtgtagatgtgtgtatagagggttgtgggtagggtgaatatattggacatctgtttttctcttcatttacatctaagagtttggattattacttttataactagtaaatggtacagaatttcacattggtgattgtgccaggatagtttttatattttgaggctgtttaagtgtctcatgaattgtagttcataggcattgatggtgggtgttgctttagtaattttagtttatacgtatttaatacgacgaggcaaagttattccctgtgggtggttagcactctgaagtgtaaattttattgtcttatgcagtgagatctcacattttggaggtcattgtatgttgtagactgataagatgcagattttattctgacatgatatttattttctcatgctctttactgcgtcctctctcttcatcttttttttcttttcctccaatgtttctttttttttttctgcaccctgttggtatttcacaggatttgcaatcacttatgtttatttaactaccatttacagctggaagtgtttgtttctgatttagaaatagcttggtattctctctacttatttttataaactgttcagttatggaatctatttaaaataggctaaggaggttgccactctttaaagtgaaagtgttagaggaagcattttaaatgtaccttaccattgtaacatttttcttactcttttagttagtttcttttccttttttttttttttttgagacggagtttcgctcttattgcccagggtagagtgcaatggtgcgatcttggctcactgcaacctccgcctcctgggttcaagtgactctcctgcctcagcctccctagtagctgggattacaggcgcccgccaacatgaccagctaattttttgtatttttagtagagacggggtttcactatgttggccaggctggtcttgaactcctgatttcaggcgatccacccacctcagcctaccaaagtgctgggattacaagtgtgagccattgcgcctgctgttagtttctaaaataaatatcactctaaaattatttttcttttctactttcaaacacttttatggtgatataattcacataccatacaattcacccatttaaagggtaaaattcaagggtttttagtattcacaacattgtggaatcactgccatgacccaggtttggaacatttttgttcttcccaaagcaaatctgtgcccatcagttgtcatttcccatcccatctcccttagacctaaacaaccattaatccactttctgtctttttttttttttttgaggcagagtctcactctgtcgcccaggctggagtgcaatggcttggctcactgcaagctctgcctcctgggttcatgccattctcctgcctcagcctcccaagtagctgggactacaggcgcccgccaccacacggggctaattttttgtatttttagtagagacggggtttcactgtgttagccaggatggtctgtatctcctgaccttgtgatctgccctcctcagcctcccaaagtgctgggattacaggcgtgagccacggtgcccagcccactttctgtctttatagatttgcccattctggatgtttcatataaatagaatcatagagtatgtgttctttggcgacttaacgtaatgttttcaagatttacccatgtttgtattgtgtattggtactttattcctttttattgttggacaatattccattgtatggagatcccattttatttatccatttatcacctagtagatatttctatttttctacttttggctatcatgaatactgttgctatgaatatttgtatacaagtttttgagtgggcaaatattttcatttcttttggatatatatttaggagtggaattgttgggtcatacggtatctatgttttagtttttgaggaactgtcaagacagttttctaaagtgaataggccatcttacattgctaccactagtgtatgcaggttcccagcttctccacatccttgctaaccccaaataaaaagcaagaaattaaaacataacaacataaacaatcaccttcaaaaaaaggaaaaggagacagggtttcgtcatcttggccaggctggtctcgaactcctgggctcaagagatccacccgcctatctctcccaaagtattgggattacaggtgtgagccactgcacctggcctgcctttctggactaccgtagctttgtagtaagtttttttgtttgtttttgagacagagtcttgctgtgccgcccaggctggattgcggtggtgcgatcttggctcactggaacctccacctcctggactcaagcagttctcgtgcctcagcctcccaagtagctgggatcacaggcatgcgccaccacgcctggctaattttttgtatttttagtagagatggggttttaccatgttggccaggctggtcttgaactcccagcctcaagttgatctgcctgccttggcctcccaaagtgctggggttacaggagtgagccaccacgcctggcctgtaataagttttgaaatcataactttgttcttctttttttaatattgttttggctattctgggtttcttgcatttgcttatgaattttaagataagcctgttcatttctgcaagcaagaaaaaagcagttgaaattttaataggagttgtattgaatctctaaattaacttgatgaatattgtcatcttcacagtaataagtcttctgacccatgtatatttatttagctctttaatttctatcaactatattttacagtttttaaaaattatttttatttatttatttttttgagatggagtctagctctgttgcccaggctggagtgcagtggcgtgatctcagttcactgcaacctctgcctcctgggctcaagcaattcctgtgtctcggcctcccaagtatctgggatcacaggcatgtaccaccacgcccggctaatttttgtatttttagtagagacgggggttttgccatgttggccaggctggtctcgaacttccgaacttaggtgatctgcccacctcgccctcccaaagtgctgggattacaggcatgagccactgcacccgacctttaaattatttctatttaattttttttttctcttttttctggggagggagggaaagggggaggtaggagaggagggtggtaggaaggagggaggggagatattttacagttttcagtgcacaagttttacacttttgttaaatttatacttaggtattttattaatttttatttcagattgttgcaagtgtaaagaaaaactaattattgtatatggaacctgtatcttgttgccttgatgaacttgtttattagctctaataatttctttagtggattcctttgaattgtctatataccagatcatttcttgtatttcttctgcaaatagaggtagttttacttcttttctttctaatcagggtgccttttatttcgcttctttgttaattgtcctggctagaacctctccagtacaatgttgaatggaagtgatgagaacggggccaggtggtggtggcggctcatgcctgtaatcccagtggtttgtgaggccgaggtgtgcagatcccttgagcccaggagtttgagaccagcctggccaagatgacgaaaccctgtctctataaaaaatacaaaaattggccgggcgtggtggctcatgcctgtaatcccagcactttgggaggctgaggcgggtggatcatgaggtcaggagttcgagaccagcctggccaacatagtgaaaccctgtgtctactaaaaatacaaaaaattagccgggtatggtggtgagcacctgtaatcctagctacttgggaggctgaggcaggagaatcgcttgaactggggaggcatgggttgcagtgagtgaaagtagccgggcctgtggtggtgtgcgcctgtagtcccagcaacttgggaggctgaggtgggaggatcacctgagcccagggaggtcgaagctgcagtaagccacaattgtgccactgcactgcactctagcctgggcaacgagtgagaccctgtctcaaaaaaaaaaaaaaaaagaaaatataaaaagtgatgagaatggacatccttatcttattcttcatcttaggaggaaagtatttggtctttattaaatatgatgttagctctaagttttttgtagattcctgttaggttggagggtagtttccttctattcctaatttattgagtatttatatcatgaaaggtttttggattttgtcagatgcttttttgcatccattgagatgatcatggtttttgttctctgttctgttaatatgatatattactctgatttttaaaatattgaatctatcttgtgtttctgggataggtcctacttgtatataatcttttttgtttggagatggagtcttgctctgtcgcccagggtggagtgcagtgtcacgatctcagctcactgcaacctccgcctcccagatgcaaacaattatcctgcctcaacctcctgagtgggtgggactgcaggtgcacaccaccatgctaaatattatattattatatatttataaatacaaatattattgtattttagtagagacggggtttcactgtgttgcccaggctgttctcgaactcctgaactcaggcaatccgcccgcctcggcctcccaaagtgctaggattacaggcgtgagccaccattcccagcctgtatatagtcttatatgttgcttgaggtcagctgtagatgacagcttatggccttctcagctctttcataagcctgtgcgcagccctacacatgtgtgtggtcttctagattcccaggcctgtttggagacacttcgtttcccagcttgtctgcttaagtattttggttaccttcctgctttttttttttggagacagagtctcagtctgtcgcccaggctggagtgcaatggcgtggtctcggctcactgcagcctccacctcccaggttcaagtgattctcctgcctcagcctcccaagtagctgggagtacaggcacgtgccaccacacctggctaatttttgtatttttagtagaggcggggtttcactatctatgttggccatgctggtctcaaactcctgaccttgtgatccgcccgccttggcctcccaaaacgttgggattacaggcgtgagccaccgcatccggcccaccttcctgtttgactcaactttttttgacaaatgcccaaggaaggaggtgagtgaagatatgtgagctctgaggtcagataaaggaaagnnnnnnnnnnnnnnnnnnnnnnnnntgtgagtggagttttccagggaactgcaggacaggtcaaatgctgacagttaactgggaatgggcttgcaaggagctccatccccattctgttgctctttcacagaagattaatttgggtcgggtgccgtggttcatgcctgtaatcccagcactttgggaggctgaggcaggtagatcacttgagctcaggagttcaagaccagtctgggcaacatggtgaaaccctgtctctacgaaaaatagaaaaattagcctggcgtggtggcaggtgcctgtaatcccagctacttgggaggcctcatgaggcaggagaatttcttgaacctgggaggcggaagttgcagtgagccaggatcgcaccactgtactccagcctgggtgacagagtgagactctgtctcaaaaaaaaaaaaaaaaaaaaaaagggaaagaataattaggaatagtgcgtagaatacattggaaagaaaaatctgaaagaagagatcaggttagtagcttttgtctaaatctcagtgtgagataattccccagattttgggcggtggcattggaaatggagaggaaccttttgaccttactccattaagaaagaattggtaaatttattgacaaagtagttatttaatataacatttatttctgatgaccaaagttcactgtatgttttatgtctttatattttcccaaaatattaaactaattatgataaaatatactaattatggtattagtaattccatagtgtatgttttgtgaaaatagaggcaagctatgaattttcaaaatcattcttattaaaatatgcttaacaaattggtgccatagtactttaaacttgctagttaactgtactctttcctcccctttcaggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcagagactgtgccatttctattatgttgatgtatatgtacagtaccttgccagggaagcaaaaattggaattattgtagcttttcatgtatacacacttttatttaccctattttgtgtacttcttgtgaattataatttgcagactatttcagaaaagaaattatctagtttaatttcttctttggacaaggagtcctaggtattatattttgagtttgatttcaccagaaataataatattaaaaagatctttgcattctggcagttcttttaggattataggttgcaaattatccaaatatatatcccattttttaaagcataatatcttttttagttgtttttctgtgaagcttttggttaataaatagggtcaactaattggagacttttctcttccaattagggcttttaatactaacaaggataactttattcattcctcgtattctctactctaacaaatatgaactctgaagttgaaaagtcatttatgttccgctttcaccaaagtgacgtgaggctttaggtcactgtttcacttcaaagtactggatccaaagctttgttgaaaatgctgtttgatgaattcactgaagaatatagaaaggtggtcaggtaaagtctacttttattttgtcaagcttaataatttgtgtcatactttaccccagtatatataggcaaaccaaaaccttatcaaatattaaattagttgtttaaactttgcttataaagtattggccatgtggtggctcatgccgctaatcccagcactttgggaggctgagacgggcagatcacttgaggtcaggagcttgagaccagcctggccaacatgatgaaaccctgtctctactaaaaatacaaaaaattagccaggtgtggtggtgggtacttgtagtcccagctactcgggaggctgggcaggagaactacttgaaactggcagacagaggttgcagtgccgagagcgcaccactgctccagcctgggcaacagagcaagactccatctcaaaaaaaaaaaaaaaagaaaaatattaataattgaccttggctgtatattaaaatagttacttttatagtagagcacatttctcaaacatgccctgaaaggcttttatcaagctcatataaagttaaagctttgagctaccttttcttggccaataaagtcactgacagtttatgtaaacattaatttcaacatggctgttgcattttaattatcaaaaatgtttaaaatgctttaagatgacacatagagaacatacacatacatacaaattagtgcatttgtaatttgttaaatttgaaatgaactattaccttgaaatatagtctttaaaaatttttaatggttaaagattaaattgaatgaaactgtagtctaatggtaactgatgatctgaatccgtctctctgataacctcctttccattttgaaaatgtgtcttattatacatggaagctagtaactacgtgaatgctgttggcaggatgagggtctgggtacctcagtctcttgtcctgtttccttcccccaaatccaccattgtgaagttgccaaccccctgccgccttcccctgccaagtacatgttgtcagagtcagccctataatgttcatttcccctcttgtttgtgggattatggatctctgcagaaatctgcatgccaattaacccatttctaaagcagaatccattttgcatgtcacaatcaagatgtacttggcaatctaagacacactgggagactgtaagaggaattaatatagaaaagctcttaattataataacatttggaagaaatttttcctttgttttgtaaagtggctaaggttgtaggagtgtgtggtatttattaccttttaaatgaactgtaaatttgccttagaaatttgtttaaaaggctagcaagtgagacccttgaggatgatcatatactaataaagattaccaaaagaaacttcttgtcctgttaggtcagtgttatgatttaatggttttaattacttaaccaattttaagaattgacaatttttaaaaatatttttttctaccattctaaagtaatgtcttttgttgtgggtttatgtgtaactacaggattttggaacataaacattttgaaggatagtcaatggtatttagtcttggatataaaaatagagaaaatttatagctttatgttattaaaataatttatcacacagagtgatttgaggttttcgcagagtagatttgtttgactcatggtttattagtctggattacttaagaacaatatgttgattttaatgttaattcccactaaatatataatattgataaatacatgtgaaattaatattgtttggaaaatgtagaggacacagctgggaattatgaatgcttttttcttaataggtttggtgtgtgtggctttgaatggttctgctgatgcatcatggaaagacagcagggaactgtagcctgccatcaaaactgtatcaactcttttaatgagcatgtgactgtattaggtacattttgaagaatataagtactgatgataaagtctagtatgcataataggattttggaggcatttcaggaattttccttttatagtatgctttttaggcatctgtatgtgtaatatcatagtatcatttattgctgggatggatcgaaaagcactgcttttacttttctgataagtatcaaaatgattttccagtaccaacttgactggcttttaattattgtcacacacacacaaaattcaactcctcaaggtttgggaaaattgtgtatttttttgtatacaagataaaagtgtcataaaaaggaatggatgaattgttgataggaacattagcagttaatttttacctgatactgagtttactgtaaaataggaaatgcataggaaggaatacctcctaaataatatgccttatagaatgatgaaatcttaccatagttcatactgaaaatgttgtttatttaaaagtattgtggagtgttgaaaataaagatacacaataagtattttctgaagagaaaattaatgaaggtatttaatgatataggaaataagtgacaagttaaagtccattttgtttcaataaaggagttgtgcaaactcaaggagtgagttacatgattgaaaaaaaccattggatatgaggaggttgctatggtgtttatatccttaataggatcttttcatctaaaaaattcctaagaatctgctccatctcatgtttaaaattaaattttttttttttttttttttttttttttagagacagggtcttgcactatcacccaggctggagtgcattggtgcgatcacgatttactttacccttggctatcctgggctccagtgatcgtcccgcctcagcttcctgagtagctgggactaccggtgcacgccaccatgtctgtttttgctgttgttgttgttgttttgttttttgtttttggtagagactgggtctctgttgtataggctggtctgaaactcttggcctcaagtgatcttcctgccttagccttccaaatgctgggataacaggcatgagccaccacccctggctggcatctcatatttctgtgtagtctataagaccatctgaaaagtttttgcttcaggttaatttgtgaagtaaatgataaaggctgatagatgttgttttcttatagagattccagggattatcctttctccagtgtttaactgaccaaataccatgttaagtgttgtgcagtgatccatttgctgccaaatagatagactcaatgtgtgaattcttctatcttgtcattgtcaatagtgagcagctactttatccagaaattttggcagttaaaagattataccaaagcagagttgttattcttagttggcactaagaaaccaatagtcaaaagaaacctgtggtcaatagaaaagcaaattgttgatcttatccatagtgaatactttgcattgcttgttcagtacagtagttgagtaatgaaagaaaaatattgttcaaggattacaaggaggcttttttttttttttttttttaaacaagcagtcctcctgcctcagcctcccgagcagctaaaccacaggcacacaccaccacactcggctaatttttaaaaatttttttgtagagacggtctcgctatgttgtccaggcaggtgtcaaactcctggcctcaagcaatcctcctgccttggccccccaaagtgctgggattacaggcatgagtcaccttgcccagctcagttttttttttccttttaataatagattacagggtaatactgaaaaatcacatcatgaaatgagattttaacaggacatcctcatattaaaatgtagtaaaattagttttaatactgaatgtcctgttttttatttaaagactttcatccatttataattaataaacatgatacttgatacttgctaatgctttattacatttgatagcccttgtagtttatcagcctttaacttgaagaacagattttttccacagttgataattgataaatatattgtgttcattctttatcacgccacattagccacttaagtaatggtggtcaaatgttccgattacatccattattataaattacctttttgttgctataatgtaaaaaaatctggataattgcaatgattattcagacaaatttaaagtgggtattgggtacgttttcagttatcctaatactcaagtgaaaataattgagttcacaagaagagtaaattaattgcatcggtttttaaattttagtaacatatggatccctttgagaaggaaagttcttgtggacttagtattgtcttgaattatttttgttaaactattgtttagtgcatacattgaacttaggctcttagatctttttttttcttcttctttagacctgtaacaaaactgcaagatcttttaaaattataaagtgggcccggcagagtggctcacgcctgtaaccccagcactttggaaggctgaggcagccagatcacctgaggtcaggagttcgaaaccagtctggccaacatggtgaaatcccgtctctactaaaaatacaaaaattagccgggcatggaggtgcgtgcctgtggtcccagctacttgggaggctgaggcatgagaatcgcttgaacttgggaggcggaggttgcagtgagctgagatcgtgccactgcattccagcctgggtgacagagcaagactccgcctcaaaaaaaacaaaaaaagcttcattgctaaaaactaggtaatttttaatgaaatgtgaactttattaagttgtgtttatcaaacatgttggcatgcttgttattaaaccctccccatgttaagtccttataaaaggctgcttacttggtacttgtatgtagatgataatattgagttcataggtaaatatatgtacattattgtcaactcctggttacagagatgatgatcaagtctgccggtccctcatctggcacctcctatctggtagagtgtaactacccattagcataatgttgtaagcggaactggatagtaatatggataagtgaagccattggcatgatattctaaaccgaactggatagtaatattgtgaaatgaagccattagcataatgttctaagcttaactggacagtaatatggataaatgaagcaattatcacaatgttctaagctgtactggacagtaatatggataaatgaagccattagcatgatgttctaagccgaactggatagtactattgataaatgaagagcagtccagaggaatctactgcaaatcctagggaaaacacctattttgccctttgccctgcgactgtgggcagttagccctgtaaccttcagtttattctgtaaaggttgtgcttgcctctgagttgtcatttaatgaaataacatgaataggtttaatcacggtctgatgcagagtgattgatcaataaatggtagcatttcttaatgttattaatctaagaatgcttagtctatgttaagatttgcatttgtggccgggcatggtggctcacgcctgtaatcccagcactttgggaggctgaggcaggtggatcacaaggtatagagattgagaccatcctggacaacatggtaaaatcccatctctactaaaaatacaaaaattagctgggcgtggtggcatgtgcttgtagtcccagctactcgggaggctgaggttgcagtgagccgagatcatgccactgtactccagcttggcaacagagtgagactccgtctctaataataataataataataataataataatatatacatttgcatcaagcctgtacttctgtgtaaagaatgggttggttttttaaaagaggtcatatgggatgccattaaggcatttgtgcattctgaattaagttaatttctgcccgtggtcaaaggtgaacagatatgcttctggatgtttgtgattcttgatgcccccacactgctgagaggacgcccctgcacgtcttgccgcaggggccctgatggatgcatctcaggttgggcacaattgctttggtaccagcagcaggccattaagatgaggtccattggaaagaggtaacttactggtaatggaaagccaggttcacaaagcttgggttgaaaagtccatggtttaactacattataataggaaactcaattcttcatatatgcaacctatgtaaagtaacatgattaattagaaaaaggagattacattttaagcttatcttttccactagtcacttgtgaatgtaatcacagtgaagtcatatgaattgtgaaagaaagtcgatttctacttttaataagcatcagtgggtggtgcttccagcaaatcttgagactagggcttctgtcttattaatccttgcctttgggcaggcactgttagatgctgaagatatacagcctcttttctcacatgtacaatgtggtggaacttagagataggctgtttatttatttatttatttatttatttaagatggagtattgctgtgtcactcaagactagagtgcagtggcaccatctcagctcactgtaacctctccctcctggtttcgagcaattctcgtgtctcagcctcctgagtagctgagactacaggcgtgccccaccacgcccagctaattttgtgtatttttaatagagatggagttttgccttgttgcccaagctggtctggaactgctgggctcaagtcaacctctcttctcggtctcccaaagagctgggattacaggtgtgaaccaccatgcccagccaggactaaatttctgaggttgttgaaaagcgctacaagtgttattaatagcttgccttttaaggataatataaactatacctaaatataaagagtttgctcctcatcctggtgtttggtaactgtattcattaaagagataagccggggccgggcgcccgtggctcacgcctgtaatctcagcactttgggaggcnnnnnnnnnnnnnnnnnnnnnnnnnnnnnnnnnnnnnnnnnnnnnnnnnnnnnnnnnnnnnnnnnnnnnnnnnnnnnnnnnnnnnnaaatacaaaaaaattagccaggcgtagtgatgggcgcctgtagtctcagctactcaggaggctgaagcaggagaatggcgtgaacctgggaggcggagctttcggtgagccgagattgcgccactgcactccagcccgggcgagagtggcactccgtctcggaaaaaaaaaaagaaaaaaaaaaaaagagttaagccgggcgcggtggctcacgcctgtaatcctagcactttgggaggccaaggcaggtggattgcctgagctcaggagtttgagaccagtctaggcaacatggtgcaaccgcatctttactgaaatacaaaaaattagccgggcatggcggcgtgtgcctgtaatcccagctacttgggaggctgaaacaggagaatcgcttgagtttgggaggcggaggttgcagtgagccaagatcacgccactggcgacagagcaagactccatctccaaaaaaaaaaaaaaaaaaaaaaaaaaaagagttatattgttggctgggcacagtggctcacccccgtacaatcccagaactttgagaggccgaggtgggtgggtcacttgagcccaggagtttgagaccagcctgggcaacatggtgaaaccctgtctttacacaaaatacaaaaatagctgggcatgtttcagctacttgggaagctggggtgggaggatcacttgaacccaggaggtcaacgaggctgcagtgagctgtgatcgcacaactggactccagactgggtgacaaagaccctgtctcaaaaaaaaaattttttttttaacttttaggtttgggggtacatgtgatggtttgttacataggtaaacatgttacggggttttgttgtacatattatttcatcacccaggtattaagcctggcacccaatagttatcttttctgctcctctccctcctcccacctctagaccccggtgtctgttgtttccttctttgtgttcacaagttcttatttagccccaatttataagtgagaacatgtggtatttggtattctattcctgttagtttgctaagaatgatagcctccagctccatttatgttcccgcaaaagacatgatcttgtctttttttatggctgcgtagtattctacggtatatacgtaccacattttcttttatccagtctgtcattgatggacatttaggttgattccatgtctttgctattgtgaacagtgctgcaatgaacatttgcatgcgtctttatggtagaatgttttatattcctctgggtatatacccagtaatgggattgctgggtcaaatggcagttttgcttttacctctttgaggaatcgccatagtgctttttacaatggttgaactaattcacactcacaccaacagtgtataagtattaccctttctccacaacctcgccagcatctgttgtttttttggctttttactaatagccattctgactggtgtgaaatggtatctcattgtggttttgatttgcatttctctaatgatcagtgatattgagctttacctcttagactctggacagcccacacattctcgggaatagtttagtcttgacaaaatggaaactggagtagtcaatttcttagacacctttggtgctaacttctcagtcatttaatctacgtgtgtggtgtgtgtgtgtgtgttctgagacagggtctcgctgtgtcactcaggctggagtgcagtggtggtatctcaactcactgcaacctctgtcacctgggctcaagtgatcctcccacctcagcttcctgaatagctgtgaatattggcatgggccaccatgaccagctaatttttgcattttttgtagagacagggtttcggcatgttgcccaggctggtctcgaactcctgagctcaaatcatcacctgccttggcctcctaaagtgctgggataacaggcatgagccactgttcccagataatttttgcatttcttgtagagatggggtcttgccatgttgctcaggttggtcttgaactcctgagctcaagtgatctgcctttcttggcctcccaaagtgctgggattactggcatgagccactatgcccagctaagttttgcagtttttgtggagatggggtcttgccatgttgcccagtttggtcttggactcctgagctcaagtgatcctcctttcttggcctcccaaagtgctgagtataaggcatgagccactgtgcctggcctacaccgtgtattctaaaagcatagaatgctttatggtgtatggaaccttgctggtcctgtgggaggcacacagaatgatagttttattcatatgtagtgtacagtctgtcttttgaaaggacatcattttggtatacaccagtgcttctcagattttaatggcattcctgagggtttgttaaagtgcagatgctaattcagtaggtctatggtgggacctgaggttctgtttcttacaggcttcccatgatggccactggttggcagaccacactttgaggagcaaagggcctaataaacagtggtttgggaggaggcttaatggacgtgtgtctggcgggcaccgtggagtaggaaatgtagaccatgtttggggtgcatatactcaaattctctttacagaggagcaggcacgatctcaccacggtgtccttggctattttggttttgtctccctaacactctccccactcacttttcatggccctctgctggaacttcctctggtgttctccagctccagacttttgacttgagaccttctgactctcagagcctgtgtatttggtatatttgtgtgtgggcagggatgggcatagagggcaatttcaccacaaatatttaaattttaacattgccacatcacgaaaatcagtttccttttagatgttcccatctgggctgtgtgtacaataatctttatgatgtctctggcacatccccttgctgaggttgggcaccttgtagatgatctgtgggtgtgcacctgcagcactgagtcttctaggctgtgtttgcagggcccttcacctgatgccacctcgcagattctaaccttcatctccgggcacacttgccctttccccaggcctgggaagctcctcctcctcatccctgttccaggcacatgactgcttccttttgcagaatgaatgaaatttatttcagggaaaaacatagtaggtaggttttatatcccaaaagtgtccttccatctgttaaggccaagtttaaatgttaccttttccactaaaaattgcaggtcatgcttatttctctctccctcaagctgtattgataaagggaaataatgagatggaagtcacaaagtgcttgtcgtggtgtgtgtgccatgctcgccagcgccagccaccctgcctgctgctggcagagcacctgggtgtgagggtcagggcgggtagaaacaagctgtggggtgaggtagaaacgccagtgtatagcggaagagcgcggcctcttactcaggtctcatctcagcacggcagaactgtggaggggctttaactcagtatacactcctgaaacatttttaaatgaccagggtcaatagatatatgacagatagatacaaatagatacatagtagatatttgtcaatttgtgaggtagaaagccttgtaatgtgttccaagcactacaaacatttttctgagattacgttgttatttatctaaggcctctgttagcacttttggttgaatatgactcttctctaattttgagataatttcttttttttttctgagacagagtttcactcttattgcccaggctggagtgcaatggcgtgatctcggctcactgcaacctccgcctccctggttcaagcaattctcctgcctcagcctcccgagtagctgggattataggcatgtaccaccacgcctggctaattttctttcctttcttttctctctctctctctctctctcctttctttctttctttttttttagacaaagtcttgctcttgtccctcaggctggagtgcaacggtgcgatcttggctcactgcaatctccgcctctcagcttcaagcgattctcctgcctcagcctccagagtagctgggattacaggcgcctgccaccacacccagctaatttttgtatttttagtagagatggggtttcaccacgttggccaggctggtctccaactcctgacctcaggtgatctgcctgccttggcctcccaaagtgctgggattacaggcgtgagccactgtgcctggcctatatgatatatcattgttattatatagtcatcctacagtcatatagagcactggaactcatgcctcctatctagctgtaattttatatccatgagcaaatctatccctatactctccctccccctaacttcaccagctatttcttattttaaagaattaacaacaacaacaacaacaacaacaacaacaacaacaacaagaaaatcctgtgagccaagtgtaagctccttggatagctcttaattctgcagtctacttgggttcttccatgttttaatattgaacagagcaactgatcctgtagcctgtgtactgtggatggcacacttcccctaatctatccttcaaatcacggagcagtgaccactcacagggtcattcttgtttccaggatcctgcatctgttgaaaccttggatctctgttctgaatcttgcctcctatgactgctgctcactcctttccctccccgcccaactggacaggactctgatcccttactccactaatgaaagctgatatcctgtaagtgatatcagctttttgggtttggccaattttgctgaagacttgtgctagtggaggagggttgaagcatagtttaacacaaggatatcagtattttaaaaaactcatggttctcttccaaccatgggctgggagaggataatggaaacaacaaaactacactggccacagttttactaggaacatccttctgcccatggaaaccacaccctagaacccagcgacagatagccagatgtctaccacacataaagcactgtattcttgatttaaaaggccacagtgataaaatgcataccttcttttagacatgagtaagaattacggcatcacaccagggctcatcctctggcctggcttgtgagggatggggggaagcctgttagacggtctgagttcaaatgccatccctcccaccagcattagagaaacctgagtcagctcacccaaacccaggctgaat

SEQ ID NO: 167 - DNA, 4046 bp, Homo sapiens
ctgcgtcgggctgcaggagaagatggcggtctccacaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcagagactgtgccatttctattatgttgatgtatatgtacagtaccttgccagggaagcaaaaattggaattattgtagcttttcatgtatacacacttttatttaccctattttgtgtacttcttgtgaattataatttgcagactatttcagaaaagaaattatctagtttaatttcttctttggacaaggagtcctaggtattatattttgagtttgatttcaccagaaataataatattaaaaagatctttgcattctggcagttcttttaggattataggttgcaaattatccaaatatatatcccattttttaaagcataatatcttttttagttgtttttctgtgaagcttttggttaataaatagggtcaactaattggagacttttctcttccaattagggcttttaatactaacaaggataactttattcattcctcgtattctctactctaacaaatatgaactctgaagttgaaaagtcatttatgttccgctttcaccaaagtgacgtgaggctttaggtcactgtttcacttcaaagtactggatccaaagctttgttgaaaatgctgtttgatgaattcactgaagaatatagaaaggtggtcaggtaaagtctacttttattttgtcaagcttaataatttgtgtcatactttaccccagtatatataggcaaaccaaaaccttatcaaatattaaattagttgtttaaactttgcttataaagtattggccatgtggtggctcatgccgctaatcccagcactttgggaggctgagacgggcagatcacttgaggtcaggagcttgagaccagcctggccaacatgatgaaaccctgtctctactaaaaatacaaaaaattagccaggtgtggtggtgggtacttgtagtcccagctactcgggaggctgggcaggagaactacttgaaactggcagacagaggttgcagtgccgagagcgcaccactgctccagcctgggcaacagagcaagactccatctcaaaaaaaaaaaaaaaagaaaaatattaataattgaccttggctgtatattaaaatagttacttttatagtagagcacatttctcaaacatgccctgaaaggcttttatcaagctcatataaagttaaagctttgagctaccttttcttggccaataaagtcactgacagtttatgtaaacattaatttcaacatggctgttgcattttaattatcaaaaatgtttaaaatgctttaagatgacacatagagaacatacacatacatacaaattagtgcatttgtaatttgttaaatttgaaatgaactattaccttgaaatatagtctttaaaaatttttaatggttaaagattaaattgaatgaaactgtagtctaatggtaactgatgatctgaatccgtctctctgataacctcctttccattttgaaaatgtgtcttattatacatggaagctagtaactacgtgaatgctgttggcaggatgagggtctgggtacctcagtctcttgtcctgtttccttcccccaaatccaccattgtgaagttgccaaccccctgccgccttcccctgccaagtacatgttgtcagagtcagccctataatgttcatttcccctcttgtttgtgggattatggatctctgcagaaatctgcatgccaattaacccatttctaaagcagaatccattttgcatgtcacaatcaagatgtacttggcaatctaagacacactgggagactgtaagaggaattaatatagaaaagctcttaattataataacatttggaagaaatttttcctttgttttgtaaagtggctaaggttgtaggagtgtgtggtatttattaccttttaaatgaactgtaaatttgccttagaaatttgtttaaaaggctagcaagtgagacccttgaggatgatcatatactaataaagattaccaaaagaaacttcttgtcctgttaggtcagtgttatgatttaatggttttaattacttaaccaattttaagaattgacaatttttaaaaatatttttttctaccattctaaagtaatgtcttttgttgtgggtttatgtgtaactacaggattttggaacataaacattttgaaggatagtcaatggtatttagtcttggatataaaaatagagaaaatttatagctttatgttattaaaataatttatcacacagagtgatttgaggttttcgcagagtagatttgtttgactcatggtttattagtctggattacttaagaacaatatgttgattttaatgttaattcccactaaatatataatattgataaatacatgtgaaattaatattgtttggaaaatgtagaggacacagctgggaattatgaatgcttttttcttaataggtttggtgtgtgtggctttgaatggttctgctgatgcatcatggaaagacagcagggaactgtagcctgccatcaaaactgtatcaactcttttaatgagcatgtgactgtattaggtacattttgaagaatataagtactgatgataaagtctagtatgcataataggattttggaggcatttcaggaattttccttttatagtatgctttttaggcatctgtatgtgtaatatcatagtatcatttattgctgggatggatcgaaaagcactgcttttacttttctgataagtatcaaaatgattttccagtaccaacttgactggcttttaattattgtcacacacacacaaaattcaactcctcaaggtttgggaaaattgtgtatttttttgtatacaagataaaagtgtcataaaaaggaatggatg

SEQ ID NO: 168 - protein, 145 aa, Homo sapiens
MAVSTGVKVPRNFRLLEELEEGQKGVGDGTVSWGLEDDEDMTLTRWTGMIIGPPRTNYENRIYSLKVECGPKYPEAPPSVRFVTKINMNGINNSSGMVDARSIPVLAKWQNSYSIKVVLQELRRLMMSKENMKLPQPPEGQTYNN

SEQ ID NO: 169 - DNA, 21500 bp, Mus musculus
  misc_feature (1)...(21500): n = A,T,C or G
ctatttaaatagcaggacattgcccctgtgactttacagcctcctttatcactcggcaccataaaaccacaggtgtgttgggctgctctataaaaacaggtgttctgtgtgccccagtcacacttcacccagtgtgtcgggataggattactatctacttcttgactgcacagaatctcccacgaggagctggcaggaaaagagaagcaggacggtaggggacgcaagaagtagggtctcagctcccaggcatctgctgcccttgtgcatggcctgggtgagggcccactggggtcacctgtcccagctgcccttctcgttttctctgccagtcttccaggaggatgcctggcctacccactggcacttttaccctttctatctgcgttgccatgatgggacctgcctgcttaaatcttacttattaactttacaaagatatggcaggctgcgattacaggagaattgtttgagagtgcagtatctcgctccttcccacgtaccttaccctgggaattgctttgtacctgcacattgctgtgtgctggtgtgtgtttaataaccatcaataaagataggcctgggaaaacacggacagacacagattcctcaggaaacgagtatccaggagggtgctggctgcccacaggtgatcactgggtgtggtcaaacgtaaacccacccctctgactaagcagttaaaagtttggaaagtaagtgtggcctgaggatcccttaactgcccatacaactgatctccttaaatcgaagctgattcctgtgtttatgatccagatatcagagtgtctactctgcaggaggttatttcccaaatagctcatttactagagaatcaagggaaattgggagtgtgagatgcagcttagcatatatagcttaactgtacactgcttgcctagggagcacctggttccaattcttggcaccatacacacacacacacacacacacacacacacacacaaataataattaagtaaataaataatgaaatgaacattcaataataataaaatagaggaagtgtgtgtgtgtcgggtggcatttctgaactatgaacttggaatgtcaccattccaaacagatgaataacatttgtatagtgggaagatatggaagtaactgtcgaatagatacataactctgactcccgcatactaggtgctcaaaaagtttgttgtgcagaattaatcaactaaccagaaatggaaaaatctaaccttcactctattcacagtcaacagcattcattagaaacaaggcaaactgactaggagccttccaccaaggcaacagaccagtccagataccaagtcgctggctgtccccagcagcaggcctttgagagtaactgaggagggtatagatcatgcaggacagtacttgaacttgggtacttggttcctaagtgactgtgggagcctgctgagattaaggcccagctggatatttgtgcaagtcacacagtgcctggcaacctcctccaggagctaacaacatacttgatcaagaggcctctcctgtgaggtcaggccagcttggcatgctccagcatgtttccagagagctcattttccatgggccttctaggatagcagccaagattggccctgttgcagttcagtcccacaaaaggaagaactcagttcatactccacacaatgtccacatactgagcaaccccaaggggacccaaaatagtctccaccacacccacagaagttgaagggatgacagagattaaagtttggtcctgagtctccctttgtcctgaaccatcccgtgacctctcgggaacctcttccccccatgcggaccccagagcaggatgcagtctctccaccccattccctggcgccatgaaaacccacttccattctgtgagatttgatctatgactacagtgctacagaccacacagggcagatgactaaccactgagaaagggaacaagttctagaattctttcaaggaacctcagtgggaaagccgatgtcacgttctaagatcttccgagggagactatagcagacagttgtgccatctccctggactctcttcctgaactgttctctaagttcagcatcccaaaggaaaatatatagttcacacacaagcatcatctctcagcaacttgggaaatcattatttgtcttacccatcccttggataaatgtggtattagcccaaagctcaagcaaggtctctctctctctgtgtgttctctcccctaaagtcatgtttctgagagaaaaacttagcatctgaagattcaaattccagggacagaactattctctctccccatcttcctgtcccagcaatggttctcaaccttacaacgctgtgaccctttaatacagatccttgtgttgaggtcactcctaaccataaaattatttcattgctacttcataactgtaattttgctagttatgagtcatcatgtaaatatgtagggtatctgatatgcaaccccatgaaagggttgactgaccccctagagcagtctctacccacaggttgggagccattgttttagtgcataaagattaaccctaagagagaaggccaagtggcttggcttagcttggatggctgggaggggccaggctgcctgtacttgtggctcctttctgtctcctggaactgaggagtcaagattccttccctcacagagaagacaggatgataagcaaacctgggcaagacagtccagaaaactcagggatgtctgttaaaagctccatgcttcagattacccaaggtgcaccgcagcagggcctcttcctcctcagctgaaataccgggtaatgcagtgacccaaagtgtccttctcctatagagagggtagggcgagtttctagatcgaaaggtggagagcctgaggctggtccaggattggctactccttctctagagaggcaaccacggacttgtacaagccatttcctcctggcctgtttcctcacttgttacatgaacgaagaatctctttccgtggtgcctggagcctgtggcttcctataatctgagataaactggaggatggagcggagcagaggagattgaaaatatgttgtatgtattcacccattacacacacacacatacacacacacacacacacacacacacacacacacacacacacaccctgctgaggtactgggagtggtatgtaaggtctcatatatgctagacagggcctcctaagactaagctgtatccccagccctcgactttctgagacacgatctaagttaccaaggctggtcttgaactctttaactcgggtgggtcttgaccttgtaatcttccagcctcagagggatttatagaccagcatcaccaggcccagcgcatatcatatccattcttgaattttactcaattgatttttctgggcagttatatttattttggttttgatttttagagagacttcgggtctgatgtcaccatttgagtggcttatctgcaagccaaataatttcaggtcgtgggttttgagggccctagcttcacccccacattcctaaccttcccagagcccttgagcctgtcctcacatgcctcagtcattaacccagctggaacctttcttgccctcagtcctgaggtagcatcccatggtgcctggaaatgccttccccacctctgagccttcaggcttacctcacagaagtctcactgagggttaggctaatggctatgagcacagttagggcctcctgagtcccccatgcctcagccaagtgggagagttgagcagaccgtgggcaccccacccccaccctgctgaggaaggtcttcttggcagccaccctcctccagagcccattagggaagtgcacattcccttggtctcgctggctccagtgagtgttagggggcgggggagcattacaggctattagccaatgttgaaagcctctgttttccaccccctcccgacttctcttagcaccgtctgggcttggccaggaatcaagcctttttttttttttttttgttcagaagtggcgannnnnnnnnnnnnnnnnnnntctccatctaaatgctggccagggatcagcttaggtttctggggttgcagaaattaagactcattattaatatctctactttaaaatacaggccctggctggtgaccggaactctgtaaatcccaccctaaaacaacctgagggccacagtactaccgaagtgggtaagcctgggctatgcctcctccaccccccacaactcaccccttgcctcaaggcttacattgctgtatttcctccagctagcccttccctctctggaggttagggtgcccactaggaggcacagattgcctaaacctttctgaccccaaaatctgggggtcatccttgggtaagaaggtgaggcacttgttcgtttgagacatatttattagatagacacaaaggggacataaagacatatagaggaacaatttcgaattcattttgagggttatgagaagttctctttggggattctgtgatgagctcaaagactcttatctaagaagacatcatgatgacgatggtgatgatgatttcagtaaaggatactgatgccagatgccatctaaatgcctgcctgacatcaggctaaaaaagaggccacaggaaaatgatctccagcttccttcttgcccccggtctcgccaggaggcacccacagacaaacatgcaagtacaggatgcctggaatgtcaaatgtgtttctggacactcccagctgcaaggagctagctggctgccaccccaggggaaaggcaaacacgtctcttctctcctaggctttatttttctcacggtgtctgaaagggctgtgatcaggtgatatgtgtagggctgctcccagtacaggtgcggggcaggtaggaggggaggtgagcgatccaccccgcccagtgtgtgcttactctgagctctttcaatagccctaccaggagagctcttggcaaggcagcaacctccatctctggcaggctgcagggaatccgagtgtgagaaagtcagtcatgcgagggagaaagaaaaaaaagctttgagtcctcgggcaaaataccaccaccaccacccctccctagctctaaaccaaacccacaaaacagtcccaaaaaccgagtggggaaaggggagtctctcccaggctacagatacttgttttatgctttaaaagccaacaggtgataaagcaagacagagaagtcagaccctcacgggtggtgggttacactggggacaggcagggagaagcccccgttacaactgattactgggcacaaagcagtgtttaagattctgttttattgacaccataatgggagccaaaagacctccactcaaaacatccccactgaggcacaggactccgtcttcctcctgctttgggagtaggggaagatatgactgaaaaacattccttggaacttttcaagtcgaaaaagcctttctggatattgagttcactgccctcgttggcgttggtgggtggacagcaccaatttgacaaaccttctctgtccagagtaagagactaaaacctcatctatggggtctgtctgcaaagcgaccttgttcttgaatacttagcagagtcaagactcaggacctccatggcttcttaacactatttcaagagggcagtgcagaggcacaaacatatacataatgtttgatcacatgggtctgctgtccctctacttagaactgtgtatgtgaagtcagttgctcactctagcgggtaaatgttctaaagtgacagttaaggagttgtggttaactccctgacccatgggacagcatgaggctgcactgggagaccctatgtgacttattcatcctccacacactttcttggtttgccaggaaccaaagcccaagaggcaatagaatcagactagagaaacgttagaagggacgatggtatcctaggttggggcatgagggcttaagagcagacagcagtcaaagtcataacagaccttattgcctaagaagggtcttggagggaacctggagagggggtaaacgcccccaccccacccactgggagaatttgggcggtgttctgttgttgagggtttttggttttggttttgttttgttttttaaagagctttcaaagaagcctaagaaggttattggggttgaaaagaaggtaaccccacctttcacctaaaggattttcaaacatacaggaaaaccccactgtttaaaaagcaaccgattttctttcagcagccactactttcccatctgtttaggacatgaaaggagtgcccaaactcattggtccaggttgcagggtaacaaagaaggcattgtttatcatttcttcaaacaagatagggaccggcccactctgcagcatatatatattctctctctctctctctccctctccctctctctccctctctccccaaaaggcaagtcaaacactgaggtaaaggtttatctgcaaactctggggagggctgtcctggcgggtagaagagaggcttagaagataaaaatggttagaagcctgtgaaataatagacaacagctcgcccagggcaaacaagtttctaactcaagtcagtggagtgtgtggttagtggtcaggtaacctgaaccaagtaggtagcatgtcagcctacctgtgccacttaggagccctctctactagtctgattcccttagatggcctgtgtctccaagccctgcagtccgctcttgacactttcctcagggtcacctaaagagagccctgatgtcttttctccactgcgaacctcctttgtggctcttcattgtcttaagggaaggttcagagtccttcataaagcaggatgcccaagggtcttgtgtgtggtgatctcaaatttcttacatgtccatttacacccgctgtgagtgttctataactgaggacatcaggttctgtgccttaaacgccatcggtagctcccttcctctccatccccatgactcagcatatttccaacacctcagccatatttttctgaggtacagaatacagatcctctccaccagtagccctactagaagcttaacgtatgactaattgttctggattctctacatccttttacttctgtctactgcctcttttaaaggcactcccaggggaatcttgtggggaatctatagatggcagccataccacacagatacctggcaacgagctttctaaaggcactgttaatgaactacacccgatgaaggcttcatgacctaaaggcacccctccggattcaaccccccgcaacacgatctaagcccccaaagggaaaaacagaatccccaagcattgtccagaaagcccggttctgtgcgcccctgcagtaggttggagaataaatactccgtgggagcggccactctatctctcatcgtggtaatcccagggtttaacagtgtctggcgttccatcacaaaggggggtggggggggcttgcccaaggtcatgcagtcaaggaagcaccacctcgtccgggaccagagctggagaaatctttcacatgatctcagtgggaggttgggggaggggacgaagggacgagccggtgcgccttgtgtgccaggcctcccggacgcgggaaagactgggggcggggatcaaacaacgcgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgggggctcagctttcgggccgccgcccccgcggattcctggctcgcccgggccggaggagggggccccggacacacggacgcacgcacacaccccacacgcagcgcgcgccaatgagccctggccaggcgcagggggcggggttttcccaggctcgagcacagcagctgctatttaccttcttggcttctcccggggaccagaggcggcccccgctccctcccggccggccgccgccggcccccgcctccctgcccccggggcgcgcgcacacacactcacacacgcacgcacacacacacatcctctgggccccggccgcagccgcggcggcaataaaacatcctggcacgtgctccgactccaggcgcgccctcgccggccggctgatgtcaaactgcagctcggctggtggagctcttaaagggctcgcgcgcggggcgccgaggccgccttggccgcccgcggggtgaggaggggagagccccgactcccttgcccgccgtctatccgtattgccaactgggagcctgcggggagaaaggtagagagagtggcggaggaacgagcgcgcccctcctgtcgcattgctatcaaagccccccttgttcattttttttttcgtttgaaattccatttcctttctgcccagtaggaaattattctgattgttttctggagaagcgtgaggtccaaggttgcaattccaagagaggaatgaatgggctagagggagacaagcatccaaaagacaccttgctccgaaaaccctggctgtgaaggcatttggggggacggtaagggcatgtttagcgtgtggggtttagtatctccccaacctcatgagcagttttgactcccctaaacatacagagttcgagcgggaattccggaagacattagagtaacacatcctctttaccttgttccctccttttttcaatcactaaattttgtcttggcctatatctgttcaaaatatttttcaaatgaacttattatacaaagtagttatattgcatgcagcaagaacaataaaaaccaaaggcctggccacaaaagaaatagactagactaaaactaagcaaagcccagaggaaagagttagcaaagggttaaaatccttttgattgacgttgtagcctccggtgccccgggctcaggcgcgcgccattggccgccagaccttgtgcctagcggccaatgggggggcgcagtccacgagcggtgccgcgtgtctcttcctcccattggctgaaagttactgtgggaaagaaagtttgggaagtttcacacgagccgttcgcgtgcagtcccagatatatatagaggccgccagggcctgcggatcacacaggatctggagctggtgctgataacagcggaatcccctgtctacctctctccttggtcctggaatagtgctaccgatcactaagtagccctaagacataataaaccttcaactgctcagtagtttttcttatgaaagtcaagtaaaaggacgtaagcaaaaaaaaattattttttttttgcgtgaaggattccaaaaataaaattctctggggactgagaagaaaaaaaaaaaaaaaacgaaaatgccagctgatataatggagaaaaattcctcctccccggtggctgctaccccagccagtgtcaacacgacaccggacaaaccaaagacggcctctgagcacagaaaggtaagacagtacctgcgtctagaaattaagtgggttgtgcacagcgggactccttttacttttctcttaaaacctcggggtgaaatggcagatcccgtgggaactcaggacctcttttctccccctttgcagtcatcaaagcctatcatggagaagaggcgaagggcaagaataaatgaaagtctaagccaactgaaaacactgattttggatgcacttaagaaagatgtaagtgagcaatgcttttttttatttttaattacgaatggaatggcatttcccaggcacaaagaactaagctcttagcctgctgcatgtggatcttaccccgccagcactacgttcccactggcgggagagaggccgccgggccctgggatgtgggacatgcgggcggggaccttcagaactcggaggcagctgacaaggaggactgactttcatcccttgttttttctgcgcagagctcccggcattccaagctagagaaggcagacattctggaaatgactgtgaagcacctccggaacctgcagcgggcgcagatgaccggtaaggaccgcgcgtgcgtcccctctctgcgggtgtccctctcggcccgcggtgatttcttccagacttccgcccgcggttgtgagaggcattcagctacattttactgccttggctcactccgcgttcccacggtctgggtcttatttatagccacagctcccaagttgttactgctccggaaatggagggagaggctgtagccgagaagggtggtgggcagcttggctgtggtagaagccggtgagggcgaaaggacgtaagactgaggaagtttggggctggatagaaggtaggggtcagtggtttagcaccggtccaacccctgccgcaggaggggaagtggggtttggaaggcgccttgggtggcattgtccaaggtcaggtcgcgcgcgggactaggggtggcagatctggagctgagatcggtttagatggagggagtgtcctggcttatgtccccaacctagggagaaggagctggctgttcttagcctacccaaccctcccaaccccaggtggttccggaggcgcgctgcggggacctcccagggcgggaggctgtatggctcccggggccagggcttttcggtgacccatcttttctccttctggcctgcagccgcgctcagcacagacccgagcgtgttggggaaataccgcgccggcttcagcgagtgcatgaacgaggtgacccgcttcctgtccacgtgtgagggcgttaacaccgaggtgcgcactcggctgctgggccacctggccaactgcatgacccagatcaacgccatgacctaccccgggcaggcgcaccccgtcctgcaggcgccgccgccgccgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatgtgatgccaaagatgtttgaaaatgctcttaaaatatcttcctttggggaagtttatttgagaaaatataataaaagagtgaaggcttttatgtcttagaactgattatttcaaaatttgtaaaaaaaaaaaagtggtggggcttgaaattcatgtagtttggcaattcagaaataggatgtattttttaaagttttaaacaggaaccatcaaacctttcagcaacactcaatgatctaagaagacctaatttatgagaattcatttgatggggctttcctgataaacagtccttatttttttaccttccaaagggcggctcccaactcactccctgtagtagccactggcctcctaaagtaaaagcgcgctcaagccacattgcagccctccagcattgggaccttcatttgtctgtccttactcaggcgtagctaggcatcccctggcacccgtatcacaaagtttgaaatgcctctcttcaccctcttcaagcaagctgaaaaggtcaacagattctctctgccagggtacaactagttagactcccaagtggagcccgggccagatgattaacagcagacatatgtttctgataagtttctgcgcttgactttaatggagaaagcatgtgggggttgcgctggcaggcacacgggccgtttttccccttttaatacaaacagcaagcgaccccttcgcatggtcatgccccatttccaggcaagatgtgggctccagatagaagcaaaagggttgtctcgggtttcagctcacacaaccctccttaacaagtcctaactcaaagcggacagctttaaactgtgccaggatctgcagggaatttcttccaaatcccatcacaaaggcttgtcagattttctcagatttggccaggtgtttgactgcatccaggtgttggggaaatgaaaaccacgagccctgcgagaccagacacatcagccgcgctgtgggtctggccggcgcgcccttcctcccccacagccggccagtcctccgcccagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggagaaggcaggcagggaccacctcggacatcccccaccccaaatgccttgcaccggacaaggatgctggggaccctaagagaggggagcctcgtttctaagcaccttgagcacctactaagctcccggcagcctgcagctggcgctaaaatgacaactttggtggcaatgcagtcctgtttagccaccgagacagcccagcttgtgactaatcccacgcgtgatgtattaggtgccaggacttaagtttaaacagagggcgcccagacggatgagttcctgctgaggaagaaaccagggaagtttttcccttcaagcagggaggagaaaaagtcaacacaaaggacaaacaggctctaggtgtcccctagtgtcctgctgttttctggcacaggttcgactggaactggagaccaaagccgcctgcctggaccacagggatagccggctgtcctcatttctctaatagaacggtttacctttaaaaataaaaaaaaaaagtcaggagcaaggtgtggtggcaatccccccaggcgcttgggaggtggagaactagtaggaagtgaaggaacaaggtcaattttgtgttagttaggctagcctgggctacctgacactgtctgaaaacaacagaaataagttaggatttgaaggcgggcagtggtggcacatgcctttaatcccagtacttgggagacagaggcaggcggatttctgagttcgagggcagcctggtctacagagtgagttccaggacagccagggctatacagagaaaccctgtctcgaaaaaccaaaaataaataaaaataaaaatacttaggatttggttgtcaaagagaacagagacagttaaaatgtagatggagaagttgtagttttactctttaaaaaaaaaaactaatgttttactatcgttttttgtatttaactattcaaaatacaagctctgtcagagttcagaaagggcaaagctggccttacatccctgcctctgttcttgttttactgcaacatagcaatcaggttggaagcacatggtctgggtctcgttccctaaatgcttgagcacatcaaatcatccatctgtttgtgctgtggttttgttgttattttgttttttgtcattaatttattcatttcacaccccatctcagccctcctcctctcctcccagtcccaccctcacactcctccctcctcctcatagaaggggaggcctcccaggggtaccaacctatcaagtcccagcagggctaggggcatcctctctcactgaggccagataaggcagccccagctataggaaagggattctaaggcaggcaagagagtcagagaaactccccactccaattgtttggaggcccacatgaagaccaagatgcacatctgctacatgtcttacagatatgtacgtccaacccatgcatgttctttggctggtggctcagtctctgtgagcccccatggggctcgggttagtcgactctgtaggtcttcttgtgatgtccttgattccagccgttccctcagacttaccctgactcattcacaggactccctgaactcctccacctaatgttggtctgtgggtcactcaagtcattcaggatgatcttttctagttccatccatttacctgcaaatttcatgatgtccttgtttttaatagccgagtagctttccactgtgtaaattttctctatccattcttcaattggggtgcatttagggtgtttctggtttctggctatatagtatttgaaattctagctagagcaataagacaactaaaggaaatctaggggatacaaattggaagggaagaagtcaaaagtattgctattcacaggtgacatagtagtatgcataagtgaccccagaaattctacagaaaaacccctacccctaataaacaccttcagcaaagtgtctggatacaaaattaactaaaaaaaaaaaattaatagccctccttaacacaaacagactgagaaagaaattagacaaacaacacacttcacaatagccacaaataatagaaaatatcttggtgcaactctaaccaaacaagtgcaagacctgtatgacaagaactttaagtctctgaagaaagaaattgaagatttcagaagactgaaagatctcccatgttcatgggtagaattagcatagtaaaagggccattttacaaatgcaatctgtagattcagtgcaattcccatcgagatttcaacacaattctttacagactttgaaagaacaattttcaacttcatatgaaaaaatctgtacaataaaagaacttctagaggtgtcacaatctctgacctcaagcaagggtaataaaaactgcatggtattagccaaaaacagacaggttgaccaatggaattaaatccaagacccagaaatgaaatcatacacctacagacttttgatttttgacaaagagaccaaaactattcaatggaaaaaagaaagcatcttcaacaagtggtgctggatgtctgtatgtaaatggacttgaaacctctgcaatggtgctttgtggaaagaccacagtgtgtattcaccagataggaaagctagcgatggccttttgctcattgattttttagcatctacttgtaattgcaccacaccccaagggagacaacagtttcttccatagtttctaaatttcatgctagttattaagccaggcactagaggatagaggcatgacttctgtagctaaatactcacagcctggccctcaagagaccaagtgaaaaaaaagtaacaatttaactcattacaagttaaatgatatgaaaggggaagtgttactcagggttgatacaaaagaaggctctatccaccaagcaaccttttgaccttctgagttatcattaacacttgttacaatagacattaccagtataatcaataattggtcaaagtttacctaggaaaaattattgccaagtatttaacttcaagagtaatcattctgtggtctggaggcatagcttagtcatagattccttgctgagggacctataggtatcataaatacccgtgttctccgatgttctgagaccctaggttcaatgcctagaacttaaaaccctaccatcgcctaaaaaagcatagtcaacacagtcaagaagaaggactgagagtcaggaaatgtggcttccagtgccaagtgggccactacctaggagatgccgagtgcgtccacataagtgtctgagctctgggttcccatgcagctaggtgagaaggctaaatcaggaatccctgaagtcctttcaccaacatggtccctgcacatgctctcccgctgacacacctacatgaggcatacttccagactgtcaactacagccctggcattatttcacacccatcattaacatatatagaaactgagacctcaagaatggaccctgtacatcaccactgctataaaaaggccacctgacatgctaagaagactcatgcttccactagcacggtggttctcaacctgcgggttgcaattcctttggagggtcaaatgacctcttcataggggttgcctaaaaccatcactgtcggaaaatacaggcacttatgttacaatttataacagaaacaagattacagttataaggtagcaatggaaataattttatggttggaggctcaccataacataaagaattgtatttaaagggtggcagcattaggaaggttgagaacctctgctctagtgcattggaggaggaccacattcacagagtttgctccaatatagtctgctgtgatcctaccctttgttgtgattatcagagcacgatgaggtaaaatacccctgttttcccactttcccatcctttgcatctgccccacaccccctaccctagcccccaacccccacttctttaaaaagaaaatgcaatctgcaaatccttaccaggattccctccttttcagaagctctcttccccaactggctaggcgtcccccattagtctgtttgcctaattaagtgcacttaatgaactagtctggctagacactaatgccagtctaaattagcgaaagtccaaatctcagctatccaggaggtataacagtcactttgaaaatacacatagtgagtttgaatctggtttactacaagtactttacattcataagatgaacgtagtaggggcctggagagatgtctcggcagttacgagcaggtctcaagtttggttcccagcacccacatcaggcagctcacaacagtgtgtaactccagctccatgggaccagaggcctctgggacacccgcactcacatgtacatcctcacatgaagacacacagacacagctacatataattaagagcaacacaaaacagggtgatgtcatttaaagactcagagcaggtaaacacggctctggttttattatttatgctataaatccttgtaacaagaatgaggggagccccgatggcagcccaagtaaatacttgtaattgaaattaatgacaaggcttcgctgtgactatcctcctgtttccacatgtgtctctccttctcagttgcacgtatggctgagtgacggcagccatggtgcctgaggaatacctttttttttttttttttttttttttaaagatttatttatttattatatgtaagtacactgtagctgtcttcagacactccagaagagggagtcagatctcattacggatggttgtgagccaccatgtggttgctgggatttgaactctggaccttcggaagagcagtcgggtgctcttacccactgagccatctcaccagccccgaggaatacctttttgcttaaagactttttctcataagtgtgatctgttttcatgttccgcctactttataattcagtggtcaatgtgagacatgaactgtatagatctagtctacaaacattccagcctggagcagcctattagggttggcaagcactgtgccagactctgggctttctggtagatagcttgtcttctaccaacttttccccattgatatatggttataaaatttatccctaagccatcaagaccataaaatggggttatttcttagcagagcacaagagaataaattcggtgtgtcaaacccatttcagaagctaaggccctgaacagcatttcagatgttttaagagcaaacagcgttgtttcctggcatgcgatagcataaacatatgtgtgtatatatatgtttatatgcgctcgcgcgcgcgcgcgcacacacacacactttcatttattttgtgactctctaatgagggctaggatccaaggcttaccggaagccttcctcaagccctttaggtaaaacacatgttctagggaccagttccccttttcatcctctgctaaggccctcctcagccttgccactctctgggtcttaaaggaacacctctctccctccatcctcccccacacctggcacagaagctttgatgactcagaaaattgggatgaggagttgagaggtaccagaccaggagagtggcttaggactagagaggtggagaggagagacacactttctgccttctgtggagccttggcagaaccactgctcttccttccttgggtaaaatcctgtccctgtggatcctctctccccaactttttatctcctgccttttccccttaaattcaccacccttcaccccccccccatgactcctccatcctctccttgtttctcaagtactgtctctaaattctgtcctcttccctcttcattgccatgtagctattttattatgattatgattatgattattattattattattattattattattatatttttttattttgagataactattctgttagccctggctgtcgtggaactctctttctctccctgtagaccaaggctggccttgaactcacagagatcagcctgtctctgtttccaggggttaaaaacatgcgttaccgctccctagctgtattttgaacttttaataatcctccacccccctgtccctcctcctccttctcttcccttttcctctgactatagtttggtagtggctcccaaaggccatggtctcccagtccctactcactacaggaaagagataggaactttagagttgagggctgatgcttccttcctcccacacaccttgccaagagtgatgttcatatgtcacattcatacagattcctctgggggacagaagagggcatggaatcccctggaactggcttgggacctatcactcaggttctgggaactgaaccctggtcctctgcaagagcagaaagtgctggtactctggccccttctcaccattctctaagagacagccagagacctctatcctccattctttccaaggatgcctgcatcttgcttagatccggcatgccttttctgtctctcaaccaggctcattctgtaccctgggctctactggcatgccctgatcaggcccactcacttacttcctgcccttgcttctgccaacaactgttcgtaggtgctgagccgtacaaaaattccattcatgaaactccctcctccttacctaccatggcatcctctgcgtttaaaattcttctggagactctgcaatatctcagcatccaccttgggactcttcttccaccccaccttccactgaaatccattttcttttggcaatgatgtccatctgtatgttggg

SEQ ID NO: 170 - DNA, 510 bp, Mus musculus
atgccagctgatataatggagaaaaattcctcctccccggtggctgctaccccagccagtgtcaacacgacaccggacaaaccaaagacggcctctgagcacagaaagtcatcaaagcctatcatggagaagaggcgaagggcaagaataaatgaaagtctaagccaactgaaaacactgattttggatgcacttaagaaagatagctcccggcattccaagctagagaaggcagacattctggaaatgactgtgaagcacctccggaacctgcagcgggcgcagatgaccgccgcgctcagcacagacccgagcgtgttggggaaataccgcgccggcttcagcgagtgcatgaacgaggtgacccgcttcctgtccacgtgtgagggcgttaacaccgaggtgcgcactcggctgctgggccacctggccaactgcatgacccagatcaacgccatgacctaccccgggcaggcgcaccccgtcctgcaggcgccgccgccgccgccc

SEQ ID NO: 171 - protein, 170 aa, Mus musculus
MPADIMEKNSSSPVAATPASVNTTPDKPKTASEHRKSSKPIMEKRRRARINESLSQLKTLILDALKKDSSRHSKLEKADILEMTVKHLRNLQRAQMTAALSTDPSVLGKYRAGFSECMNEVTRFLSTCEGVNTEVRTRLLGHLANCMTQINAMTYPGQAHPVLQAPPPPP

SEQ ID NO: 172 - DNA, 22473 bp, Homo sapiens
  misc_feature (1)...(22473): n = A,T,C or G
cacacacacacacacacacacacacataatgtgtatatatatgtgtgtatatatataaaatgtgtatatatacacacatataaaaagtgtgtgtgtgtatatatacatatataatgtgtgtgtatatatacatatataatgtatgtgtatatatacatacatacatatatataaaaaaattttttttactttaatttccgggatacatgtgcagaacatgcaggttcgttacacaggtagacacgtgccatggtggtttgctgcacctatcaacccattatctaggttttgagccttgcatgtagtaggtatttgtcctattgctctccctccccttgccccccaccccctgacaggccccagtgtgtgtggttcccctccctgcatccatgtgttctcattgttcaactctcatttatgagtgagaacattcagtgttcggttttctgtttctgtgttagtttgcagagaatgatggtttccagcttcatccatgtccatgcaaaggacatgatctcagcacacgtaggtttattgcagcactattcacaacagcaaagacttggaaccaacccacggcccatcaacgatagactggataaagagaatgtggcacatacacaccatggtagcctacgggattgtatgttacacctatggcaatacaaacagcatggcacgaacaactaactagtaaaaagcgatgcagcttccagaattccacacgggccctcattctcaaacctggtcttcttttctgagatcttcccagaaagcctttctgcactaaatgctgaactaggcagctcgaccctccgtgcagggacgcctgggatcctacttctctgtgtcatttccggaatctgctcagtcatccttttgctaagtgggactcctttccctcatgtctctcccttctgattttcctccacaagaaaaggaacttccctcatttcctcttcccgcaaagatgcacctgtcctccggattactgacattctttaccagattgacagacatctcttttgtcctctctgttccaatttctggaaatctgattcttgtccatggctctccttaagaaagaaaagtcagttctctcctggcctgtaagttcctttctccaccctttctctctagaggtactattttccagaattcctgtctatcccatatccggagtccccaacagcccacagcccagccaaatgtctcctgcattgaccacataaatccaatctctcccttcctgggatgcccatcagagcccttccagcctagacaatctagaacaaatggctgtgtatgaggaccaaatgctatggtggacgcgaaagtgcctcgtcaactgtcaagtaataccatgtgggtgacaggtaccttaggaacctcccactctgtagaagagaccagaagggcccagtcatgctagagcccatcagtcttttttttttttttttgagacagagtctcactatgttgtccaggctggagtgcagtggtgcaatatctcggctcactgcaacctctgcctcctgggttcaagtgattctcatgcctcagcctctgagtagctgggactacaggcacgtgtcaccatgcccagctattttttgtatttttggtagagatggggtttcaccatgttggccaggatggtctcaaactcctggccttaagtgatccaccggcctcagcctcccaaagtgccgggattacaggcatgagcaaccatacccagtcatatcatcttgagctgcagctgcggcagctgcctggaccatcttctcctgttctctatgcctgacatctaaaagtaaaatatatatttcatttgcaaacatcatctctcaaccacttggaagatccattatttttctcacttctccctctcctaagcgtgaagccggccagcagcacagtgtcttagtgctccagccccttctctgtattcctaccatcatgtcttctctggtcctgagataaaagcgtagcaccaccggagcatcagttctggagctagaactattccctcttccaatcttcctttcagagcacaaatcagggaaacacattggcaattataagaagagaggacatgtggtttggcttggtttggtggactgagaggcagcctgcctatcctggacagatcctgaaagagacttcctatgtcctggagctgagaaattaagatcccttctttttcagagaatatagcgtgatgagcaaatctgagaaaggagaatcacagcacggcaaacctgggactgtgctctgtgacactaccaaaatcactcaccagcagatgnnnnnnnnnnnnnnnnnnnngcagggtgggggtcaatggatgggaaattactaagaggaaatatcacagataaggggtttctggctgacttgacttaacaggagtcttgctgaaggccggccagggtgatgagataccaaaagtgggagacttttgctaaactgacttggcaggattcttgctcagactggcttctataaggacagggaaggaagccaaggtagggcctagtcaagcagaggacccagaggagcccagctaaagttctggtcgaaggagacccatcatcactatttaaaatacaagttagaccgggagcggtggctcatgcctgtaattccagcactttgggaggccaaggggggtgggtcacctgaggttgggagttcgagaccagcctgaccaacatgggaaaccccgtctctactaaaaatacaaaattagctgggcatggtggcgcatgcctgtaatcccacctactcaggaggctgaggcaggagaatcgcttgaacccaggaagcagaggttgcggtgagccgagactgcaccattgcactccagcctgggcaacaagagtgaaactccatatcaaagtatatatatatgtatatgttgtatggccgggtgtggtggcttaggccgggtgcagtgactcatgcctgtaattccagcgctttgggaggccgaggtggacagatcacttcaggtcaggagtttgagaccagcctggccaacatggtgaaatcccatttctactaaaatcacaaaaattagccaggtgtggtggtgcatgcctgtagtcccagctacttgggaggcagagatgagataatcgcttgaacccgggaagcagaggctgcagtgagcctagattatgccattgcactccagcctggatgacacagtgagactctgtttcaaaaaaagaaaaaagaaaatatgttgattcatcccaaatcactttcaggtcctaagttttaccaaatggtttttctggatagctcagtttttctgtttttgatttttggagaaatttggtctgacgttaccatttgggcagcttatcagcaaggcaaacacatgcatgccctgagtttaaaggggatgggcttcaccccacattccagaggcttcctgaggtccctgggcctgcccccatatgccccagccccagcatggctctgaccctttcatgcacaagggtacaagttagcatccctgtgatccctcagggataccctccttcatccctggccttgcaggctcgcctcactgaagctctgctcagaggttaggaggttagctgggagcacatttagagcctgcccaccgccgctgctgtggctgggccaaacgtgtgatttaagccattccaggatgccccgcccccaccctactgggaaaggctttcttggcaaccatcctctttcagagccattagaaaagtgcacattcccttggtttcactggctccaagcgagtgttggggggtggggggagtattacaggctgccgttagccaatgttgaaagcttctgttttccacccccacctccagtttgcagtgcaaggtcctagcttggccaggaatcaaccaggcattttgttcagaagtagcaactcatttttatcaaagatggaatgcagttgcagttgtttctaatgcctctgcatgacaaccagggctcttgctccaagcactcccgactcctcttttccccgcagacactttgctttctcacctatccctttctacatccaaaaattggatgcagagctgctcaagtgcctcagaattcaggagtcaaaagttgtagcaattcaaagtagctttattgtgtctattttaaatgcaggctttggtgatcacaactctataaacccaaccgaaaattacccaaggaccacagcagttggtgtggtgaaaacagctcccagctggcttctgcccaccctacaccccccacacacccccagccttatgctgctgtgggcagctgagcaagtcccttccctccctggggcttagagtacccactagtaagcagagactccagatcagctttccttaaccttttttgattgcaaagagctttgcgattctgctgaaagctgtggaccctcttctcaggagaaagaaaacgtgatgcatccatttatgcatttggaaaatatttattaagctcctgttaaatatgcacatacagacacacgttgaaattccatttcaggggctttataggtaaaaaaaaaaaaatcctggttatgaattctgcgatcagcacatacagactgctatctagaaagactatgatactgattctagtagagggttctcaagctaccagtcagcacatgccagagaacgggggcagcaaggtggtcattacaaaggtgacctctagttgccccccccttcccagcacccccacctggcacgcgccccagcaaacatgcatgcacagccggcctggaatgtgctgtttctgggcactgggactgctggaagctggctgcagccctggagagatgacaaacatgtcttttctatcctgggctttatttttctcacggtccctgaaagggctgtgatcaggtgatatgtgtgggactgctccctgtacaggtgcagagcaggtaccgaggggaggagaaaatccaccgtgtgtgtacttactcaaagctcgttcaatagccctcccaggatagctcttggcagggcagctaccacgtctctggcaggctggagggaatctgagtgtgagaaagtcagtcatgcggaggaaaagggaaaaaaaaaagcttcaagtcctcaggcaaaataccttttttcttcttctcttgctctctcctttctgtagctttaaaccaaacccacaaaccactctgatacctaggggacaaaggggagtttcactagagatgcagttatttgttttatggtttgaaagcaaacaggtgatgcggtaagacagagaagtcgcccttccggggcgggggtggggggacgctgtgggtggagacaagtgcgggagcccctggttgtatgtattgggcatgacacggtgagaacgattcagaacgatgctggtgtcacagggggatcaaagaagtgacctccactgatgaactgggctccattttctctttgctttgggagtcgggggaaaaggatgactgaaaaataaaggctgtttctatctatctaagagcattcttccagatgcagatgcttcttcctgagtttaggagcttactgtcccatttgagaaggggtggggagaggacaacgttggtcctattttcactgcctagcataaggaaactgaaaagtcatctgtgagcccatctgcaagaaactcttcttgaatggttagagtggaaagccagagagttcctggaatttatttttatttattatttatttatttttggtccagacacaaattcataattttttttgttacttgagcctctgtccccctatctaaaaacgtgtgtgtgaaagttacttgcccattccaccagtccaagcactcccaaagtggcaataaacgagttgctgattaactatttgacccacgaggctgctttagccccttcagtgagaccctaacttgaccatattccattccccatgcaccttcagggcaccaaataagagtggggaacagaatcagatgaaaaagtctcttagaatgggcagggagtggcataacccagtagttaatgagggccgaccagcagacagcagtcaatgtcatggcagagcctggcagagcctagcagagcaggcactggttctgaaagatttggggggaacctggaaagggttaacatgcttccccgggaagggtttagttcctcagaagaatctgggtcagtgtatttgggaagtttttaaaaagtcagacgctcagtagaagcattttaagaagcttgcaaagcttattggggccatggcagaaaggagggtaacttcataggctcatcacctttcaccaagaggattttcaccacacaggaaaaccctacgttttccaaaagcaacagacaattttctgtcatcaccacttttccatctgtttaaaataagaaagaaaattccttcccctttggcccaggttgcaggtcaacaaaggaggcattgttcatcatttcttcagaacatgacagggcacagctcactctgcagtgtaagaaaacattttttaaaaaaaatctcagagtagccttaggggcaacagtgagtaaaccaaagccttcgatgagggaaatgtttggttgcagactggaggactatcctggaaggtggaaatgaggcttaggttaatacggtcagagccatgattccttagttagactcaggaattaaatctgagttcctgagttcctggttgggggttgggaacactgcattaaagggtaggcaggtttgagttgaactcagttcccaagagcgtgcggtcaatgtccagaggagctggatgtagacagatgcctctgggagtcagtctgcacctgcctcctaggaaccttcttcactggcttgaactgcctaactgccctttctgcctccaagccctgcaatccactctcccacttttgccagagccatctttctaaagggaaaccctgatgcctcttctttgctcaagaatgtttcatggctctccactgtctaaagataaggtccaaagtccttcagcaagatgtttaaggagcttgtgacatggcctcaagctgcctcttccagtccctcacattccctaggctccagaccatgttccctgaataaagtcttcaagttccaggatcttggcctttaataccatgggtacctgcatcctctccagcccacgactaagcacattcccaatgccccaatcctacctatttttcaaggtacacaggccaatccctccaggaagttttccaaggtaccccaacttaaaagtaacttaattctcctgaaactccatagcattttacctctatccagacatacgtctctcttgaacctacgacttcccagaggaatttactgggccatccgtagatgtcagctgtacacgtttatatgtatctctagactgttagcttccagagagcaataacggtcttactcactgctgtaaacccaggtagaccagcaatactgttatccatacaagtatggtttcatattttgtttctgtcctcctgatctctcaagccaccacctaactcagaaaagaaaggaaaaataaaggaatgtccagtcatcaatcagaaaatcagcgtctgtctgcccccgcagtttactgtcaacttctagcaggccgccactgtatctctcaccgtggaaatcccagggtttaacacagtgtctgacactgcgcgtgtgttccacaatgaaagagagaggggggcttgcccaaggtcacccagagtcaggaaccactgaatctcatccgggacgagatctggcgaaatcattgacaacgttatctcagtggggagctgggaggccggaaggaatgaagtgtctgagaaccgtgcgccaggcctccgggacgcgggaagggctgagggggcgggaggccacatcaaacaagacgctgggctcccgggctgcccggagccgcgagccgagctcccaggcggcgggaagggcggagggggggtgggggcacgggggccggcgacccgggcaggcgggagggaggcggaggaggcggccggccggcccaggcagtgcgcgccgcccgcccggctcggcaaatcccccagggaggccgccgccagagccctggcgctcccggcccggcgcccgccacgtggcacccggcggcggcggcggcgactcctcccggcgcgcggcccggccagcaggcagcacgcagccgcccgcgccgcccgcctcctcccgggcgtccgccggcggcctcccgggcgtagtgagggggagcggcccggccgcccgggacccggggaaggggcgggcggcgcgaagccgctttaaccgcagtcgccgagcggaggcaggaggctgacccggccgcttcctaagtgcggtcaggcatcccgtgaccgcggcgggcgcccagggccccgcggggagagggcgggggcgaggagcaaacttggaggcccccacctcgcccccgggctgttgcgaatgcggctttcggccgagtgaaaaccccaagcccaaaagtaagggtggggagccgggggttgaaaaaattccccactctccaccccgggtgtgcgctcccccccgggaagagctgaccttggcctgggaaggcgggggtggggaaaaagggtaagcaccggggctcggctcccagcccgccgccccctcgaattcctggcccggcggggccgaagaagggggccccggacacacacacacacacaccccccacacgcagcgcgcgccaatgagcccgggccaggcgcagggggcggggttttcccaggctcgagcacagcagctgctatttaccttcttggcttctcccggggaccaggaaccggcccccgctctccgccgcccgtcgccgccccccgcctccctgcccccggggcgcgcgcacacacactcactcacacacgcacgcacacacacatcctcccggcccggccgcagccgcggcggcaataaaacatcctggcacgtgctccggctccaggcgcgcccacgccggccgggctgatgtcaaactgcagctcggctggtgtagctcttaaagggcccgcgggcgccgggggccgaggccgcccgcggggcgaggagggagaggctgcttccttgcccgccacctcaacgcgccgcagaacctaaagcctacggatgaaaagggaaagggtggtgaaggagggcgcgagtccctgagtcattgccctcggagccccccttgttcattttttcatttgaaataccgtttccttccacccagttggaaattattctgattgtttcctggggaagcccggggtctaaggccccaaatccaaacgaggaatttctgaaagacggggtgggggtgggattcaagaactaccttgctccgaaaaacctgcatttgtgaggtagaaggcaatttttcctttttctgcatggaaacaggaaaatttttttggcccttttcctttaccatctactttcaccctcctgaatgtaaagtctgagcgggaactttagatgtgtcggtaactcacattcttacacccgtccccccctccccccgcccccttttaaccactgctgtttttttctttattgtttatacctttaaaaaaaatatgtttcaaatgaacttactacagtcaaagcagctctgttacatatgagagagggcataaagagcaaagaccctggctccaaaagaaatagacaagatcaagaccaaagcggaaagaaaaaaaaaatctctaaaccaaagcccagagggagagtagcaaagggttaaaatccttttgattgacgttgtagcctccggtgccctgggctcaggcgcgcgccattggccgccagaccttgtgcctggcggccaatgggggggcgcggtccacgagcggtgccgcgtgtctcctcctcccattggctgaaagttactgtgggaaagaaagtttgggaagtttcacacgagccgttcgcgtgcagtcccagatatatatagaggccgccagggcctagggatcacacaggatccggagctggtgctgataacagcggaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactccaaaaataaaattctctagagataaaaaaaaaaaaaaaaaaaggaaaatgccagctgatataatggagaaaaattcctcgtccccggtggctgctaccccagccagtgtcaacacgacaccggataaaccaaagacagcatctgagcacagaaaggtaagggcggtacctgtatctctttgcagcccctcaaaattaagtaggggttggggggcttctttctgtcttgaaaccccgggatggcagattccatgggaacacagaactcttttttttatttgcagtcatcaaagcctattatggagaaaagacgaagagcaagaataaatgaaagtctgagccagctgaaaacactgattttggatgctctgaagaaagatgtaagtggggaaatgctgctcgctcttttaattaaaaaacaaacactttctcagctactaagagtgaaaccccccgccctgcggggtctggcactcgctggtactgcgttctcccaggcgggagggcccggccttattcgctggggtccagagataatgcttgcgctccgtggccgggaggagggacccccagcactctgaagcagctgacacggggctcactttcctttcttgcctactctatgcagagctcgcggcattccaagctggagaaggcggacattctggaaatgacagtgaagcacctccggaacctgcagcgggcgcagatgacgggtgagggcggctcgccgcgtccccctgtgcgggcgtcccgctcgcctcgcggtgatttcttccagacttccgcccgtggttgtgagaggcattcagctacattttactgccttggctcactcttgcgttcccacggtctggggcttatttatagccacaactccaagttgttactgttccggaaagggagggaaagaggttgcagccgcgagggtggcgggcgccgggtaggggcgaaaggacttaggactgtggcggtttggaactgcgtggagcctgggggtcactggtttagcactccttcccgttgcagaaggggaaatgaggcttggatgatggattgggaggcattgtccaaggtcacatcgcgcgcgggggtgggggtgacagatctggggctgagataggtttaaatgcagctacagggaatcgggaaggagtggctcggcttttggcagcaacgctagtgtggagaggtggctggttttttctaaacccatctcaccctccctgccggaggcagtttcacgggcgcatggtcagggaggcgcgccacagggacctcccagggcggaggcagtggccacggggccagggccgttcggtgacccgtctgtctctttctggcccgcagctgcgctgagcacagacccaagtgtgctggggaagtaccgagccggcttcagcgagtgcatgaacgaggtgacccgcttcctgtccacgtgcgagggcgttaataccgaggtgcgcactcggctgctcggccacctggccaactgcatgacccagatcaatgccatgacctaccccgggcagccgcaccccgccttgcaggcgccgccaccgcccccaccgggacccggcggcccccagcacgcgccgttcgcgccgccgccgccactcgtgcccatccccgggggcgcggcgcccccctcccggcggcgccccctgcaagctgggcagccaggctggagaggcggctaaggtgtttggaggcttccaggtggtaccggctcccgatggccagtttgctttcctcattcccaacggggccttcgcgcacagcggccctgtcatccccgtctacaccagcaacagcggcacctccgtgggccccaacgcagtgtcaccttccagcggcccctcgcttacggcggactccatgtggaggccgtggcggaactgagggggctcaggccacccctcctcctaaactccccaacccacctctcttccctccggactctaaacaggaacttgaatactgggagagaagaggacttttttgattaagtggttactttgtgtttttttaatttctaagaagttactttttgtagagagagctgtattaagtgactgaccatgcactatatttgtatatattttatatgttcatattggattgcgcctttgtattataaaagctcagatgacatttcgttttttacacgagatttcttttttatgtgatgccaaagatgtttgaaaatgctcttaaaatatcttcctttggggaagtttatttgagaaaatataataaaagaaaaaagtaaaggcttttatgtcttcgaactgattcttccagaatatgtaaaaaggcttttggtggaatttgaattacatgtaattggtaattcaggaattgactcttttgttattaaaagaacatttgtaaaaatccatcaaacttttcaccaatcctccatgaactaaaaagactaaattccatttactttacaagcagccatctggtaaggcttccctgataaacttgtggtcagtctcttaaaggatttccaaaaaaaatgtttttaagttgcagtcgggtaagtctgcagcccttgttcttctagctcctcctgaggaagattgaacaggactaaattcacgaagctaatggatccaatcctattgcccattgcacgttaagggtggttcctgcagctctcctctcagggtagctcaccagcatccaaagcaaaaacacttccaactgctgcgcctccttcaagacttggggtcttcattaattagccaatcctttggttcaaataagacgttccctagcacccaaaagtttcctctccgcaccctcttaaagcaagctgaaaaggtcaacagattccttctgccaagggacagttagttagactcccaagtggaggccgagcccagatgattaacaccagacatgtgtttttgataagtttctgtgcttggctctaatagagaaagcatgtgggggctgtgctggcaggcacacaggccatcttccccttttaatacaaacagcaagcgaccccttcgcttggtcatgccccatttccaggcaagatgtgggctccagatagaagcaaaagggttgtctcgggtttcagctcacataaccctccttaacaagtcctaactcaaagcggacagctttaaactgtgccaggatctgcagggaatttcttccaaatcccatcacaaaggcttgtcagattttgtcagatttggccaggtgtttgactgcatccaggtgttggggaaatgaaaaccacgagccctgcgagaccagacacatcagccgcgctgtgggtctggcgcgccctcctcccccaccgccggccagtcctcctcccccccggcccctcccgccagcctcctctaaccccccttttcttagaccggcttctgggaggagaaggatgaggcgggagagatcaatctttgaagctttcctaacaaagataaagccaacgattttctgtcttgtttcaaaagctttacctctcccccgccctgctctggcctttcccacaggccagtgtggagagcggctctatcataggaatgatcggggagacagcagttttccactcaagataccttcggacccagcttccaccccagagggagagatttaaaagagacctttttgaatttgtctcctacctgccttactttgtgtacatgaaaggtgtccaacacaccttccgccaaagaaacacacacacacccttatcatttttccacgttttccctcctgttgaaacacaaacaaaataacaatcgtccattaagacacccaactcaagcaccagtgtttcatttggtaagcctgtcctctgggtccactaggagccccttaacagtcctggtagaaaaaatcagacctcaatgtcttatttttacacaaggaattccttttacatcgatgtctttaaaattcacaggaaaaaaaaatctcaacaccagttgaaaattcaatgtccctatgttgaaggggaacaattttaaaagtgcatttgtattaatatcaccgaaagtacatagatatcttcctagggaggggactaaatcaaaggaaaaacacaaatatgtttttttcttttttttaattggtgatttgaaaagagcactttttttccccctgaaagctaggtttagactattccacgaggattttttctttgttacagtaaggggagaaggtggagaccccactaggctccaaaccggaaagggcactttccagttcctgcccagctatgccaccaaattcactgtgtcaccttggataagtcatttcccttctctgggtcatttccaagtctggaaaatgaatggacttatttctaagacgctgtaccctcctgcactttggctgtttctggagtaagtagctgagggagaggcgaaacttcaaaaacgacttcaatgatgttgcctccctgggggtccctcaggcctggcctaattatacggcctcgggcacaccagcagcccctctcgccggcccccagcagtgctgatcgctcggggagataaggcacgactccaaactgcgtccggatgcgggccgcgggccccggctgccgcgcgcattagcctctcaatggagcccttccggggccccggccccccgccgtctccagcagcatccggagcgggaaaggcgccgaactggaagggggtgggggtgctcttcggtcaacacgagagccctctccaagcgcagaagcgcgactccggaggctcgcccctcctcgcgccccgtcccaccccacgcgtttctggaatggggaccctggggtttcgttggacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggagtctcactctgtcgcccaggctggagtgcagtggcactatcttggctcactgcaagctctgccttccgggttcacaccattctcctgcctcagcctcctgaggagctgggactacaggcacccggctaattttttttttttttgtatttttagtaatgacagggtttcaccgtgttagccaggatggtctcaatctcctgacctcatgatccacccacattggcctcccaaagtgctgggattacaggcgtgagccaccgcgcccggcgacagacaagtattttcatctgcagttaaagatatggggactgagacctgaaggacaggcatcgtagttcaccagaaaatagcctacgtatcagtttcctggagagctgccatgttagtgagaatcatagctactgcaaagtacatcgaaggcagactgcatctgccaggatttgctcacatatgtgctaccaagaccttatcctttgctatgatatcgagcagcaagagttaaaaataccactttctctcttcatcctaaaaaaatttcccccaatccttttcacttgctcacttcttttctgaaaagagaatgtgatctgttggttctcgggactctctctatttaagaaatatacttccccaactgggccaggtgcagtggctcacacctgtaatcccagcactttcagaggcaaagacagaagattgcttgcaccaggggttcaagaccagtctgggcaacatagtgagaccgacatctctatgggggaaaaaataaagaaaaaaaatatatatatttccccaactagctagagtttttccactagtacatttactgaattaaataggctaactggactagtctggctaaagaagaatgtcaatctgaattagtggaaaatctgagttttaaatatctgttaggaaaagtagtaactttgcaaatacttgtagtgggtctgaattcatagctttcataaaactaatgcattaaagtcatttaaagaatgtgttctcttattaagcaggttaaatgtggctctggcaatattatttgtactataaatcttccttaaaataatcagaggggccagagtgcagcccaagtaaataattgcaatctaaattaataagaagcctttactgcagctattctttctatgttcagatatgttcccaatcctaatttgtctttagtcaagcagagatcaatacatttttttcttagaagtccaagtataacttaatgatagccatgttatttaaggaacactatttgtttcttattttgtttttcacaaatgtgatagttttcatgttcaactaactttatgagttttgtcatcaatgtgagacatgaaatgtataattagtttacaaaaaactccagcctaaagaaaaactattgcaattgacaaacactaccccatacttcatgttttctgcaccatcatcttttcctcctagctttatggttataaaatttgtctctggtcaggcgcagtggctcacacctggaatcccagggctttgggaagccgaggtgggcggatcactcgaggtcagcaggtggagatcagcttggccaatatggtgaaaccccgtctgtactaaaaatacaaaaaattagccgggcatggtggtgtgcacttgtaagcccagctctcgggaggcccgaggcagagaatcgcttgaacccgggaggcagaagttgcagtgagatcacgccactgcactccagcctgggcaacagcgagactccatctcaataaataaataaatgaaaataaaatttgtccctaaaacatcaaaatttaaaacaagaatatgattgcttaacaggaccaggagagagcaaatgcaatgtgtcaccaggtgaggtggcacacacttgtcccagccactgaagagaccgagggggagcatgacttgagcccaggagttctgggctatgagatgctatgcccaatacatgttcacactaagttcaacatcaatatagtgactttctgggagcacgggaccaccaagttgcctaaggaggggcaaactggcccagattggaagcagaacaggtcaaaactcctgtgctgattagtggtgggatggcacctgtgaacagccactgcactctagcctgggcaacatagcaagaccctttctcttaaaaaaaaaaaaactgcagtgtgtcaaatctgtttcagagcaactgccataagtgacatttaagatgcattaacagccaccagaattgtttcctgggataatacaaggaaacatctggtgtaagtttttcacttaattctttccccattctcacaggtaagtgtaaaagtgcactttttcattttagtgaatccccaatacacatctggggtggggatgggatagaaaacttgaatgaggcttctgacaccccagatttgtaaagaacaaacgctttcgaggcacaagttattctttcccatgttctgtttcataattaagaccgtttgattatattcatacaaatagaatcttgaaggatcagatagatatttatcctaagactctacattattattattattatcttgagatggagtttcgctcttgttacccaggctggcgtgcaatggcgcgatctcagctcactgtaacctccgcctcctgggttcaagcaattctcctgcctcagcctcctgagtagctgggattacaggcatgcgccaccctgcccggctaattttgtatttttagtagagatggagttctgccatgttggtcaggctggtcttgaactttcaacctcaggtgatctgcccgcctcagcctcccaaactgctgggattatagatgtgaggcaccgtgcccggccttacattattaataattatgattatgactttattaagtaactgtggaattggccattcataccgttcaggtgagaagaagccttcaaaaaaaatgatgaaaataaagacttttttgtgtgatttttggttttgtttccttgttttgcagccggggaggcccaggttgaaggcagagcacaatcacgtaattgtctcaagagctctggagttgcttgagtgtgtttcgtagtctctttcaggtttcattttgagtgcagaacaaggagattccatccaaagaagagacattttgggacagtttaaggccaggagcagttcaaaaaggataacgtcaaatgttgttcttgcctcaactattcgcacggttcctgtatcaaagaccgaagctgtcatcacatttacacatctgtactggtttagaagtgtaaactcctaaaattagaagtttgatttcaagcaatcaattgtcttaatatatagccatcagtttctagccagaagacgggctgaattcaacttaatttttataaagcccagtttccatgcttggcatacaacctctaggcagggtccaggtctcagctcagtacttgctctcctctgaggggagcccatcagcatgtccctgctctctctggatacttgttccattttaaataaacacccctctacatgcagcccctctgtgaacccctcatttcccggtttgcttttcttttgagcctggcgggtggatgatgacgctgagtgcgggtggccagggagcatgtgtaccatggggtagcgagtgtgcttctgctgggcattctctgcttccctatacccttgccaagccattgctcctgcttcctgagataaaatctgtccttggtgccatccagcactctcactctttcgattcctggtcctctcctgacttctccgcttaagcttgcctccccccggctccaacccttcctcctttctcagggtctgtgctccagatgctatcctcgttctcttcatcaaggatgtggcccacaaagcatgtgctatgcctaaatctccaacctcccttacttttttgacttttccccctcagcatatgagcacatttatttctttacaatccttaagaaccaccctgcggcctctctcttcccatctcacagagaatgcctggattttgctcatggcccacactgcctgacgaccctctcctccccacgcttgcagccagcctcgctcggggccctgcactctgccgacaggctctagcctggacgactcagggaacaaaccaaatggtcatttttctgtcctttcctctgtcagcattacaacatttgtaaagtgttgaccatgttcaaactccatccttgaaattccctccttcctaaccccctgaagcatctctttcttctgagttcttccaacctttctggtaatttctcagtacccctatgggattgtctccttttaccttctaccagtaactttgttctcttgtcactcggccacccatagtagtgatgagcatctacatgcccagaggagactacccaatctggcattttcaacccgtaattctttcctgagctctcaagccatggactcagctgcgcacaggacatctccacatacatggaagtcagcatgtctcaaactcgattccatgagcccggctgtcatccctacagaatgcccctacccttattttcctaggctcagtgcgtcttgttcacactcaccctgtatctcatccctgcatctgtcttatgaatctcaaccccatttcattgccttggtacagaaatttcaagctttttactttcatcttcccgagactgatctcctcaactctggtcctgcc

SEQ ID NO: 173 - DNA, 1463 bp, Homo sapiens
atcacacaggatccggagctggtgctgataacagcggaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactccaaaaataaaattctctagagataaaaaaaaaaaaaaaaaaaggaaaatgccagctgatataatggagaaaaattcctcgtccccggtggctgctaccccagccagtgtcaacacgacaccggataaaccaaagacagcatctgagcacagaaagtcatcaaagcctattatggagaaaagacgaagagcaagaataaatgaaagtctgagccagctgaaaacactgattttggatgctctgaagaaagatagctcgcggcattccaagctggagaaggcggacattctggaaatgacagtgaagcacctccggaacctgcagcgggcgcagatgacggctgcgctgagcacagacccaagtgtgctggggaagtaccgagccggcttcagcgagtgcatgaacgaggtgacccgcttcctgtccacgtgcgagggcgttaataccgaggtgcgcactcggctgctcggccacctggccaactgcatgacccagatcaatgccatgacctaccccgggcagccgcaccccgccttgcaggcgccgccaccgcccccaccgggacccggcggcccccagcacgcgccgttcgcgccgccgccgccactcgtgcccatccccgggggcgcggcgcccccctcccggcggcgccccctgcaagctgggcagccaggctggagaggcggctaaggtgtttggaggcttccaggtggtaccggctcccgatggccagtttgctttcctcattcccaacggggccttcgcgcacagcggccctgtcatccccgtctacaccagcaacagcggcacctccgtgggccccaacgcagtgtcaccttccagcggcccctcgcttacggcggactccatgtggaggccgtggcggaactgagggggctcaggccacccctcctcctaaactccccaacccacctctcttccctccggactctaaacaggaacttgaatactgggagagaagaggacttttttgattaagtggttactttgtgtttttttaatttctaagaagttactttttgtagagagagctgtattaagtgactgaccatgcactatatttgtatatattttatatgttcatattggattgcgcctttgtattataaaagctcagatgacatttcgttttttacacgagatttcttttttatgtgatgccaaagatgtttgaaaatgctcttaaaatatcttcctttggggaagtttatttgagaaaatataataaaagaaaaaagtaaaggcttttat

SEQ ID NO: 174 - protein, 231 aa, Homo sapiens
RTPKIKFSRDKKKKKKRKMPADIMEKNSSSPVAATPASVNTTPDKPKTASEHRKSSKPIMEKRRRARINESLSQLKTLILDALKKDSSRHSKLEKADILEMTVKHLRNLQRAQMTAALSTDPSVLGKYRAGFSECMNEVTRFLSTCEGVNTEVRTRLLGHLANCMTQINAMTYPGQPHPALQAPPPPPPGPGGPQHAPFAPPPPLVPIPGGAAPPSRRRPLQAGQPGWRGG

SEQ ID NO: 175 - DNA, 98474 bp, Mus musculus
  misc_feature (1)...(98474): n = A,T,C or G
tcaatggaccctttgtgcagaaggaagccagagagagttaggatccaaggagacagggaggggtggaggggctctgcacaaagatacttgtcactcggagaagccttcggaagatggtgttaaaaaggcgccaggtggaggccggcggcttgctgctgggatgcagatggacagtccttgcttctggtcccttcgggtttcccaggcgagagacggcagtggtctgcagagcatcagcctccatctgctctccggcccttgccgaggtgctgtgatatcagccctggctacttggagtcttaggacggtacagccagatgaagcaaagtggggatggtggggaagcctgaagcagggcgtggagatgctgagggcaggcatgcatggtgtcaactctggctaggtggcctgcctttctgctatttatcccatggcatggctatagagtgaggcaggcttggagggaggggagttggatcaggaccccagtgatggcaggatgctgggcattacaacgagctgccgtcctccccatctgccccgtgccagatacagaggtcacacacaggttcttatctgtctccagagaggacagaacaaagtgctgctttgagagctcagctcttcttagaacttgcctgccaacggcactgaagaggaggggtgaagggcaggtatggaaagggtcactaggaacgggctccacaaggactgagtgaggctccagtcgctgcagtggtgctgtgaggctagaagacaggaggaattgactagaggatgagcagcgactggcagccctaggctctatccctgactgtctctccgacagtctatctctgacttctctctgtccccactcactccttaggtatctctccaggcttgagtcttgctttatgacacctgccgacagcaggtaaggtggcttgcatctgaactctgtggttccaactgtctatctgcagatccctgcactcagatacctaccagtgctctcagaatagtttgctccaaacaaccctctcctcagtctgagacttccaccagccagccacactgtgtgtgtcccatcagcccctggcagttgctgtctccaacctctgaatcttacttcaggctttgccctctctttctctctctccaggtcctttatgtcagctaatcttgtgacctctaacttcccagaatttttagcatgtaacccctccgcctccactgctgtcactctagtctaagtgaccgccatcttggggctaacctcttattgtcacctcgcccccaatctagcccctctcaggtggctactgtcttgcttgagtgaagctaaagctttcactgtgacccataaaagacccatgctcatcccatgttatcttcagcttcatggtctcttctgcagagcctgtgccatcttgttatttccaagcatttatggtttgttgcggcctcaggccctttgcacgtgctgagctctgctttctcagtgtgttgtcctcctcttggacacgcactgaaaagaaacagagtgatatatctatagatatatagagcttagcttaagccaggagatgctgaggggggagagagtggtatttcccttgagcattttgaagttttaaaactttattaatttattattactacgagatcatcaggcttgcgtgactggtgttttgctcactgagtcatcttgctggcccaagcttttgaatttttttcgcccactttgtcccgtctgtggtgtgtcctgttgtaccttcctcccgctccttacttgatgttatttttaaccgtctaaattcaccgacttacctgatcccgatgccgtcctcatcagccagtgagcttcacgatgggagacatttttacctatgttgtgcacatggaagtctggtgtaagcgaggtatctagtcatcttcattgcacaacggaattaagggaaaagaagcgcatgtgtctctaggtccctttccaccttcagtcgcagccctggctgcctgccctgttgccactcactgagagcgactgaccgttcatggcccccatagatggttcaccactctaaagcctcacactcatctgggacctgtcagaaaggcaatcttcaggccacactggcattgtatcttaacaaggccttggggactggtataaatgttctatacatgaggcttcagtggttgacatcagcccaacaaggaagcctggcttttagggttctaagatccaaacacaggcaagatcagggaccatgacagtcacctgtctatatgcctgtgtctatatgtctccacttaacgttagctggccttttgtcactgtgacaaaatattgaacataagcaatttaaaatgagaaaagatgactgggaggtggtggcacacacctttaatcccagcactcaggaggcagaggcaggtagatctctgactttgaggtcagcttagtctatagagagagttccagggctatacagagaagccctgtctggataaaccaaccaaccaaccaaccaaaaaaaaaaaaaaaaaaaaaggaaagatttactttagctcattgtttctgagaatttatttcacggttacatggctctaggtttctgggcctatggtaagtaggcagaaggcatgataggagaagctgcttactgtgtgcatccaggaagcagaaagaactgattccttcagaggcacaccagcagtgaacccccgccaccttcccaggggctttcaacagcctgtctagctaagatgcatctatgcaactaatcacccctcacagaagcaccagccaagagatccattcatatccaaaccccaatatcacctctgtccccatctctgcttcctctccatactttttttttccccatcagcctacatggtacccagacagctgccactgccccttcaaatgctgactcattggtcagattcatgggtgaggcatccaatcagctgtgttcaaggaatgaagtgttcgatgctgccaacatgggggtggggccatccaatcccctgtttgtgggatggaaggaggaagaaactgagccaggagggagggctggtggcgcagggcattgctggtgatctttgcagtgagaactttctcttcaccccctttgatatttggatgagaatattctcttccctaatgggctcatacgtttaaatacttggtcccaagttggtggcactgtttgagaagaattaggaggtgtggttttgttggaggaggtgtgtcactgggagtgagcttctggcttcaaaggcttcccaccatttacagtatgctttctctgcctcctgcttgggagtcaagatgtgaactttcagctgctattccaggaccaagcctgcctggtgtcatgctccccaccatgacagaagttatgaacttctgtccctctgaaactgtaagctccaaacttccttttgtggtaatggtattttatcacaccggatgaaaatttaaaaaccaatacacgccccaagctgagcccttaaaatgcctgtgtgccaacacagagtttcagacagagggtttccgaggctgtaagggatcaaggatgtcccaaggatatggtgacatgaatggattctcgaccctaggagccctctctatgccagctctgtccccagtaaccctctgctgcactcccctctcagtttagcctcgaatgtggaacctggaaggagatctagaactaacttcatccagcatgattcagaaatgctcgcttacactgatatttctcaaaagtttccttggtcagcaagttcaagaaactctgtttctttccctttctcttaggcaattgggaaacttggcggtttgttgagggacctgacaaatcctgaagataaagaactggagagagctggggagatagctcaactggtaatctaatttctcatttctcaaaaagggcttcctgtggaagtatgaggactcactttgtccacagcaactgttgtttgttcgtttgtttttaaggtgcaaaggtatgcactcctgcaatcccaactctgaagggagacaggcagatgcctggagcttgctgatcacagggtactctctcagcatcagcaagctccaggttccctagggatcctgtctcaaattggagagtgattgggaaaagacacctacattgatcaccgccccctcccacctcttttctgtgtacacatacacacgtacatcccttgccatacacatgcaccacgtttacataaatacacaaaataagaactgtgcatctttcctgtccttcaggggtactgggtatggggtcaagcctgtgtttgcatttaatagaaacgaagaaaccccaaaggctctctctctctctctctctctctctctctctctctctctctctctctctctctctctctctctctctctccctccctccctccctccctccctctttctctcatgaaagaatgcctagagagctagtttctcagatgggcaggggatgcctgtgctctgagtgtgagacaacattccaggccagggagagttcctgccacaaatgtctaactcagccagcatttggaggagatgggtctctgtcttctggcctctttaaggtccaattacagagggaacccccgtgcctgttctgggcaccccattttctcccattgcatttccaggagccaatgctggggccatgtagctcctggcaacctctctcaagcttttcttcagccaactgcctccctggatgatagctgtggttagtgccctatgggtgagccctgtcactgactcagggatgtagtgaggattcacccagggtatagagcagtggagagaggctatagcccaggtccaagcaagcagcagctgccccctgttttcctttgatcccccccaccccccactttccaccttcaaggagcactcttgtttcatgctctgctgatcttgagacctccattcttcctcctgggttacccacctcatccatctgccccacccccacccacaagaggtctccaggccccagcagtcatagcttcccagggacatgaagatgcggcaaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctcaaggagactcagaagggaaggcagctctgtattaaaaatgaaggagtaccaactggatgcagaggggtaggctccttgatgtttagagagcgtgtcttgtgtgcggaaggccaaagagggtttctaacctaggaagtggtgtttgacgggagccagatcagatagcttaacctgggatatgggcagccaaccaggatgatggggcttttgaaaaaaaaaaaaaaaaaacctcctagcctttcatctgacagatttccccaaatcagtcttgggaaatctgcagcccatgcaggcggtgggtctaacctctctgtcttatctcttcatggccttcctctcctgctctcctcccccaaaggatgggaaagcttcaaagaaagcgatgtgtcactgtaagtatacagcccaagaaaatgggccagataaattattaaaacagaaaaagacagcaagcgatggggtggggagcccgcagagggcaaagagccactctagctggatggtgccctggtggctgctagggagttcgtcctctgaatcctggacaggtgatccagtccccacccggcccactctctggcttctcatgccagggtcagaggtgtgtgtttgtagaagccgtgagggtccgacagtggcaaagtcccaggcgcctggtggggcctctgtgtctggccagccgtttgggatttacttcccctaagactcaagctggtaactacagagttttagtctttgcttttatctctttttgaactgcaaagagacattcccaaggggcagaggggatactgttttctcatgaaagaagaaagccatgacaggtttaaggaagtaaccaacgttctaagctctgtgagaaagggttttgctttgatttcgaagcccctggcactggtgtgggtgtgggtgagaaagacaagcagggaccccacaggaactccacttctatagcagacactctgcgggatgttccctgtcagctcgggacctgtgacctcggccactctcgtctagtctcagggtcttctcttccattcccacacagttcgcatgctttaccactacaccctagacatctgggccatgtgattctgggggtgtcctgggtacagtcggtgtttagcagcttgcctggtgtcttggacaatactaaccctttcctggatgtaagctgccttctgtcctcttgggtttcatcatgggcactgtttttcgtctctcttccacccaggtcatggcgggggtggggggtgggggagtggggggtggggggagcaggtttgtgcatgtggtactgttccacttgttcactgaagtgctagaacaatgcctaccacacagctggcacttattctttctttccagatgttatgcttggaatgtgctggaaacctggggtagtgaaatgcacgtcagcaaagcaacttggttctcaactagatcatgaatcagctgcatgatgggtaactccttgggcaggtaaccctacttctctgaggctacctagcaggatctgtcctttctacaagtacaaaagtcttcattgagggcacagaaatccaacaggcactaaagatgtggcatacacagctgacaacagtccaagtgtggtggctcacacctacaatcccagtctgcagggaggctaaagcactaacatcgcttcgattccaagatcagcctggcctacgtggtgagttccaggctaacctggtagaaggtccttgactcaaaacaaacaaagaaaccaaagcctcaacagtattattttgctgttttgtgaggtcccagccatacttggataaaggcatgccacatgagatttaggggtgtgcttagattagcttttatttcctccagacagggtatataagcaagaagagggatgaagaatttcagagggtcacacagctccgggttcccttgtcctctgagacaaggaggtgctcagagtcgtacttcacagcacaccagccaccagccacatgccaaggtctcttgcagtgtggctcttctgtttgagatgtgtttcaagtgtaatatgcacaccagaccttaaagacagtggaaaacaaagaacgtgacatcttactaagtattgatgtgattttggctatcttgagtcaaaccaactttgtcctttacttttaatgtgaaacttactttttttttttttttttttttggtggaggtgtgtgtgtaggggataattttgtagcaggttggccattcctttcaccatgtggtctctggggatggaactcagatcctcaggcttggtggcaagcaactttagcagctgagccatctggatgacacacctgtttaactttttaaaaattgtagcgcctagggctcaggacatagctcaatcacagtgtttgcttgcctagcaccggcttgtcaaagcagtgctctgggattgactcccagatcccttcccacaaagtgcttacttgtaagtctaaaaacgaccaaccactgtaggtcacctgtttatattgagtatcgcagcacaggggagcaggttttaaaaaaatgaggagaactaagtctccattgtacagatcataaaactgaggctgaagcagtgagtctagctctaagagcagaactggttctttcccatgcccaggctcagataccaggataagcttagcgcggggacagcagagaacgtccttctaaggaccacaaaggtatatagtggaagcctttaagtcgccttcccctttgcagagacctccccagacaaaacaaacaggcccttggggtctgcagaactgcaggggggaagggggaaacggaaactaagaaagatcaaagatccggcggttcaccgctcctggcctcatagcttggcagctcgccccgatctcagttgggcactcaggagcccatgggcgaagaagagttgcgagtgacaaggggacagctcggggttcctgtacacttgttgttaacaggagtgggcctgaactccctctagccagcaaggtgtccagttgatttctactggactcccaaatgggaaaaaaaaaaaaaaaagaaaaacccaaaaaacaaaatcaaacaaacccaaaacccagagtagtcaaagaaaagggcaggcagctgaaaacagggattgagcactgtaagtctgggaagggacagcaccatgggagagcagtagacacgtatgctagggcatctgaggtcgccagttataacctcagtttccccacctgtgaactcgagccatccagtcccactctggcagcttcgaggaaatgcagagaagagggaagtctcagtgtcaccagcgagggcagcgctgttccaccacccagcggccaaagcctccgcccggtcccgactcaggccccgaggttcgcacggggggcttggggcccagcacacccaaagcccctccccatcgaggctccacccctccccgcccacaggccacgccctctgtggtcccgcccatcggccagcccctacccgcaggccccgcctctacccgccccgccgcgtccgcctcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccagggttgcctcggcccccagccccgccccgggagcgctctttggggcccctctgtccctcctacccgttccccacagcccggtgctcccactgctgaccctaaccccctccactttggcggcggcgtcttcccttcagctccccaagatcttgcgccttcctctagtcgccagcccctactccggagaacttggtctctggtctcactgcaccctctctgctgaccctcatctctctccttcgcaatccctgcctcccgcgctccttcctctctgatccccgaactccttcagtcagggtattgcctcctccctttcaccctctgaatcctcctagcacttaggatctcgccgagccccctttcttggctatttcgctcttttggattctgctccgtctggtgcttgaccctcttgccaagtctttactctccgggctgtgccgccttgtctccttcccttcactctctggtaactttttgccagccgggggggcccagactcaatgtcttcgtgttcttcccgcctcaggtgacagctttgctgtaagcgctgcttgggcaaggaaaggcatcgaggagtggatcgggaggcagcgctgtccaggcagcgtctcaggaccccgtcagctgagattggcaggcactgttggtcgaggcactcgggtatggccccccactccgttccatcctttcaccccttttagccttggggagagtctgaggatctccccctactccaacttttagcatcccgcttgcacattgttctaagtccaaaaatcccttctcagccactgtgtgccccactagccctacttgtgccctatgctttggaggacccttgtcgatcaagtgggcaccagtctcctgcccagctgggcacagagggttgcttggggaggaagtgccagggaggcgatgatacaggtccagtggggtggggaaactatgctgtgtttctgtgtgtgtgtcgggggctgggggggctcctctactttgcttttgtggccagcttttccacagggaggggttaagactaaaggcagacaggagtgtctgggtagagggcagggctctgctggcccaggatctgtggctacctccaactgtgtctgtggcattcatcagtgccatctgccatctgagtgtagagtttggaggcactgagacctggctgcccccttagtgtggccctgagagggagggggcttctctgtagtgtggtctgggtgcaccctctttcttcacccagggggggttcttgaggctagaggtgttctgtgggagcaagtgggttgggggagtgagtgactccagcccctgcgcctggcctgggactggtgttcacagatgtcctgtgagctccagaactccgcacgaggctttcagatggtctgcgtggaactcttgcaagctgaggatcaaaggatgaatcaactttttgatgtgacatttaatttttttttttttttaacttagagggggaaaagactgagcctcaggtctggctagttctttggtcttgttctttgggtgagggtggtagagtcttcagatgtgtgtgtgtatgtgtgtgtgtgtgtacaggggtgtatgtgtgtatgcatgtgtgttagtatgtgtgtattgcacctggcagcactattgtagacaggtggcgtgtgtatgcatgtgtgagtgtgtgtgtgtgagtatgtatgtgtgtgtgaatgtgtgtgagagtctgtgtgagtgtgtgtgtgagtgtgtgtgagagtctgtgtgtgtgtgttggcacctggcagcatgattgcagggagggggcatgtgtgtttgtctgtgcatgtgtgttaaatgtcttctctctctggatacttctctccttccactccatggctcaggcttcctcttcctggccttccagtttgctgctgactgggactggagctgctatcctagtagaaaggtcaaaactggtctgaggtgggggtggggggactgcattggagcctttcagcaggaccgcaaacttttcctcccccaccgttctcagtttgtgatgtacttatttatttaaggaccaatgaaaacaatccaatttagacacgtgaacaaatgcatttgcagctcaacacaggccgaccgaggatttccattaatcaagttttgttttgtttttttttcagcctgtttatttccataaagtattcctgcagaatgacatttatttaggctctgtctctctctctctcctctctctcccccttctctctcacttctctccccccacctcttccccctaaagtgccaggcagcttttgcttcatgctagaggggaaacttgaaatacagcaagggcttgcttccattgacttttatcttcaaagccataacaaatgttacccgcatgtttttggtgggtctccttggcatccaggctgggaggatgggagggagggagggtggaagaaggagaggaaaacaaaagtctgtcgtttttaattaaatagtagtgttcccagcaagaggaatgcaagccagtaaaagttgccattgggggaaatgaagcagggggagggggcccctgcttaagcctgtggctttgctgaagtcacggaattctgttgcctggtttcttcccccagctgaggacagcatgggatggatgtgcttgcttgcctgccttcctgcctcacccccctctcagaaaaggaggggtcattaatatttgttcaaagtccttttgaagatgtgaggcatagagccatcagtgtgacatgtgtcggatagttagagggtgggcccagccatcaaagatgttgagtggggggagggaggtctctgtttccttgagagtcgatcttaatagcagaccgggatgcctgggtccctgcctgcctgtggtggccacagtagtggggtcgtgcatccaccctagagaatgaccaggctgagcctaagtgtgggtctgcgtggtagcagcccgtgaagccattcaggtggtctttagaggggctatctttaatctttatagatacttatcttttttaatcagtgaaaaataactaggacatcaaacgcatgatttcctggatgttctatcacttaggatgaatcaaagttgaaagaggtaggtgagttcaaagtcaatacaggggaaaatactgagttcaagcggtcagagttgggaacgtcaggagcactgctcacacggcaggggcactgagagtggcgacaggccagtgaggagcgcgttgaagtcctgccatttccatggatcccactggcatgggaggggtggctggcagggtccttctatgatatcatcaggatgtagatgggtgtgggctctcgcagtctgctggcttccagggctgacagtttcctgtaggcctgttccaggcctatcttagggaaggactttgtgtctatttctctacctgtcctgtcaccgaagaggctgagggacacattactggcttatcaaactgacaacattattgttgccatgagaactgctgttgcctgagagcctggatgtgcccagcacattgcttctctgaccttaatctccccatagccctctggagttgcactcagctggtgtaaacttgagtcgtgtgaagccaagccttgccttgtttccagtcaggggctcacggacagttgctaccatgtccacatgagctggttgcagggtaggaaaaagcaagagggactctgcctttcctgtgtctgtgacaggagccgagttgcagacatagccataaagtgtgagggcagccacacagacatgaaactcagcctatccccccacccccatacagaagtgaatgaggtcaggctctgcacaggacattgtcacctgtgcaagtcacattaacgttccgtgtctttgttagcacatctgtaagacgggcacagtaatatcatccatagcagagctgctgaagataaatcttgataagaatagggcctgggttgagagttgatctttacctagggatcctgatgtgtgtgctcatgctctctgcacccttctactgcaggcgcctctggcgggggggtgggggggaccaggctaaggtctgggcttctgcttttccagggatacttgatgaggtacaagggagtataagctcaaaggagaagaggcatgaatgactggggacaggaaaacacgtgaaggaaggacagtcgactgaaccaaggccatggttgagacgaatgtactgagcggtagtagaggctagccagtggtctccgagggccggcagaaacaaagcatcaggcagcaagagaaggcccagggccaatgctaggtgagcagaggcatcatagtgaagctctctaggtcagtggagcagtgggctcaggcatgagggaggacaccttgcctaatgtccatgctgtgagcatgggcacgcatgtacacagggatgcgtgtaaccaggctccaaacaaccttgactccttgaaccatgatccttttgttcttttatagcaagactgcttgcagaaataggctggggcttggggcaggcaagccccctgtagatcaaaggcggctgccaggcacttgggtaatttgattagggggcacctagcacattttgatatttggaggagattaggagggtgcaggcatgccacatggggccaggtggggctgtgtgatgagattgggagctggcccagctgctgctgggatcctggattccaggggaattacccttgaatgataccagttggcacaattaaaaggccccatgtcttcaccatatggaaagtgttaggcctccttacgtggtttcaaagctatgtgttgggaggtggacttgacatttgaggtagagcataaattaaatactcggtgtttaagactcgaaagacgatttgctctgaggatgcctgggtttcagggcagaggcattgtgccttcactcacaggcatctttgagtggtctaggaagggtctccttgggaacagtctcacaggcctgagagctacctctacgtgggagccagcaaggaagggagcctgggaagtctgggctgtgccaggtgccagacatcactgcaggctgctcctgctctgtatctttccaagtgggtaccatcacctgctgcggtggtacatctgtgtgatgggactgcttagaagagccactttaactagtaccttctctccctctgaaacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccacctgtctccttggacaaagtggtcagagttgaactgtcattgacaaaagagtcagccaccaaatgcaatttcttttctgaagtgcataacaggcactcgccgtgtatgagtggagaaagaaaatttgatcatcatccttgctgcctccttccttctagccaactttttaaacctgtattcctgatgctaggtttatctttcccgagtccatcatccttagtggaatcgtagaaccaagccttacacggagactgtggcttggtagctcacggggagtggaagtgtccctgggactccgtcttggaagccctgtgggtgagcagctcttggcgtgcttgggctccctgtccagggacaggtgtgtgaggccgcctgcttatgccttggaattaacttaacctgctgttcgaggatgggctgttacccagctgtcagttgggttggtggcttctggagccaggttgtaggtggaaatcagcttgagggtcggaagctcagctgtgcctgtagagaactgagggatgacattggctgctgaagggcagggaagagcccctcagggcttggggaaaagaggctgctgacaggcaaccccagagagctcactgtgtggtggaactgagagaagagcatccctgctcaggcttctcagagtaagggatggagcccgcggcagggggatgggggtggggaggggggaagggcggccatcatgttgatgagttgggtgccagagctgtgaatttactctgcttagctatacaaactttgaaatctttttggctgcttgttggatccaggtacttcctgcggcagcctctgggcttccttctcttgctggctcccatgtttcctcttgcagctcgttgctcacagtcagggtctcccccccccccccttgctttcttcccctggcttcttccctagccctctctcctgagaaaggaaagaacatagtccctcacaacccaaatatctgccctcctgatggagagaagcaaggaaggagctgagaacaccctggacgaaaggccagagagaactgaaggcctcacttgttggatctggaagctgggctttgatgtcaccctgctccgtttatcctgggaagctgcctcggcctctctgcatggacaggggcaagctctcaggctggatcagaggagaggcatgcccactccatgaagggtagtcctctatgaagggtagcccgagagtccggccaggccgcaccctgccaagcccaggtgggtggggagccttttctaaacacgcacttccagaggcataagtaattctttgatagatgcctgggcaagctgagagggatgtttatccatgtgggcaccagccacaaggctcaggaggaaagccgtaggtccttcagctgaagtcaccctcagcttcagcagggcatgcaggaaccccggccagccagtgtggctctgtccgaggggcctgtccagggccatgtttgcttagcagccctgaggaattagtttgggcatcactgttcaggcttgctgagccacattggctgtggcatgtgtccctgtgtgtggctgatggttattagagggccctagggtaaggtgggctttgctgcatcccgtgacatcagctaaagggcctttccctcccctgaactttggcctctccatctgagaagtgggatgatgtcactctaatttagtatgtgtaggacgtcgtctgtttcgctcttcgtgtgtctgcagaagatgtggggtatacacctctacatgttcactgaccacaagccatttttgtgaggcttagagcctggtagaaaagaaaagttttaaaatgcaaataataaaatacaagttggcccgatgcttcagtaaggtccagggtgccttgaggctcagagctggtctgggtggttgttcaccttacgtgttggcagttccctctcctcacgcctctgtccttgccttggaacttaacgagagggtttcctaattaacagtgagatgttgtgcgtgctgtttctttagctaaaataacttgctcccagctctccaagataatcgttcaggaattaggaataatcgttcagttttatcaaatgttgtgggcatattgatgggctgggtcactctactctgtgacaggatcttgctgtgtaggccagactggtctggaaatcactagcctcctgtctcaacttcttggttgctgcaattacagggagtgccaccatacctattgtaatccatatcactaagttccctggtgttcaacttctttatgctccagaagtaagtccattcattgcgatgcattatggtatcagttgtccatactgggccctgcatcaactgaaaactgaaaatatttgaagaaatgcatctaagttgatcaggagggctttctgccctcctttgtcattgttttctaaacaagataccctgacgactagatagcagtttattatgatgtgataagatgccgtgaccaaggcaacggtaataatttgggcttatggtttcggaggattggagcccatgatggaggagcaagggtgtggcatcaggaacagctgagggctcacaccttgctccataagtaggaggtagaaagtgctaacttaaaaatggcacgagtctcttgaaatctcagagcccacccccagtgacacacctccttcaacaaggccacacctcctagtcctttccaaacagctccaccaactggggacctgtatgagcctatgagggccattcttgctcaaaccgccacattaggtattataagcaatgtggattttgatataggagagtgtgcacgggttatatacatgcatggtccctagttatataagggatttgagcagtgcatttcagtcttcaggagtgaagatgagggagtgctctacattggtgccctatagctaccaaagcatacaactgcattttcttttttaatatgcagctgtatattgctacacagatgctgtgcttgctacgcagttgctgcgctgtggacttttaagaatgcagctgtgttttcaatgcaactgccgtacctgggtctttgcaggtgtttctaagttagattggcccacacttggaaggaacgtgttgaacagtaaagacattaaagggaggttaggggacatgctttggggctttggggctggaacaggaactactggggtcagggctatctgtcctcagaggaatcctgaggcaaacaccagaggcaagtcagggataacggcagagggggaatgtcagagtggttgcaggtttgataagtgtcagggagaaagccacagagcatggtttgttggagatattggtggacgtcgtggctgacctggtcatcttccatgtttacaagattggccttagactcagagagatctttccgctgagtgctgggatttaaagcacaaggcaccatacccagctcctggccaccttcccactgtgttatggactcagtcaggtctttgtctagagagaaaagttgatgtagccttgtgtgaggtcggtgtgatgaaagaagcctatgatcggttctgtggaggaggaagagtgtgaggaagggctctctgtaaaaatactttggatgatgaagatgggatagaaaggtttcacgggctctgtgaggatcgcaggtctgcactgggataagcacagctcttggctctctgggggaacacccaggggcccttgggggaggctgcaggcaggcaaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggagctcctaggggttgggagggtgctttcacacagagcctgccgcctcctcactggggaggaagaggaagaggaagccagtggccttggactgaggtcaccatctgaacctgaagggcaggagccacatctcagaggggatgtggctgagcagccgtgatgatggcttgaggagcttcgggtacccatggactattacttgacttctccaagtgcccaggcagtagctcagggttagtggtcccatattcttttcggtacaacaggccacagctttagcccagactcaagggaagggaccacaggtatctaaatactggacatgagatctctatcagggattgtagcttaccatagagtgtgtgtagagagaaagccactgataggcagccttttttttttaagaggggaggggccagtatccatgagatgcaggtaggataggattgttgggattgtcacagttgggttttacaggtgctgacttggtgccgagaggtcagagagtcccaacagaactgaggtgtgcctcatgcatgttcagctatgtgcatagagtaagaaaatctggttacaaggcacccgtccctcaccaggtcagtccctggccatgtggccatttcactgactgccccaggtaacagcaggatgagtgggcccttgtgaagaagggcctgagtgttgacaggttttggtgtccacagcaggggagtcctaaagccagtctccggggatattgggggacagctgtgcacacgtctgcccaggcctgtttctgagtgttgttagatatataaagatctggaaggagcagagacttttcacactgcacactcccttctttggctttttttaggtgaatgagtgtgtaacgctcatacttttcaggaaaaaactatacatttactaaggaaagcgaggggaggggaggtgccagaaggggcggggggttggggtgactcgctgcttctgagcctcctgggtgctcattcaagcgcagagtccagcaggtgtggtacacatttgtgtacttggtaagctgaggcaggaggatcgtgtgaattcagagctggcctgcgaaagaccaaatgagagcggcagatgctgggtgtaggggacccaataggtggccctgtgtgactctgactggtgtcaggctccctcttcccactcctgtggctgtagctaagcttccacgagggcttagacttccacggacagttttgatacgggggtactctgaactgttaaaaggagaagtgggcagtgtagctcagtctgatgggttttcttgtgattagagtgtcctgggctactgtatgtgtgtgctgtgtgggagcatggtccagcaactgagctctaataagataagcttggtttgagaggattgacatgtgaatttaaagatcctccagaaaactggctgcttcctacatcccccaactctggtctgaggaggaagactggggccgtgcacatggctaaacatcaccttgtacctgactcatccctatcccctgcccctgtgtgtgtgtgtgtgtgtgtgtgtgtgtgtgtgtgtgtgtaaggcagatttgtagtgggaatgagaatgctctctacacctttgaaaggaagcccaggtccaccctcccctgaggaccataagaggcgtaagaggcatggctgtgtcccccactggccactgacagccacagtcatggtttccagtgttcttccttctggaagagtgggagggagaacttgagccctacattacaaatacttaagtctggatctcctacaggctactccttgtgcagctgtggggtgagactttttctaagtatggactggagtgggtacctaccacagagtttgctgtagggtactggaaggcaaacccctggactggagcagcagcccccccccacccccactggtattaaccagaggttttctggctcccaaagccttgttcaagtaatacattaatgggccaggattatttgcatggggaaactgaactcacactcagattccatggaataatctcttgtaggctgggcactgcttggcaggctgtcgatactcagatatactcaaagaatatctgaggtttggaggatcccggtggcgtggagagatggtcacaggtgtgcagggggctggggttcaggctctgtgcctttcagccccagtttctgttctgggtctttgcatagggctttgggttgcttctcccttgctctgtgagcagtgcctcacctttctcctaaatcatgtctgtggcaatccacctagcttggcctcccgaatgccgagactaaaggcatgtgctcccatgcctggctcaaactttttaaatgcatgtatgaaaatgtcacaattaaaatcctctgttgctcgggtatgtcgttgggtgaacgtggctggtcaggagctcagagtgcctgtccccagagcaggatggcagtgtttgtctctgcccacttcacgttgcttcattcataggccagtgtgagcaggtcttagcagttcaagcttctgcctccatctgaaagctccagaaaattccaggatacactcccatcattttgacccgggccatatactttcctgcagagttgagtcaccctggctctctgtctcatgctatgtcccttgggtgtgtcaataagagaagtccatagggattgatgggaaggctgcacgtgctgatgagtgggtagagcctagagtgtgcgtgggcccaagactctccaaacaaaggatggctagcagttggggacagggctaccaggtaaagtagctaagctttggggagaaatatggctgaccattgggtttcagagagcctgggtggtttgccatttcccccatgtggtccacaggagcctccttccttcccagctcccaacctctgcatggggctaccaggaaatccctcccactcagagtgctgatggcagccctctgaagcccatgtaatctccaccttggatgtgtgcccttcgtccttactgttgggctagtgtagccaaagttcccaggtcagaaactctcccttgatttgcatggaatatagaaggctagtcctggatttgattcccagcactgcaaataacacacccaaacgacagatgattttaattgtgacattttcatatatacatttgaaatgtttgagccaggcatggtagcacatgcctttaatcccagcacttgggaggccgagctagtggaggccagtctgatatacatagcaagttcaggccagctaaaattacagtaaaaatactttaaacaaatgaacaaacaaataaaaataatacaatagtaataataataataatagtaatataatattttgatccttctatttatcctctcttcacatgcacgcatgcctcatttaatcttgccttcctatgtgtggatctgccaattctaggggacacagagcttggggtgcagctttgaactggggttttcattgtttttcctgtgtagtggggagggggagtctccaccttgttttaggattctatgaggtaatgcctatgctggtagccgaatatgtatgcctatctctatctctttggacctaaaacagcatttccaagtctcacctgctgtggggtgggtacagaggctcagagggacctgtcaactgggatcctgtttctccagagtgagccttccacgttgacaagttggaagattgaggtctgtgcaagccctgtaccttccctagtgtcctggagtgagttaggtttaagtgtttatacactcacctaagcacccctaacttaaaaaaaaattattaattatttttttatttacattccaagtgttgctctacctcctagtccctcctcccagagttcttctcccccattctcctctcccctttgcctctgagagggtgcccctcccctagcatctcccttccctgggcatcaagtctctacaggattaggcacatcctctcccattgaggctagataaggcagtcctctggtatatgtacaggggttctggggcctccaaccagcctatgtatgctctttggttggtggctgagtgtctgggagttcttaggggttcaggttagttgacactgttagtcttcctatggggttgtcatctccttccattcctttaatcctccctctaactcttctgtagggatccccaatctcagcccaataaccctaacttatttgataatgctcactgcctctgtgagcaaggccaagccacagagggtgactcacctgtgtagtgtggctatcttaggggttctctgctctccagaatcctcccaggcccctgagtccagccatggtgctgctgcccacttggctgccccctgagctggggtggtgggtattgtttcagcagaaatgtgaactggtgttttgctttgagtgtattaagacacaaagtccctgtggttaacagcaaattaatcactgtgcccgggaggactgcctggggtagacatgacttcatgagcttgtcagaacgtctgccttggctgtatttcattctccaagggttttgactttcagaaaaggagctgcagatagagttaccaagttttacagaaatatttttactgggcagaggttgctttatggcgagagccagttatttcaggagacaagcaaagagccctttattctcacgttctgtgggaggaaaatgttatgttggaaagcttgcttcttggatgggccactggggagaccagactgcatttctagagtgggagtgggtgccaggagatggcatggggtggggagggtgagggtgaacatgcaaccatgttctcttctcctttggagggggggatttagggctatgcaacttaagggtgtcaggcagggatggagacaggccgagctggaagatggagccagaaactggaggagggtacaccagcaaggagggaccagatgagatctggaggtctggtccgatctggtgctgtctttactgtcatgcgactcgggcttatctgtcatctggagacagcagcagtacctgcctcacggtacgtcctcaggagggagggttattatcctatggttgctatctcttttatcccacccttgatgctgagggtaatggttcagaggcaaggaacacgacttcctctccccacactactgagtcagctcaccccgcctcttcccattatcagggcctatgtagtgagagatttgacctctgggttagctacccttgggacttggaggttcacgggcctcattctgctgctccggctccagctggtgtcctggttcccagaagggacccttcttttttcagaaatgtaggggaagctgagcctgcatgtgctcagagtggctttgagcctgcgtataaggactgcttgctccccttccgacgaggaagaaggatgcctgccaaaagttttgtttgtgtctggagcggccttgtgcccgataagaacacggcatctttgctccctccttgctccggaccataatcccttttaagttgggcagtgggaagggttgatttatttccttgtcctccccacctccctctcgttatttagaatgtgagggaacgtttatctggttttccgggagatctgtctcttcagctctggaattgcatccaagtttacagaacggagtctgtgcccagagccttctggtaaatattttgggaagttgaattcagctggcatcgtggctcaggagtgggtagtgggtgctgttcaggactagatggttgaatctggacccttctcacacagtgcctgtgagcagactagtggtaagacatccgtgtcagcaccagaattcccatttctccctggctccatttgtaccaggcaggcctggtcccatgtgtgccctgccttatcctgggggacctgcttccttcttccggatcaggacactgagataccatgtccctccctcttctggaagctctctctcagctgaccctcctccctcagggaagctttcacactgctttgctgatgttttctgggttgtgcgagtcagaggggtgtggatgatatgcaggtcctcggttccccagcagtaaaatgaaatagtcaataagaactctcctggtaatgagaattaaaagaggcgagcagggaacctcagggcctggtggctagtagcttttagtaaatatagccttcctatgacattggtccctggggcgtctcctcaagtcccttatacaaaatgacaagatgagcatgtaacttaggcacaccacaccctcctattcttttaaccaacactgaagatttgtaatgccggagacaaggaaatgcctgaagcgattgtctccctgtgtctagggctagcgataaagacagtgtaagcatgctctcagagaagccacttccccagggtcttccctggttggcctcaggctgcactgcagttccgctcttccctgcagagatgtcctgcattccttgtatcgtacccaagagctggtcctcatgttgtcttgcacacagcgggtgctaaggaccagagtggaacctgccagttgggacttgatattctctatccagggttcttaggtgtcaaatgtcccttagagcttgactatagagagagttttagggaagatacacacacagccttgcttcagcagagtggctggagtctatgggccctgccaactatgaaggcctcctctgtcttttgcagggttgatgggcaaagaaatatggctgacacagggtatcccaaaggttttgtgtgggaaggaaacatgagagttcctagttaacaatttaaaaaagatttatgtttactattttttgcaaactttcattgattctttgtgagtttcatatcatgtgcccccaatcctgctcatctccccatccttccatatatgcccttgtaaccccccaaattaaacccacccacaaccaaccaacaacatcaaagcatagaaaacatgtcatcctggaagctgtggtgtgtcacagagtatccctctgtccatgcgtcttcacttgccaatattcatggcaatgagtcgttggtctggctcgagatctctggcttctgtgaccccatcaatattggatcgtcactgggactcctcctggatatcctgtcgcactgtgtcatgaagatcctgtaggttttgatccgtagaactgatccctttcacacatcccagcgtcaactcagagcccttggtctgggcctggatggtagctgagctggtcagcctgctggctgtctcttatctgtaccaccagggtgagctctccagcactgctctgagtaggccacccagtgctgccatcatctgacttcctgtcagaagtcaggctcagccctcctgctctcatgtccttggtctggctcacctgcaccccctcctccagagcaagctccattgtggtgcccagtcaagatgctggccccactctccaagtgctgcagcctatgaggggctgggccaactctcccgctctcacaccctcggggctggcttacccatgcctttgccatcagggccagctccactgtgtggcccaggcatggttcagggcctgctcttctggtactacagctggtgaggtgcaaagtcagctctcccagctaccgcaggtgtcgaggcaggttgaggtggaaggcatcacccacacatccatggcacctcgtgccagggttagtcctcccgtgctctcagcctcagctcacctgtgcccactccatcagggccagctcttctgtgctacccagacaaggtacaggacccaggagtgctgcagttggtgaggggcagggctagctctaaccctctagctctcctgagctcatgactgtgggcagctttcccaacggctgggggtatcaaggggtagaaaggtggggggcatcctctgtgtgcccgagccaccccttgccagtatcagagtcagctcatattcttaccctaggggccagctcgcccatacccctgccatcagggtcggctccactgtgctgcctgtgtgagggaagagtgctgctgccagggagagatggggcaagatctccagagtgcagcatccagtgaggggcggggccagttatgcacatcctctggacacccacagtctctggaggttaccccaaccatgttctctagtggtaatatgagtgtggacatcaacaccaacccctgctgttgtctagcctcggactccatcatggccctcagcagcagcttgggctagcctcagactccatcatggccctcagcagcagcttgggctggaccttaccatggcctcaggtggcagggctagcctctcacagctggctgctactctccaccctcgagtctccagatccatctccttcatcatgttcaagctgctccacttccctgtctctcccacctgactaccacatgctcccacactgtgatgggtcccgccgaaggctggccacacagctggtgggcccctgggtgacatcctccatgtgtactgtgctgtgtggtgacacacaggtgatgtgtcccgcctatgctgtgcactggacgtcatgtcaaagggtggcatggtggtccacaggtctctgtgtatcttcctcttcccatgctgtgctgcctggatttgattagatttggtttttaggagtcctaggcataagcccgctttggccaccaagccaggcatcaagctaggatgaacagaggactgtcatctgctctgcccctgactgacgtaagagcaacaccactaatgaggtgtccctttgccagttacattatttttaccacttgtgtgcatattcacaggaaggcaggtgctcctgaggaccagtagcttcagtgggaactgaactctggtcctctgcaagagatgtctatgccctcaagtactgagccatctccctacccccagtcattcccctgcagtaacgtttgttttaaaataattttttatatgtggtgacacttttgaaatgtaaatatttggatatgctggctttagtaacgtcagaattaagttcacttaaaaaatgtagcttgtaggaatttgaacttccatccctcgtgttttcttggacagcactactgtctactcagtactgttctcaaagaggctagctgttgtccctaaggcagtgaaggttggttctttagactttaaagatcttattctcttaaactgtaagggacgtgccattagtgaacaaatgctctgttacctgtggcattaacattttccgagggagggtgaggacatgaaccgggccttgtactgggaagggcggggcttgtatgggggagggtggacaacgagaagcaggccttccacagtcaggcctgacgctggtgtcacccccaccactctggttgtgtgactttgggcagatgccctctcatctctataaatctgtgcttatccagaccctgacatgaggacagagctctggtgtaggcagctctgagtccctcggaaagatggcagctccaggcagttacagtgtacataaaggtctgaagggaggactctgcttcccgagtgaccacatctgttagcgtctgtgttctcatgtggggaatgggttgctgagagcatttgtgggaaggttctgcacatcactggggtatttctagagatttccacgcttggctcaaacagaacctcctggtcgtgttccgtccagctctctgggccaggatatgccggcaattctccccagggctgccttcaatgggagggctgtgcaagggtgcagaaggggaccgctgactgttgagtgttctgtccagaagttggattcaaggtccttatcaaggctttgagaattggtggtgacttggaccctgtcctggaaatgcagaggcagcctcacagtataaacgggctatatgctgctgtcacttacgagagaccaaccctgtgcctcctgcggacatgtgatctggaggtagcccgtcacagcacatccaggaggaacacagtctgctgtccagagcctggtggaagcagggcacgtgtgtgtatcaggcttgtaggttgggggaagggagttagttccagtgtctgcagactctctcccttcactcataggaacccagcctgtccaacgtagccctctgtgtctgagaggcctgactgggctcagacctggcactgctcctgattaagcaacagatggccacactgttcccagcctagagtcagccactgtcatatggcccatggggggctcttctgtccccacctgcattccaggcaggccacatacacagtacagaaaggcatcaccactgcgtgtggagcacacgcctttaattctggcacttgggagccagaagcaggaggatctctgagttcaagccaacctggtctatggagtaagttccaggactcaggaacataagaacaaacaaacaagaggagagagagacacagacagaggcaggtaggcatgcatgcactgtgtcactttcccctgtcacttgcatgtctgatgtctgtgacgagcttctctcctgcccctccctagagcccgttcctcactcgctctgccccagacctcctggccccacctctgagcctctgcacatgctcctgtctgcttgaaattcttctcacttgcttccctgactcttctctgcccaccctttgggggtttagccggagcagctttccccagagcctgagagacagtggatccttatcagaccttcctctccacttctctgtggtcgtcaccactggctgcgtgcacgcgtgacttcttcctgtgacagctgaaggaactgtccactgtggaactgtccactctgctgccttcagtttatcgccactaggcccacgagaatgctggacatgtaacaggcatggatttgtacttaggaaatgaacttgctttgctgtgtgtctttgtaagtgcagttccccctctgtgctcctgactaaactttggtggtggtagattttggggtttctgtggactgccccagggctttcagctcaatgggaagtggcttgccatacctgtcctttgtgctctagatgagtaggaggtgtgtgtcagggtcggctggttgacccatggagacagaaatttggagggcaccagtgagcccatagcccatggctcttcactggcatggctgtattataatcatggtgccaacctccccacacagaagcagaaagaggactctatacttgtatatatttaaatccagagcttgctgcctgttaatgcaagcttaggcagctttactgtcttgagatctcagttttcccatctgtgaaatggggctgtcagtggacctcctctccttaggcagtggtgtatataaggtgttactccaatgttcatgtaaaacccaggtgctcaataaagctgtccttgtgaccacatgctatttccttctgtgtttcacctgctcctgccctttagatccccaacctccaggtctccctcggtcatcaggtaactcaaggtagaaagtggctgaagagcctccttgtgctaaagttgctgtgtgggcaagtttatgttacttttaaagaagacagatttattgaaatagaaccgcacgttgtactgatacgcgcatgctcgtgtgtgtctgccgtggtatgtgtgtagaggtcaaaggacaacctttggcattggtctcttctcccattgtcaggggtgggattgaacccaggttgtatggtttcggcagcaagcacctttaccctgtagccctccttgttgacacagagaacttgattttgatccattgacattagcctgtgccttgtaggatcacacttgaactctgttggtctctgctcctgagccctacctagcagctccacatggatgcaggagggtgagggtcagccctgagggtggggctcagttcagggtaggtagagtgtgcagagcgaggaggctgttcacatcagtgcagcccgggaggaggaggtcgctaagaactagagcaggtatagtcttcaaaggcctggcccagtgccctactaaccctgttcaggctccacctccttgaggttccacagcctcctccaaagtgccagcagctgaggcatgtgtgtaacctgagcctgtagggatgcttccaagtcaaggcatggaggctggggatgtaagggtaggggttctgggtccttcctattctctgctgctcagtggaggattgcaagacggaagaccacccagaggagcagcagggcactgttgtcaccaagtgggggacaggctgaatggcctgaaacaatggccgcatatggtatgtatctggagaggacctggggacagccttaacccacagacacacagttgcacaaacacatccataaaaagtgtgcacatggctgggaagatggctcagtcaggaatgtgcttgctaagcaagcaggaagacctgaatttggattccctagcacccgtataaaacagcaacaaaaggctaggcctgtaatatgagctaaagaaaggcagaaggaggaggctcccaggaacgagtcttgctgaattggtgaggcctgtcttaaaattcaaatgggaagcaatggaggaagacactgagcttcaggcctaaaggtgcacacatgcgtgtaccatcccctcaacaaacatacacataaaccacacaaacagaaacaaaaggcatgtgtgtatacatacatcctaacacggtgtacctttttacaccattccgaagtgggcattctcgcgtccatttcacagaccacagaactgaggcactgagtggcagagtgcccttttcctggatcagtcagtgtagaccctgatcgggtatgaaccctgggctgcctatgcccgtcctgtctcactactatacttaagggtctcagttttctcagctagcaaatgggtagacttgcccagcctgggtagacagtacctggagaatgaaggaagtgggaagataggaaaggggtatgagtcacccacaagttgaggctggggctgaagggccctgggagctggtttagcttggttgccttctctgggcctctctggctgggcacataccagccgtctttccccagagactaaatttagtattccttggggccaggcagtccttgtcttgttttgagagaggctccattttgttcctgctgctgctgctgctgctgctgctggtggtgaccacagctcagtgatcgccttgcctggtctctgctccccagaactggcctcagttgatcttgttggagctgatgagtagctggcctcacaggcctggccttctgtggacaggaggagctgtaagaggtgtgccaggagccccccacgtcccgcctcgctgcttctcaggcagaggcccttggagggagccgctagggttttctttggcatccactgagcaaatggctccgtctctctcttttcttccgagccctgtaaaaataaaaagttaaaaggcctaaagtttgaacagtaaaactaaatacacgaaaccaagctgtttccatgcgggagccacggacggcgaacacccaaggttgaaacttcctctcctcgggatttatggatgcctcggaaactttcccccctttttttccctttaaacatcagatcggctcagggtgcactcgcagagcgtagcctggcgctcctcacagcttgatttgatgcagctgggtcctgtaaggacttctgagggccatgcttcagaggcctgcaaagctgtttcaacactcagtaagtggggtggttgtgtgtgtgtgtgtgtgtgtgtgtgtgtgtgtgtgtgtgtgtgtgtttctaagccaagaagtgtagtctgagatttattaggctcttctgcctctccactagtaacccagattctgcctctgcagctttgagagcaggatcgggatgatgagagagccttccctgaaggaggcctgtccacactaaatgttcatgtacttatgggccggtgtcatttgctccacagagtgccacaggcccaggtctgctgcagagcatcagcacgaggtggtcatagtgggggagaaggcagggaggggaggtgtcacccattcaaagttgactttggacttccgggcctgggctcctgggaaatggtgtaggacaagggttggcaggggagagaggagtggtatccccggaagtgggtggcatcctcacctgcctgtcttcttccttgaccatgggtcacagtgtggcctttcgggaacttgatgtcaggaagtagacgctgcttttccttgtggagccaggggagagctggtggaggtggcagctcgcgtcacacctgtgttttatggctctgactgcataaaacaatttaattgcgtttggagtgtaacccgctctgtgggaaaagtgtgggtctagtgtgtgagaacctgtattctatccccagcatgaaaaaaatgtgaattgaattagttacccaaatgtaacaaatggagagaaagcagcaggtttaggttttggcctgggcatctgtctttgtgctcgttgtagcagggttgacaaggagagcctgagccattggctagtgcgctctgcccggcctgggtggagtaccctggtatagctggtggggaggaagggggttctctagtatcctacaatgccaaggatagccatccatagcagaatgctttggtgcctactttcagaagggccaaggtagagaagcctactctggggtgcacctggcaccccacttggcagcagagcctgccatgcccatccctctccccagggcttcagaattttctcaaaaattggaatccctacaattggtagctagcctcttggtctctagctgccttttattcaaaactgggattatatacttatttaacccctctcagggccctcctacccttgccttgaacacattatgggttcttggtaactggcagttgtgtgtattgcacaagtgggcccatattagagcctagaggagccgctctctgtggccaagttcagtgacatgaaggcatttggtcacttctcccccagggagtgagagactccaaacatgagaatccctggctttaacacatgtagattctttgccaaattgcttcgattgtgccgtaatagaacgggaggggattgggtctgtctgtgctaacatttcagggctagatttagggtgtgagtcaagagacacccacattggccaaccataaagatctggatggtgcattagttcccgcagaaagctcaggaaatgttatggctctgatataatattgctagctcttgtttgctttgatacactattcgttacaatcttgatacaatattgttacagagtaatagatctcgtcctctatcctggcccttcctctggcagccaccattctcatgtctggctgtgggcttagtgtctgtctcaggagatacctcctcaccatttctctataagttgcttgtgctgggggtgtgtgtgcttgttgaggacagagatcaacctcaggtatccttcctcgggtacagtccaccttgttttgtttgtttgttgtttgttttcttttaacgataactctccctctccctggaattggggcttgcttattaggccagtaagctccaggaatctacctgtccatgcttccggagtaccaggattacacgcctgtgcccgcagtgctaactttttacatggcttctcggggttgaatttcaggctttatgcctgtgcagcagaggctttaccaacggagccatctccccgcccctggaagtcccttttgatcaaggcaggcagaactggacctggagtttgggagctgaccttgttctgggagggctgcagggaggaggtgggagccgatcttctctagcaggtttttcctttgctgtttcttgccttgagctcttctctgccactgaggagtcgtctctccacccctggtatttttctttccttttgctctggttttagatgaaccagcactagcacaaataaaccttggcactgcagtggcccagtacattagaattttatcatgcaccagtcccaacaagcaagtgtgtggatcaaaaggtggcttttggcctcttaagtgatttggtggcccaggtgacttccatcttgtggctcattctgcttgctttcagttgccagatctcttcatctgcttggattcatgaccgccaggtgcaggtcccatttctgcccagagtccctgagtggaaattaatgccagccccacttagaggaaagatgggctaggtggtggtccatctgagcctgcatcttatgagaggaagcaggatcatggggctgcagttacttcttctcaagacccagcttggtaccctttgcagatgtctggcttcctctgtcactttctcagctgcctgtgtctaactctacattgtacatccgcctcttctaccacactgtgtggcattgcctctgaggcctgctgatgctttgctgtgggactcactctccacactctggacaccctccatacgcataccattagcactgtgtgtgtcagaactggctaacggtttgctatggcatcactgttagtttgggtccctatggtaatgcctcatcttgaaggaaatcatcttgtgtctctctggaaatgcagataccattgggactccctggaaaattactttatatccatgaccttggatttaagatttaaggttacacatccctgtaatcccagcagtaggaagactgagacagaaggatgagacaggagatcaacctgtgcaacaaggtgaagccctgtctcagaatggggtgtgatggagtagagtattggaagccctggccatgcattacagtgacctctaagaagtccctgaaaggtgttccctgtgcattgtgctactgtctaaccacctgaccaaggacagtgcatgtgtctctgtgtgtgtgtgtgtagtgccattgatggtctgtcaggattttgtctgtgtcactttgagtttgagaacaaatcatgtttctgacaagtacctcaggagtgttgatgtggcaccatgatgggtctctgtgatggactggccatctgcgtgccgctatcctggcttgccccttcccatgtgtgtcaggagcgagcatggtgtctgtgggaggcattcaggaatgtggcattaaagaagggtagctgtgcacaaacgcacaaacgcatcatagcatctgagggcagctctcacataccctggcacaatggcacagttgcccagggggtcgtctggaggcacacttgacagcagcaccaatcctgagcacatgtgtcctgctctgcagagcttgcagcctggtgggcgctatgatccccatgaaggactcgtttgatccacattttagatttatttattgtattttatgtgtaagtgttctgcatacatgtatgtccgtgcttcatgttcattcctgctacccacagagttcagaagaaggcatcggatccccaggaacaagagctatggatggttgttagttatgatgtgggttatggaaaccataacataacataacatggtcctctgcaagaagagcaaatgctcttaaccacctctctagctccttgacccacattttaaaatgccaagtttacttagaagtctagattttggatttttgtataaagacaggaacatgtctgtctctagccataacaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaggaggacccctaaagtgtctagcaatcaaatgctgaaggaccagaggctcagggtggcagtgggagcagaggtggcaaggttgcctggtgatcacgccagagagcattacctgcccagctatagaaaggtgcctataggagctatagaaatgctagccttgatgtgcagatctccctgatatgtttctggaaggccagagtgcactgcctgcccaaggatatctcagctaattagtccattagaaccaagtgagcctcagatctcacacttggagccgattgctaattatcccttgattgctgttgtggttaactgatataagctctcccaggctgctcagtgtgggcatcctcagccaggtccagagcttggccaagaggagagtcacttttgtcctgggtgagagagccctactctaggtccccaaggagtctagatcttgctgtactcatttccaaagggaggtcttggcagagagcacagtgctgcattgtctgtagacacctgtgtgtgttgggagggggtcattgttactcaatgggccttgcaggaattcattctggaggattctggcagctgtcctggctgaggccactgccttcatcttgggtcagatggaaacataccaattactcactaagttgaatttgctgtgggactcaatgcaagctttctgcctggtggggatgaggggacaaaaggtactggggctgtgccttaggaccccagctgtaaggacctggggctagaccacatgcaggaggtcagaagttgtggttgatgaacttgctgtccttggaagaatgtttttttctcattttgaacttgggcagacctggaactattttaaccaataggaggaggccatggaaagggatgcccagggaggcttgggaatattctcctctgtggtcctgttgtccatattggccaatggagaagttgagtcatcttgctagaagagctgtgtgtggggactccaaggctgaatggagcagagagaagcccaattatctcggccttttagctgtcccagtagtgtgccagaaacaaagtgaaccacttcagggtgccagtcaggccaagctcccagtgactcaactggaacctgcagcatttctcagtgaagccgagtagtccgaagcatccagagatggctacagggccagggtaagcctctagattcgaagtggttcttgtacaacagatccaaaacctttggcttcatgtcagtagggtgtggaagaagtgtgtcctgtcacttgtcctgtggaacattgcctcctgagtaactgagtaacccatgcttctagttccaggctgtgcacatgtgtggcaggccaacagtcatgtgctagagttgaagatcacctcttcttgtgacacgcgtacagccaggacacacacaaagccctctgtggtttaatgagtttattctccaagtagggaatggctgcagcatcagtagtctggagatctgagatccaaaatgcctcaaagtctaaaactgtgtgtgtgtgtgtgtgtgtgtgtgtgtgtgtgtgtgtgtgtgttttaaaggggtaggggaaacatatggaagagagaagagagagaagggggagagggagagagagagagagagagagagagagagagaaggagagaggttaacttcaagcaccagtcctcaggtactgtcaagccatttttatttatttatttatttatttatttatttatttatttatttataaggcagggtctttcattggctggagctgtccaagcaggccagcaataagcttcagggcctcttttcgtctctccttctccaaaactggggctataggtgtgaaccaccattcctggatgttttatgtgggctttttttttgggggtggggtaaacttaggttttcatacttgtggggcaaataatttccagcctgagcttcctccttatccctgaaacctttgagcatcagcattgtgccacagtggggaaatttctcatcatgtgggcaggttgtacttgaaccacagcaccctaagaacattgaattaggctccctttagactgtgtatggagcatggatgagacagatgaactttgtcatgtttacacatgggcctcctttctagaatatctacctacatggatgtaaacattccaaaacaaagaaataaaagataacattgcctcttagagctggagagatggcccagcggttaaggctgctgttggctttcttctatagtgccagaattgggttcccattacttcttggcctttggctaagatcaagtgaaagagatttttctcctatgtcagaagaggatggtcattataatttgtttagttcttaattgttgctatgtaataaattatcccaatatttagtgttttaaaacaacatttgttctccttcacatgggcaaactggctggctcagtatcgttctaggttgcactgttgtgggctggtctgggttgggaagctgactctgggctgatcaggattggctggtctgggtggggcacctctaatggggctgaggtgggctcgtttagactggtccaaactcaactgggctgatctggattgggctagaagaagattgacttagaccagttgcctcttcatgtgtgtttcacagatgcttctcatcacagtgacaggccttggacaaagtgaagtcccctatcccttgtcaggttttgtattattcttatccctgtcctgctggcaggtcgtgtggctaatcaaagatgcagatgtgaggctgtggcaaagaaagtgaagtcaagatgtgagaagatgaggcctctgacctgggggtcatccccagcttggggaagaggtcctttactgctcacagctctggagttgggtagagtgttgttttaacaacgttctgaatgtggctttggccattatttatctggaatctcagctttcttctctttgaaacttacagagtcgaggttgagagatggctccgtggttaagagcacatgttgctcttccaaaggacctgattttgatcctcatcacccacatagaagctcacaaccatctgtgacttgcagttccaagggatacggtgcccgcttctggcctccgtgagcaccaggagtgtatgtggggtgcagatatatgcaaggcaaaatactcatacacatacgatttaaaacaaaacaaccaaactggtgtagtcatagaatctggggtgttgcaagggtttcaaaggaaggcaagggtaaaagaaggcatgcagcagtgtctggccagatgagcgcgtggcagatggggacaattattcaaagaccagccatcagagaagccattgtaggtcacaggcacatggatatttggtctctattggggccatttggtgtcttttctttggccttcatggaaagccaagaacctgaactatcttagggctctactgagtcctctgtgactggacagcaagggctatcaataccttctctttcaaacacattctgtcacatctgactatcttgagggctcattggcaatgtgcatagccagtactgagcctcaaatgcctcaggaaacacatgacctctcttcatgggattccttctcaggctttggagagagtcccagtgggtagatggtaaaaccattcgtcattcagattttgacctgtgacattaaggaccaataagagtcactgaagtccaagtgttgatactgaatattgggcaggggcagggttgagctggcctttccagggtgtcttctaaggaactctatgagggtgggaggagaaaggagtggtacccagcagctggggtctgtcagcatggatagctggccaaagaattctggcctgtgcctgagaagaggctgtcttggaagtatatccaggcctggaaggagctgagagctctggccagcaggcctgcccagggacttggggctggaatgttgggaatggaaagctggcctgacttctaacactgcggagctggctctctggaggcctccctgcctccagaatccagcagccaaacgtttacacagccaggcctgccccttgccctcaagcgcacaccctgggctctgtgctcagctggacccggacactgggctttgtggcttagtccagtcctgatgctggactccaggcctgaatgtttggctccacagctctgcctggccaggatgctggggtctgtgacactggaagtgctctggggttttgtgtgtttatttttgagatggggtcaccgtgtcgtccaggctggcctggaaccctcacatgctaaggttgcaggcatgtgctaccacactggcctggcagtactgcttcctctccagttagagttggcagtgacaggaaaatgacagctgccatcaagacaggcttgcttgtgcagcagacacaagcttaatcatctacatcttcattggagctgacacttgttcaaatctgccctctggccctttccatcttgatggggtggacttcttcagaccagcacatccctacatggatgagagtcatcttcagcgggacagaggctgaggccaacacactactctgtggggctcggctcatctgtggctggccctgccccagccctgctacctccgcacacacctcgcacacctgtgtagtatcttcctgcttttgacatcttagaagacaggcctcctgttggagtaccagaatggtgctgtattactgaagatgctagtaaattgggtctgctcagccctagccactaagtttaagaacagtagacttctaaaccacaggcctgcagatctgctgagggccacctgtgccccgtgtcagggatctggatggtgtttggtctgaagtgttaaagactatctgctaaggcttctacggccttggatgctctcaagggctgttgactctcgtagtatcttttaatctcctttgtgttgcctctggcttcatctcagtgatacagaaagaattttcctgtctttggtttggagaggaaagcccaacctgttaagatatactccgtgatgagctaggagttgcttcccatgtatccaaaatagaaggcttctcacctgtgcttggatgcctcctgtgacagagagcagtgctttatgatcagtccttttcttgtgggactgtcctggttcttagagctaggtatagagaatttgggtcctccctcccactaatcttgtttagattcaagaaacattgaattggccttcttcctcttcagaggagtcattcctccccatggggaaacaggctactagttatttctcctcttgggtcatcagattgtcagctgctcctcaagtccctatcttcatctttctgccagctctgtgtcctggagggagttacttggcctctctgagtctttgcttcttcctctatgggatagggatggcagctgggcatgatgacatagacttgtaatcccgggattggagaggcaaaggaggatcagcagtttgaggccagctgggctannnnnnnnnnnnnnnnnnnnttgctgttggactcactctccacactctggacaccctccatacgcataccattagcactgtgtgtgtcagaactggctaacggtttgctatggcatcactgttagtttgggtccctatggtaatgcctcatcttgaaggaaccctgtttctctctggaaatgcagataccattgggactccctggaaaattactttatatccatgaccttggatttaagatttaaggctacacatccctgtaatcccagcagtaggaagactgagacagaaggatgagacaggagatcaacctgtgcaacaaggtgaagccctgtctcagaatggggtgtgatggagtagagtattggaagccctggccatgcattatagtgacctctaagaggtccctgaaaggtgttccctgtgcattgtgctactgtctaaccacctgaccaaggacagtgcatgtgtctgtgtgtgtgtgtagtgccattgatggtctgtcaggattttgtctgtgtcactttgagtttgagaacaaatcatgtttctgacaagtacctcaggagtgtttgatgtggcaccatgatgggtccctgtgatggactggccatctgcgtgctgctctcctggcttgccccttcccatgtgtgtcaggagcaagcatggtgtctgtgggaggcattcaggaatgtggcattaaagaagggtagctgtgcacaaacgcatcatagcatctgagggcagctctcacataccctggcacaatggcacagttgcccagggggtcgtctggaggcacacttgacagcagcaccaatcctgagcacatgtgtcctgctctgcagagcttgcagcctggtgggcgctataatccccatgaaggactcgtttgatccacattttagatttatttattgtattttatgtgtaactgttctgcatacatgtatgtccgtgcttcatgttcattcctgctacccacagagttcagaagaaggcatcggatccccaggaacaagagctatggatggttgttagttatgatgtgggttatggaaaccataacataacataacatggtcctctgcaagaagagcaaatgctcttaaccacctctctagctccttgacccacattttaaaatgccaagtttacttagaagtctagattttggacttttgtataaagacaggaacatgtctgtctctagccataacaacaacttctcctttgtgccactatgcatgtgtggaacaagtgttctttccccgagctctatccccagccttaaatgtctcaccgtgtaccccagtttggccttgaatgaatgctcttctaccacggccccctgagtgctgagattgtaccccccaccctcatttctaagcctcattagatatagctggagctgagggcagccatgccctggcaggcctgtgtctcccagaggcccatggtgctcagtagtagtattgcttgtttctctctctgtttcttgccttatttttttaaaatcttaataattctctattaaaattaattaaattaaaaataattaattctttatttattaaaaataaagaaccatactggctcctgaacaaatatttaaggtcctgctttttgtgtttgagtaacctagctcctgagggttgaggtagaacttgccacttctgccctatctcctagacagtcttcccccaatatatgatccgactagattctggggaaagacagattctgtgtgaaaataagtttgggaaacgtcagatacaatgatcagttaaattttttctgcggggcttctcagtgccttcatggtgccagtgcatgctgtgaatatcagctgggcgctttagctcagctcagtgttgctcccagttaagtgactccttttccaagctcgtctggcctgagaagccctgaaacaggaccacaggggtgagagtactctcccctgggctctgtgctcacctcacgtgtgccgttgttctctgagtgcacctgctggggttcctgttgcaccgaggactttgcagagacccagaatcacctctgcggagcctccgccttctgtcaccttccagcagaggtttccaattcttctcgcctcatgggaggatttctaccatcaactcagagcagttggattgagagagctagacaagcagcaagtgcctgctctctgagtttgcggctctgtgctattgggctacacggagctgaccagtctttcctatttttaaaaagacttatttattttatgtgtctgaatgcctgattggatgtatgtgtactatgtgcccatggaaatcagaagaaagagtcgactcccctggaactggagttacagatggttgtggccactgtgtggctaggagtctcaggtcctctgaaagtaatcagtgctcttaaccactaagccatctgtccagcctgctgagtcattttcttcttcatgacaatgtaatggctcttagtgactgactgtgagcctacaggagcaaattgggacctaggaagacaaaatggttgtgtataggtgtgaatcccttatcctgactggcattaatttggagagagtcaagtagatccggaggcaggaggacccctaagtgtctagcaatcaaatgctgaaggaccagaggctcagggtggcagtgggagcagaggtggcaaggttgcctggtgatcacgccagagagcattacctgcccagctatagaaaggtgcctataggagctatagaaatgctagccttgatgtgcagatctccctgatatgtttctggaaggccagagtgcactgcctgcccaaggatatctcagctaattagtccattagaaccaagtgagcctcagatctcacacttggagccgattgctaattatcccttgattgctgttgtggttaactgatataagctctcccaggctgctcagtgtgggcatcctcagccaggtccagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcctatgacagagagcagtgctttatgatcagtccttttcttgtgggactgtcctggttcttagagctaggtatagagaatttgggtcctccctcccactaatcttgttttgcttcaagaaacattgaattggccttcttcctcttcagaggagtcattcctccccatggggaaacaggctactagttatttctcctcttgggtcatcagattgtcagctgctcctcaagtccctatcttcatctttctgccagctctgtgtcctggagggagttacttggcctctctgagtctttgcttcttcctctatgggatagggatggcagctgggcatgatgacatagacttgtaatcccgggattggagaggcaaaggaggatcagcagtttgaggccagcctgggctacatgaaacactgtttcagacaataatgaatgaatggatggatgaatgaatgagcaagtgaatgaaatggagatagctatagttgctgtgtgtcgatttatgctactgcctttgctctgggattggccgtgttaccagcccctccccagcttcccttttgctccagggggtgggcagtgctaccagccccatctggccttcatggaatccttggacaacacacatacacacacacacacacacacacacacacacacacacacacacacacatttttacaacttgccttcttggcacaatgctgggcgctgatatctcctgcctggaaaagcatgcccttaccaatttattatctccgtctctccacttgccctaaacttcagtggttagtcccacctagcccctgtcaaacatccctggccacccacctgtagcaatggtcacaggccccaggtgccagccccaagacctttcatggctgctgcattcttctccctccaaagcatagcagaaactcctctctcctgccttgcatatgacttttcctcctggcacccagaagtcctgcccgtgctttccgcccagcaattggcccctggctttctttgctaacaaatcaagaaccaattggggaacaggaccttagcatcagaactgcccacttcagtagttccaactgtagacttttcatgactgtcaaatgggctaagacatataaagtagtaccgtgtactaagttgagaatgccagctcgtcactagaccagggcttctccaactagaacgtgcatgagttgcaggagtaattcatgacttgcatgaggatcaggtggcagcccgacagattccttaactctgtggagactgctaggcctcaactcagactctgaagagaaaaacagtctatctttcttcggtgtgaaatttcattttccagatgaggttacctcccatggtatggctgttgtagtgtgtgtgtgtgtgtgtgtgtgtgtgtgtgtgtgtgttggggatgctcatgcatgagtgcatgcaccatcacatgcatgtgggtaggcatgtgtgcatgcatgcacatgtttgcatatgcacgtggaggccccaagttgacactagatgtctgtccaaattgctatccacattattttatagaggatcttacccagagtttaccatacttactataatgcagcttagggtatattgtttaaaagactaattattgatattaaggtaattgttattccttttcttggaatagttggaagtagtcactataggcaagttgttctgcagtttgcatgtcttgatgggtccgagagtctctatagggagagagagcttactgattttcctgggtaatcttgactctcaactactcatccgagagggggcgtctcaatggaggaatcctcctacgtggactatggtggattgtcttggttgtttaataatgtgggaaggcccagcccactgttggcaataccgttcctggggcaagtggtccagggctacctaaaacaatgctggttaagcataagccagagagcaagccagcatcagcatccctccacggtttctgccctgatgcccatcagtgatgtattgtagcctggaagcgggagccaaataaacctctctttccctatttgcttttagccatagcgtttcaccacagcaacagactcaaactagaacaccattcatttccttctgcagcacctgggatgaatcaaatgacaaaccagagctgctgggaccccagggtcctgaagggtggtacaccttctcagggatggtctatctgagtgtccagtgggtgaaccagcctctgacatctggattgtaggggttctggtgtcctacgaggtcctgcagcatgcttgcttgagaaggaaaacaatttgcagaagggaaattcctgagaatggagaggctgagcactccagccgaggttggcaaggggatcctacagctgggactctgctaccagcttgtcatatcaccaggttgccctattccagtgctggccctagcttctgagttgtttctggggccacagagctgcttcagctgcactggccctcagttcccaagctaaatcacagccttgggagagtgtggagtcctggctcaggctctggcctgctgctgcttctcagccacttgctggagggtttcttttgtttgtttgttttgagcagatcttggtcttggtttcctcaagcggtagtgcccacctcttatatccaggacagagttaaacacagatcccattaatgcccacatttgagcccttcctcatgtgctgctgtatgacttcactgctaaaaagaaatctaaaactggatgttatatgaaggcccgccatccggccactcaggaggctgagtgggaagacccatgagcttagggccagtctgggaaaatgaccgcaagccttttggaagcaggattctcagccatgtccactctaccctttagcctggaaagcagtggaggggtcctacctgtgcagagatcatcagcctgaccttggctgtgagcaagtagctggcctcaggctataaccctgccaagctagaaacaggtagaggctagccccaaatggccacttgaagaaccaggccctagaggtaaccacttgcctgggagtggaatctaggcttggggtatttgtttccatatgaggtgctggcctccatgagtggtcttctgtcttgtttgcattcttgggcaacagcttggctactgcagagttcccgggttgctggagactggccacatcgccaacatcactggcctgcattttgaataggagccagagctagatgccggcagaggccagctcagctggtgcctgtccctggcctcactgtcagcaaagactgttggaggcccagtgctttgcctctgctgccctccctgactcgtgatgccccatccccagtctctgcctctgtctagcaccctactgatgatggtttcttcaacacagagaaaactcattctgcatgaaagaaggagggcccttgtctccactgccagctgtgtgtatgtgcgcatgtgcacgtgcatgctaggttgtgagtctgaagggcttctggcatggggagggagtgaagcgggagactggacataccagggccgagggctgagcgggaatgtcatatctcaggatggcttctctggaagtctgcaggaagcaatcaggaagtgacacgaggaagaaggaagcacatgtgcagagggcaggaagctaaggaagatgggcccacaaggtgggggtgacctctcagagaaggggcagcagaaagcggtggacggcgtgcccccaggtcagttaccctagacagtgccagttgctcttgcgttccttgccttgggcataatacttctctctcttgaaggtgctctgcttgaggcgctttaatcataaggacacctggggtgagtgttgagtgcttggtccccagggcagcctagccagggttcactagcaggagtctgggcctcgccacagcgtgggctctctagcagatgtgtcctacctacatgatgtctgtcattcacaaagttcatgctcaagaactgctcaatcaggtactcttccccccgccaaaggaatcacaagaagattaatgttttgagaaagttcatgactttgtgtgacatgcatttgtggctacccttggctgaatgtggtcggtggccagcaggctggatgagcttacaagctacgagcctaaataagtttcttctctttgtacttgatatttgtgacagtaatgggaagtggtgtgtgtgttcgttcatttatttatagcagggaaggccaaggctgaggcttcaggccccagagtgagggtgggtgagctgagcccttctgtcacctgagcgttcctgtccctcatggtgaagggtgaacttgggagttttggggacatacattctgggcctggcagaatgtgttggtgatgagacgaaggtacattaactaggacttggcagccatgatggaaaacaagctcaagtaggcgtgaataggaaggaggagatttacagttcacatcactgaagtgtctaaggggtcccagcttcagccatcgtttgatctaggggctctgatggtggtgtaacctgttttttcttgcttcactgacccctactttcctgggttcccttcttattcagctaggatcttcctgtaaggaagtaaatgtttccagcagttgcaaattccaagcctcattatcgcagatgtcctgagaatgcactggggctccttggcctggcttgggatgcacagttcccattggttgggtcatgttctgtgcctgtcgtcatgcttagggggagaagtcagccctgacctacaggtggatgagagtaggggagaaccaggatttccttgatacataggaattccagatagaagacaaagaagttttattttaaatctgttccaaatcttgcacaggcaagcctcacactaagcagttctgtgttgtgtctgagatgcccagtgctctgggtggagtcggacagcccaggatagacatccaaagatgatcagtaactctggagggaggagctatgtatggacactgggaggggctggacaggagattctcactcacagattctatagcgagcacatagagtcagaaggagggacaaagatacttgggtcccccagagaatggtctgaagttcagcctagagctgtagatgagcgctctgaggagatgaagggtggaaatgtcccttctctctgccagcagagactgagttctggtgtgaggtcctacccttcgctggctacactgtcattactatgatttctgggcccgaacctgtgctctttctggtttacacaagaccgagcagcctgtctgctgtctgggaagtcaccgcgtgaggtcggagctccccaactgcagatacttaagtgggaacctgtcttaggtcaaaggcaaggattgtctctggtctcgaggttgtcccaaggcagtcaaatgaaggaactaagatgcaaaggttccatttctgggtggggctctggactctagcttggtcctgtgaggacctctatagattatgacttctctctagagtttgtccagactcaacaggggctttagccccctctgctcttctcagggccacacagttctgagccttcagatcaggtgccagggtgggttttgaggaagcctcataagagtggcagctgggaggcctcaaggagccttgtgtgctgaggctccagagtggtgagctagtcaccctatcaaaggctctcacagtgctaacacaggggtcagtagagtgtgtcagaccctccgtggggagacccctggatacgttgtgtggtctttctgactgccggggctgaactggctgcatacagaacctgcttcctggctgtaaatgggttggggaaactcctgagctgatctcttgctcctactttgggtctttggggtactgatggtggctctgctgctactgggctctgtaaccctggcatgttctgtctctttttgcggcctcttttcccacctatactctggttcttataaacatctacaaatagaaaaaaataaaagtctacaaattgactggttcacaaaacctatgtagtcaatgtgccatttccacggcaggggcatcctcagtgggtctctggtcctgcctgggctgatgccagcccttgatgagaggctgtctgggcctctgctgtagtgtccctagatcactgtagttctcaggcctggcctacacagaaggacgcggtccttcccagctgcacctcttttcttgcttccccttgcagatccttaacccctaacatgtaatcagggagggggtgataattgcccattggtctctctgggttacttggagtaagggatgatagagaaagcctcagctgtggatgccttccatccctggacctgagcagtctccttccttctctgctggccacacagcatctgccagtccttcacagtcctccttaggccaccaatgacatggggtcctgatgtgtgtgcaagggcaagcagtgacttcttgaacccaggctatttgtcttagtcagggtttctattcatgcacaaacatgaccaagaagcaagttggggaggaaagggtttattcagcttacacttccacactgctgttcatcaccaaggaagtcaggactggaactcaagcaggtcagagagcaggagctgatgcagaggccatggagggatgttctttactggcttgcctcccctggcttgctcagcctgctctcttatagaacccaagactaccagcccagagatggtcccacccacaaggggcctttcccccttgatcactaattgagaaaatgccttagagttggatctcatggaggcatttcctcaactgaagctcctttctctgtgataactccagctgtgtcaagttgacacaaaactagccagtacactattcttctggcttttgggttttctggaatgtaaacctggaatgtaacagtaaaacctggtgtgtggtggcaactgtgccctcctcttccctgacatgctccattggtcccctgatacttggattccaagttctcagcatctaacggaccagcggttagtccttggcttcccacatgtgtgcagccaagagcaagaagcaggtggagtgttcaggactcccaggtggctaaggacacagaaaagttctacactgtgtggtggctaaagaccctgtcgccttgagcttggcacccttccagctgactactgtaaagcctacctaccacataggtactggttctggtacactaccttgccttctctctgcctgatggcgatgaacatcaggcaacccgcatgccagctgtcacagcctcagagaacatttttggtgccatctctgtaaccttgatgtatgggaacacggtggataattttagcagagacaatcacgttctttgggctcttgggccagtgctttcttcttgggagaaaatgcagggaatgttttcttagtctgtaaatagagagctgccttggttgcgcagcacgtgcctgctgcatgcctcctgtcagggccggtatagaattacacaggcagtagccccagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaattcttgcttaatgtgtacatttcacttctagggcctcacttctgaggctgagtggggaaccctggcttctgatctcccctctcccagctcctggcctcactgcttactgtcttaagtcagagcacacctccttcccctccacaaggtagcttgggggcagcagagtcattgtgatcaggttaacagatgacagtgccacctgccacaagtggcctggcttacagccaacttaccccgcaaggcacatgggctgtatcctggcagcagactggaggacactagagcagccgctacagctgccaggtggtcagaggtgttcaggtactcttgaccgcttccgtcatccactctcagccatgtagcagtaggccagtagctgggcaggtgagcaatgtgacaggcagccaaagggcagggaaacctaggagttaggaaggacagcagcctgaccatataccttttgggacagcacagctgtctgatccctgaagacctcagagaggagagtgtagtgggtgacagcgaaggccccttgggagccagggagcagaaggtcacagccactgttccagatgtgagctcactgctttgtgtataagtcgtttccctgtaacagcagctggggacaccggtgagcaggcaggggacattgcttgcatggagtctcatagcacacaatggtgactctagagtgtcatgctgggacagcagcaggcatcagaccccatgctgaggagggttcagtggaggtaccaggctcagcatggcacgaggtagctgtcacactcagtcaatgttcgttgtatcatccttggtccttagtctgtatgaccttgtactcccatgccagtaagctcctgggcgctgagcttgggctaggtctacgccctgactattctgcataagcctctcctggcccaggacatctgcctcaaactcttgacattcaccataagaaagcatacaagtttaccacctttgagttagagcttgttccccgcctcagccttcttttccccgtccatagacatcgaattataaatgtaatagctgttgtctatgaaaagagcctgggcatccctccgtgtcttgctctgtgtgtctcttctccctctcctcctgttagaaccagccttgccataggggcaccaatggggcttgtcacatctttccattctcaaagcctgggcatcactcttctgtggggtagtggggtaggacttggggtggtaagtagtggacatctggcattgtaatgactatatctgtttaatgtacgatatgcctcaaaagccttgaatgtaacgaggactcacagccctgcagtcgctgatcttcttgcaaggttggagggttgggaggggggaggaagagaggagagaatgagaatatttaacatacttagagaagtttgagtattagccagctgcacatctgtaatcccagttactcaacagccaagacaggaggaatgtcagtttaaggctagcccggcaatcgaaactctatctcaaaataaaaagtgaccatttaaaaagaagactgggaatctcagtggttagaatgcctagtatgtagaaaccctgggttctatctctcactactctagtaaggggcggggaggaggaggagtatcaagtagtttagcttgggactgtcttgaaggaagttgtggtgatggtggcatgcaaatgtccacagcttgccgactgatagcctgggcagtgtactttgttaatctgtggctggctgatgccagaagttggcaaggccaccatccctgagggtcatttgtgtcccgtggggtcctccctgatatctgatgtccatctccctagcaggagactaggtgttcaggctgcatgcttagctgtggggggccagctgggggcgccacatggagcactccgactacattctaggcagataaaaataggagcgaggggaggaattttaatcaccactccgtgtctttggagccacggaggctgtttcttgtgagcctaggcagaaagccagccctgccagtgcctgagaggtgcctctctcctctgagcagcacagttgaaccagctggggaaaccagaggggctatgggcaagggtggcataagcctctgagcgtggcagaggtctcacattccagttatagtaggctctggcttggtcctggtctgtaagtgtcaggatttttacagccagagacaagtttagcctgagttgttgcagtaaacaggttaatgagttgggatttgtcaccatcctaggtggcagtgtgtgaggatgggcagggacagtgttctcagagccagagtccacccaaaacacacttaccacatttgtctagcacctaacagatgtgccaacccatagcccacagattgtccgcattcccagggagctatgtatgcagcttaacacggaatggcaaacctacttggaacaaacacagaagtgtttcttgttaacactgggttgaaatggtcaaaggtgggacacacacataatgaatgtcaggtacaattccagaacaaaaccagccgggtcctcccagagcctgctctcaagagatggtggttcacaaccttcccttcactggcctctctctctgacctccatctgggcagaaatggtggactttaggggccggaagggaggcaagatgcagccagggaggcaggtgtcttcgtcagctcccaggagacccaggatccattgcctgtgaccctcggctggtagagctggaggagctgagggctgggccttatacacttgcagagagatgtcgcctggctctggaagcagctgcctgagatcttggttctgatactcttctggggtagaatgaacttgggttcctcttccctgggggagggggttctctgactttctgtcacggaagccagtgctttggggagccttgtctgtctccatatccttagcccttggatggtgactgtttttgtctcctggcctgaatgtcccccgttgttagcctgagtgggcagttcctagcacctatggcctatggtgctcatgagtggactctgagggtagagaagcctgggggactgagaagttagagacgagggccagatggtgagctgccttggttatcccatctctgttggatatgccacagaaaagcaaccagccactggggctgttgggggctgggtaccccagatttcctggatctaggagaccatggactcctcctggcccagaagatcccagcctcgtctgccagcttctccaaccagttcaaccctttccgtctgtctgagctccagacccctcttctgggaagtaggggatcatccgaggtcttgctaagtcgggatttcattccctgggtgacacgtgcatgttcagctggccctctttctgtgggtcccacacccacccattcatcccatagaagatacacatggaaaaacaacctttgtattgagcaaggacagactcttttcttggctgttattctctaaacagagcagtgtgacagctgcttccacagctgcacttgtcggaactacgagtcatctagagatggctggaagactccaagggaggggtctaggctccgtacagataccgtgctgttttacctaagggcttccagagtcctaggatttgggtgtctttggaatcagcccccatggagcccaaggaccactatctcatccttgggaattggaaggactctgataaggctggggttttgactaaagtcactccttccccttccagtgagtgaccagggcatctgttctgtatgctctctggcctgttgggtgcctcgtgcttccttactcagtcactgtagtgacatcgggtcccctgcatgtgctcctttggtccttccaggggatgtacattgtgtggcaggcagaggagtcttactatgaagagtcatactgtatcttttgctggcctttgggggatatcttagccccagatgctacggaacttggatgggctctcagagggggtggggttgctgggcaggagccaactggttttcaggataggccatgagaatatctgagagcacctgtgaggggaggctgtggcagaagaatgggagaagtgacatttaggctcttgacaagatgatgtaaatcttgtaacagatgccacaaaatgcctggacattttgaccccactttctccctggctcctctttgacataaaaatctccatttctcagaggaggaaaataggggcagacaagtgtagtgacacttttattgccactcagctgtggagaggggctagagcccttgctgggcccacctgggcactggagcatggtctggctttgtcccagctctgacaacaggaggtggagcttgccattagtggggctgggccaagtctgcagagttcatggaagagaaagtttgctgtgcattcatttcaggagctaagtgggacaggctacttggatctaagggttctggggtggcctgagctgcaccccctcttcctggaatgtctcaatcctgtgcactcccgaagtctatacggtaccgtgttctgtgggcaccaagagtttgcttggaaagtgtgtggcacccacatctgttacctcttagggagcagaaagattgacagagacctgctggggccttgcgtgggggagactgagttcaggagtatgaggtcccagtgacaaagaggaaaatccctagcccgcgccagcgtcccccaaggccccgctttgatgtggttttccgtccctgaggccttataaggcagtgtgcctgctgcttagctcagggctgggccggctgcacaccagtgaccagaggagaagttgctcttcctggggcccagtgaggggtagaggctgggctcccaggggcagcagaggggcagtgctggaactttagaggcacatgtaggccatatgtcctgacaaactaccaagtcaggcctctgatcttagaatttggaataagtctgaggcccacagtcctggaggtcaggggagaggggcctaggtcctggatcctactaattagatagctctctgtctaggcgtcctacacaagcctcttaaggaggtgcagtggtaagggttggactctctagtatgtaagaattgtagccctggccagtcacaggactgctctgacttagttttctcatccataaagtgggtataatagcaggataccacacagtggttgtcattgagagggcagctaggattggtcagttccagcatttcaggcatttgcccatagctgcttggtggtgagcaccgaggacacaatgaacagtacctgctgattgatctttcagcacagaggtggagcacttccttgccccccagagtcactctgagacagtgtgctatggaccctgcctgtggagggagaaccaaggcaccttgggaggtagagctgaacctctgtggcttagctggtgcagtgagttgtgtttgtgctgcccgtgaccccctgattctacttccgtaccctctgctgcagcccccatggggcttgttagagcgatgagtcagagggcacagttccagcagcatccacgttcctgcaggaaccatgttcctgcttcaggtctgtggctgtgtggactgggctttcagccaggctgcagcctggaccaagcccataccacagagagcaaggagctgtgctgttctgagtcccactgggtagattggagcacttggcctctaacccaccagagctgatggccaggtcctgattcacgaatctgtctgtctgtctgtttcaagataaggtgtagcccaggctggtatcagacttacagtagagagagctctgttcggcgccttttctttgccatctgatgcttccctttttgcagtgccatgggtgagatctgggccttgcacccgctgcacgtgtagcacaagtgctgcacacgtggcagctgctatcacttcagctgctgtcagcatccttgtttgctgttccatcgccatgggatgacggtgctcatacatgcaccgtgatatttgcaaatcaatctcttcttgagagaaggacagagcaggactgttgagatggccagaggaggttatttaacacaacgtccccactgcctactgggcagggagtgtccagtgttagcccagaagccagggctctcctaaccctgggttggctcactatgccacatttccctgggtctagagaccacgaacactctatactgagaccctgagcggcccaggaagcaccaccgtgtgctagggagcatatactttgtgtgagctcagtcctctgcgggtttgctgtgcctgtcactcacggccgtgctggctggtgtacagcatcagtgcatggcttccttggctgctccgttggggtgatgtggcagtaacaccaatagaaagtcccaggacctcaaaggctcgtcattgtcagcatccttgctgtggtgctatgagggctactgaggtcagtgctgagaccactctttcctagaggacccagcgtgaagggcctttgtccccttaaagcctgctgcctgctcctattgcaagcactgcctgccagcagtttaggactgaagagatggcagcagtctctgtggcatgaaagttggactttaattggctgctggggcgtccccgccatctgatgatgccacctgtgtgtgtccctttcctgtcagtgtctgcagattccctgtcaacgctggtcctgttaacacaaacagccagattacaagcctgggaaatgttcagtgattatgataattgacaagaaggggtgtgaagaaagtcactagggttttagtaaatggggcaccagggcaggcacagccatgcttcaactaccttgaagaaggagtgtagtgcctagaatggtctagagagctacatgcaaacagagagctttttgtctctaaaacgacagttgaggctggaagccactctgttgctctaaccattgagcaacccgctctgtgcagcatccctttctgtgccttgtcaggacaagcctggatgttctttaaacatctgaagtgcagagtttgggtggtttgtattctgtggaagctttgccaatgcaaaggtttttgttgtcacaatgaggctctggtagcagctgccgtgtttgggctttttagctcttaccatttgctgggatttagaatcgtcgtcacaccaaccacattaggaaatagaatatggcgtgcccatccccgagctctttattttccaagtattttcctaatgttggcaatgtggtccttgggatgtgagccccatactgcagtatacggcaatggagattcacgtgttgctgactacagtgaaggccccgggaagtcttgcattaaaggtcttatttaactttatctaaataatcttaggcttggaaacttttggctgagtaccaaaaactagtcatttagtaagctacggtctaattctttctgtatctattcttctgggacgagtcaggatagttggagcggtcgtcccttggcgtctcagacctttccaagcctgtaggacagcaacattccctttgccagtatgacaggatctgaatggcagcttgacaaggctgtgggaaggaccccggccatgttggatcccaaatcaacagctcattgaggggatagaccaggcacgtgccaagatcagattaacgtctgggatgatggggtgtggacaagatacggaggtcctagtgaagaccactggggccacagcatgcaggcccagggcattggcgctttggccttgagggtaacagattgattagagaagagagtgcagagggccccaccttgtttggaggaagaatctagactgaggtctctctttggagccttgctgagtctgtggctgtgaagttggctggacgggaaggacaagggacactgaccttacctggcgttccagtgggggcatggaattggcctctgtaggtcctgggcagctcttcccagggtgctgtgcaccgagaagccacttgcattatcatatgactaggtcctgtctcatctgctcagccctgtgtccttaccaccacctgtgcagtctagccaggttggttcctactgcaccccacaccccccactgtcttgtaacctgctgctctgtcttccccaggaactcgtgggtgacacttctagagaggctctcggtgaggaggacgaggacgacttccccctagaaggtatgtgggtttcagtagctctgcctatgtatggcactagggtcagggaaaggcccacagagctcagagggtgtaagcaggggatgaggaacccttctcagcactcagggttacatccacaccctgtgctcaggggctatcagacttcaagaaggccatcacagggctaaccccctgttgtggtgtcagtcatagtgagtgagtatctggcctctgccctctctcctcctgttccttatgcaagaaccctcctttctccagcagaaacgccttgctgtagagctagggagagtggcacaaacccaacctctcgcctgctggtttgtttccggcagagcctgtgccttgatgcatagatgctttgcagctgcccacgtgactcagctgacctcccatgactatgaccagcaatagagagggcttcatctgcctgttactcaccatggaaggagagcctggccaacgttgagcagcccaggagagcaaggaccctgtctgccctttcagacccttggaaggaccctggacccagtacccaccaggggctctcctgccattcctagtgccatagcccaagcccacccacactagggcagggttatagctgtgcatggcaagctgccaagggcagatgcttctgagccctagttatacacctgctgggcctaggttgtgacatccctctatgctcctggccaggggaaaaaactggttcctgaatgtcatctttgtctttctgttggtcaagctcattgcctcttggctgttagagagctagctgtttaagggaggggaaggggccttgtgaggcgtgaagatgaaaaggagtctctggccatcccaggagaggagggctttggctcctgggttgttctgtaaagctacccctaatcccgagtcttagccgccttaactggccagctgggagcggagcaggagattagggctggcttggtgtgcagggctgtgagctccttttgaacttgggaaagaacaaagtaaacatcagaggttccaagctgaccacaggcctgtgtggcagggtgtggaaagcagagggaccctccttctggagatccagaagcagctaagcacaggagggccaaaccccttgtacacttctgaagtccgtgctctgagtgcgcatgagtcagtactggtgtggtgggcaggcccaggatgcatccaagggggtctttcatgggctctctgacttatgatgagtgtcccctatgcccagggtgcaccccagccttctggctcacttctgtctcagggactccaagcagtgtctctattgaccctggtgcccacttggcatctgctgcagaaacctagttttgtagaacctagcaggccattgtcccacctagtaaggctgtcaaggctaccaaagtatgacccctctcattgggccagggctccctccaggccttgcaaacagagcccactagagctttgtatctggctaaagagaagcctgagtaaaaggaagaaactctgggtgcagggcattcggttgagggtgccagcaacagtgtcaacaggccagattcccccctccccctggagttcccggagattgaaccaccaaccaaagaatatacatggagctacctagctgttggggagactggagcgggaggggaagggcttctcaaggaacggcttcagtcggttccactcccccctctagggcaggcccgtgggcaaggctagctggcagtgcctgaggtctgagggggcctctggggagcagcaggtggctgccctggctcctcttccagcttgggctccccacaagctccgcagtcacaccttagtccccagcacctctaagccctttccactgagtgaacatggcttggtgtcttcccttctgctgtccacagaagtgtcgcatggacagtggagattgtggctctgctgtgccaggggaggtttagctgtgtccccagtggccaggttagaaagctaatctccttcatggcctttcacatgggggaaggacaggggcaaagtggatggaccacagctgactcttacagctctctctttgtccagggtccctgccttctcttcaggccccagagtgtgaggaccagacactgttggtagacagttgcctcctttgcctgtttcccctttgcctgttccctctcagtcacaagtgtttctaaagcagaatcctgggacgtgggcccaggagtggcgtgtgggagggcagtgtgcatatttggaggcgagccggggaatgtttgggggctctgctggccagatcactgctgctgggaggtggccttggttccctgaaaagcagaggctcacagcacacactccttaagccaggactccgggctctttcagatgttcaaccaaacttgtttgaacttgaggctcttgaaattgaaaattctcagataggattgcctaaaaaggcctggctggatctaggaatgtagttggccacaccgtacaagcagatgcgcgcgcacacacacacacacacaccctctcaccctctccatctctttctgtcccctgtccctgaaagtctgagatgagttttggggagcatcaggaatgtctacccatgaaagggtacattagtgacactcctggcttctttcctgtcagggaggattacttggcccaacttccctctcatctaaatttgagcaatgatacaaaactccacccctaagctctctcccctttgaatgcggaatgtgtggggctgtctcaagcaaggcatggcttctgggtcatgggattctttgcagaaattctgctctcacttttataaccaggaaaactctaggcttgtgagacctgactatagtgtaatggtgtgggtagatagaggctgtgaaaaatacatcctttttctcttctcttctcttctcttctcttctcttctcttctcttctcttctcttctcttctcttctcttctcttctcttctcttctctcctctcctctcctctcctctcctctcctctcctctcctctcctctcctctcctctcctctcctctcctctcctctcctcttcttttttcttttttcttttttcttttttcttttttcttttttctaagacagagtcttgattccatagcctggtgaggttggggtggagggctcagattcacagtcctgcctggcatgacatgagtgtgccaccacatccagctttccatgtagcttctaaagcttcattcccaatgttgtgaaatgcaaatggtgacacttgtacgctgtgttagcaaggacttaatgagacaacacgtgtacctgccaacttgactggcagtgccaggctggcacatctgtgcatctctggagcctttttcctcctgaggcctgtgccaatcatgcaagaaaccatttggcctggaatgcacacacgatctttctcctcgtggccgcagatttaccctcctaattatttttggcataggctaatattaaaatccatctgcatttcccctgacagctgctcgctggaggcttggaggcccagaaacagcctggcaagccaccctcagaccagaatatttgtcacagatatctttgtgtggacagttgcaggggatcaggagcatgttagggcgtgtatccagacttcagcatggaaaccccagcttgtacccagtcttctatcgtgtctgcttggagacttgctggctctccaggtagaaaaggtgtgtgtcacactcttgatggtcatttctgcactttacctgcatctttactgccttggtcatagccgggtttacagcttcttgcttttatccaagcttgctgttaactaggctcttgtgggttgtgttaaaataagctagcattggctactgtcccctgagtttgaatttttgctctgaatttcaaccatctccttctacactaggtccccaagttgcttaagccaggactaatagcatctgtctgtcttagcttaccaatacctgtgtgtaggacgtggcacagctgggttcatgcttatgagaaccctcctctgtagagatgaatagatgcgccagccccacgcagctagcgggaccagcctccagaaagttagagttctgtctgtgcagatatggagcctgctgtgcggtaggtcatcagagggccccatctgggactgagcaggataggctgccagattgaatggaggtagaccgggtcctgccagcatggatgcatttgtaccaattacgagacacagctcagtactcctccttccacacctgcctctcatgcgtgtgagaaatgtcagaaataatacgctgcacgtatctctggtgccacacgcatgacacttctggaactgaacagtgtgcttctcaaagcctctctcccagcaacttcagatgaccccaagtgaccctagccacggggcaagagccctaggtgagcatgcacccttgcagcttcggatggagctgctgcataaggagggcccacttggcttccaagtcctcttctccccctgctgtttagatggcgccagctgtcagtgctcaggctgggtgggctgtgccaggctgctctctaggtcactgctgtttgccagggtaaacagtccccagaaagtgatggggacctctcacagcatgtgatcccagaggtgcctcctattggccctgggatgctttgggaatccaggttctaatcacagctgccccctttccctggttcccaagtctcttccctttctcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtctctatagtttctacacaggggttgagtggagcaagggagattgttcacgcctgggctacgggcaggggctaggggacagtcagcacttattgagcacttactgaatacccatcatagtatctgaccagcagtctcctcacagacccctcctgaaactgaggatgctgtctactaagaaccaatatccctgtgagggagataccacctctcctccactatacagactcttaaagctgcctaggttggaaaagtaggagcaccaaatgccactctctcccatgatgctcctgtgcagtccagctgtgtctgggggacatgctggtgacaactaaagccagggcctcagcagagctccctggttcaaggagtagcaggaggaccacctttccccaaggcctgaatggcaaagccataccttgtgccttgtctggactcatggtagcatctatggcccagtgggcactgaatagatttagtagtcggtgcttgactgtctctgagtccctggccagttactagcctggccttcctggattcagagtccgccagaggagggtgtctgaccaataggatcagacagttagggatggaatacaaagtacttggggccgatgccggtccccaggagccttgtgaggagggggccctcctggttatgtgctcctttggctttacgttgcgataacagaccactccacagtcagcatccttgaagaccttagggagctgtgtcctctctggcagcgtgggctggaggccctgcgggtcctagctgtgctgagacaggaagagagagaagagagaagctccctggggaatggactactgccccaggtctgtctgtagctgctcaagtctctgggaacctggactgttcctgtgtcttggtttttccatctagaaaatggagctaatagtagtaactgcttcaaaaggtcccagtgaagacacaattcatagcccagtgctgagggctatggggcccggtactatacgagcctgttgcccaggctgtgaacactggttccagggtaccatatgaaccgctgcagatagctgccaggaagagagttctgacctggagaatatgaactaagaaaggtggtgtgcccctccctcactgaactccccacgcccagctgttgctcttaggtgctcatcgcagtactgggatatatggatcgaatgaggtggggacagagccccagtgtccaagctgtgcctcctgtcaccaggatcctgacatcccaagacagttcagtctggtcaagccatctcaggtctcctcaactgtcctccaggcatgccagcctcttaggtcaggggccctccgccgttggtttccctacaaaatagaacaacaacaaagtcactgtacggggcgtttgaggagggaagaggtgggagcatcttctaggttagtgcactggagcttctttgtgtcatacaggaagggtcataggattcctctgggacattccattacgtggtggaagccatcacctgggctctgggtctaggatgatgggtctacacctcatactcctgctctgctcctgaagggcgggcacacagaagaccatgtcctttggcagaggggagaactccaggtgagcggaggccaagggcaagggtcagggtgattgcaatccctcaagaggccaatgcccttcagcatgtgcacataatcctgccctcagactcttcattcagttctccctccgctctacccactcagcacgtctgcatctctgagggtgccaatgtcggaataggaggcagcgaatacagaaggctgtggtccctgggaccccaaatacttctccgtgtgccctaccctgctgaagtggttggtagtctctgcaaggtactgaatctgcctataggctacttacccagcctagaaagctggggccgtaggagtctgagaggctacagagaaacctgagtaactggtgtgactgcacctcaaaggctttctccaggacggcctgtggcatcaccaggccaaagattggaaggatgtggagcatggccaataagcagggcaggaggggccagcactcttggcctgaggacacagcacagccacctgatcccgacttgttcttctctccctgtgcctccccgcagtggccctgccgcctgagaagatcgacagcctaggtagtggagatgagaagagaatggagagactgagcgaacctggccaggcctccaagaagcagctcaagtttgaagtgagtttccttctgagggctgtgacttgacggcagtgtccgggaagggggaaacggaggcccatctaaatgggaggagttctcacctcttatgtggataattgcttctgggggagacccttcctgctgcccctgagccatgacacttcagccacagcttcaccacatgagtggtggccagtacacaccaccaggaccccatgagtgcacacggggagattgaactctggtccttgggcctgttgccctcttatgggatcttccgagtcctcaaagcttccctttcacccccccagaggctgacctgggacatatggggtggggtgggggtctcctatggtatgtaagaagctaaggcaagagccctgggcagagccccagttctatctgggcctccatttacaaaccacgtgatcaacacaaggagggggggtggctatctgctcatcctcctgctcctctcaggcaccaggcgcagggtgagggctcagagtgaggtctggtgcagcggaggatgctggcatcccttgtcctcactgcttcacaccttccctgtccctccctttcagaggccacagggcacagctccactgttggcacaaagctatgaattcaggccaaggcccttcccattccagccttccctggactgtgggtatctgctgggggttctgggaccttttggtgctcccattctacagtatatagtgggttgtcttgcttggcagagctggggcttttttctttcccccggtgctaatggagccctgttgcttgccaggagaacaacagtaaaataagtatggttcctggctcctgcccttgagctgcgagcagtgtagtcaaggacagacaaaatgacatagttagccaatgcagtgtgtggtgcttatgtgcaggggtgtgtgtgtgtgtgtgtgtgtgtgtgtgtgtgtgtgtgtgttcacatcaaatacttcccaggaggggtgggcacttggcaggtgtcagattagtatgtcacagatgagggaagactggctttgaactcagcatggtccacttgagaacgagagggaagcagcttcgggctgtggccactgcaagcaggaaccccttgtctgccatgcacactccagtcagcagctcttttcccacatggtgcagaggcctgtctccatgctctgtgagccggggcatgggtgtcattccattgtccaggtcacctgggtctttgatgcctggccttgtatcgaagcgctgccctcagcagacacttgaggtgggagtatgggaactgtctccataacttcagggggcctgggaactctgaactgatgaatggccatatgacaaaggacataattattctgaggactttatgggatagaggatggatatgaccactttctgtcacttatatgagaggaaaatgaagcatcagaaacatatcccaggaggagtctgggcagactctggagtttgacctcttcatgtcccccctgctgctgcccagttcgattgctcatcctgaggtcttgccgggtgtcccaagtcattggtccctgttgccttcccaaagcttctcagccctggttgaagcttgccttgtgaggccagtctcctgtctgagtccatgcgtctcctttgtctttgaacactagagattacctgtgccctgggtcctgtatgccctgcccgggctctggcctctttccctggctgatcatgtcttagtctcccttcgccagggtcagggatagccaggggtgctcatggccttaccatggggccctctgtgatgctctggctgacagttaaacaagccacatgtctgtctgtccaggagctacagtgtgatgtctctgtggaggaggacagccggcaagagtggactttcactctatatgacttcgacaacaatggcaaagtgacccgtgaggtgagtgtacttcctgcccagtggcagccctcaggcacagggcttggccttggcctgagactgctgcagccctcaggcacagggcttggccttggcctgagtctgctgtcccctcatcctgcctgataggggcaaggctaggaaaggacttgtagtgaaaggttgttggaagggtcctggcacctcacaaagactggggctgggggtacccctccagggagaggtggaagacagtggcaaagtccaaggccttcccagagaggaccccaggttccagccatttccccctgcgtccttctctctgcagtcccaaagctctagcagccatccttgactgcctccatgagcccccaaggccacacggaacaggggcaagcagtgactacggctggtcccaggcaccctctccccattcagagtcttcccatgacccctccccaaggccccctcaccctctctatgcctctgtctctgcaccaggcggaacacttagcagggaggagagtgtcagttctccatgtgtcgctctggcaattgatggggcagaagtgagcagtggtttgggaaacggcttctcagagggacagcccatgcaaagctgacctcagccaggcaacgtgctgccctagggaggagcgcctgtgcagctgatccctggttactaaccgaaggagaccggccgtggcccctttgcagaatagatatagtaggtacttaaggccctgcaagaaacccagattccatccgggtgccaggaaagcctagcccggctcaggcttagacctttcctatgcctctccaggaggcctgcattatggggtgaggcctactagagatggtatttggcacctgtgtggagatagaagaccaggtgggtgggctttgtgtcctcttgtagcccagcatgtggacctgccagtgactccagaggtattggtgcttggcctctgtatctccttatcctgtccagggtgggacaagtattaggttttccacagcatagataggaagtcatctttacgtacttggagggagatctggcttacaaagcatgcatctgtcgcaggctgtaacttgggggacatgagaaaccagtaggaggaggagcctgtgctacagtcatagttcaccccgtcctaggcaacaacaagagcaatgcgttgttggctcatgcctctctgagtttcagttctgggaggcttacttcaagtgtggctgaatccagaggctcagtatgtgcaagcaggcccaagccttacccatggatggtccctctccgatctcttccttctgtgcagactctttatggcactgtcagctctagcccagatccctccctctcaggattccctcccattcagaatttccatacacggtccagagccaaatctcattggcttcctggccagccagcctgaatgtcacaggacatacaggaccatctgtggcatctttgtcacgagagccacagtgaaaatggccagccctgggtggctgccctcttcctttcttcccagctcagagatgcttaggggcgtcctgtgtgtatcccctactacaaagtccttgcaagaagagacatggacagacactcatatctcttttgccacttgtgtccttggtgatgagaggaaggagccaaaggaaggagccaaaggctgcccatgggaggtgggtccatgtggcctgaagtgaacatttgcattgtgttttctttctgaagatctgagatcctggttgagttaaggcccctgtctggtgggtctcctcatctctacccacaaataccttttttaaacctgcagtacctacctctccctctcttcttcgtagtgtgagtatacatgttttggtgtgctcaggaatacaggtttctaccttaactgcatctgctgtctggagcccatgtctgggctaatcctccaggtctgaacttgtgaacctgagctctcaatcacataggaagcagttgtgatggtcacctgtgtcagtcagctttctgtcactgtagcaaatactgagctgttcaacttacagagagaacaggcttactccagttcgtgatcagttgtttctgttgttttgggcccatggcaagtcagcataatctggcagctgtgcatgacaaagcaaaacctaaccctaatcctaaccctaacctggaaaggaggccagaaagaagagcggactaggtcccacagtccccgttgggaacatgcctccagtgacctaaaggcccaccacaagggccttttaaagtgcattccctaaaagctcccaatagctaccccaagaccacacctttcttgcgttggtttagaaacaaactgtagcagcccccatttctgtgccagatggtagcaaagcgcctcttcagctcctgagctatacagcacttgaagaatgttgtcagtggccctcagtctccttgtttgtcacctccatcatgatgatgtcaccatcatctcctgaagaaggagcagttctgagaatggatggcatggctctgcagggagccctgggaagaacggggagaaaaggactcctgtatagtctcaccaggaggaactgagacagctgagtgagtgggggtgaatagtggcggctgggtctcaaactgctgccctccacaatctctctccacatctcatggtctagtctttcagaggctaaaacctaaattagtagtcagcattgatggtttggaatatttttcagaagactctggctttctgggtcccccgagtggcctcatcctgtagagtcagcctagagcaatgtccaccgtgtttcacaggtacacctgtcccccaccccaccatagaccccacatacgttttacccatcacacatcagcctggctatggcatagctgcggtcacctctgcctcagctgagggaaggtagaggaggggcccagtatgtcagaattcacgaagaattgctggccaagataactgttgagtgtgcctagtgatacagtgtttttttttttttttttttttttttaaggaagtggctgcccctcagacagctgactacagatagagacccagagcacaggagtcctagtaagggtgcttgtaaccccttccccagtcagaagtctctgaggctcctcagagaacactgctggaggccccatttcagtttaataggtaataggcccagatgacacacttggtcaggttctcacagaccagtttgtcttcagtgccgcttatgtcacactaccaaggcggagggacttccatcatagaaagtgacctccttcacatcctggagactggaatttagggctgaggtatcagcctgcatggttctggtgagaactcccttcctagtcagtggacagctgccttctcccagggagagagcaagtgagttccaggagccacagaacagcagcacctgttcccacacgcccctcctccgtcaccatcagcaaccttcctctctccattgctcactgaatcctgctatggtgtccatggggatgcctgcacaggaatgcaggggcatagtccagtcaagtgtaaggacataatcacatttctatttctccctctaagagcacggtatgtagcttccctgggagcctctcgcctaggagggttgagaactggtttgtaaactcttcccttacctggataaggctatctagggaggttccacatagcctgttaagggcccaggggctcacaagccaccctgaattcatgagtttacctcttctgcccccggctcttcattccttcttcctggggctttttccccacgcccaccatcttgcctccagctctctttgaaggagctgggccttcagcacagcagtggtccccagctctcaggttgctgatggcagggcatcgtggctaaagtcttcggggtgtctgcttcctcccaaacaggacattaccagcttgctgcataccatctatgaagtggttgactcctctgtgaaccattcccccacatcaagcaagacactgcgggtgaagctcaccgtggctcctgacgggagccagagtaagaggagcgtccttttcaaccataccggtaagaggggcggagcagtgcccactatgggaaagacagggaggatctaagtcagcctgggagggtggggagagacccagctaccatagacagttgcttggtgttggtgtactgcaaggcttcagcaaacccttgaaggactaggcctctggggagggagaggggacggaatcacagatggaagaaggcccagtgtaagcaaaggcatagagttgagactggagaggatgcaggccaggcttaggagggcagcttatgaatctggagaggtgtgtgggacaggcaactagtttgctccttgctgggcaaccctgctgcagagctgttgtgaactactttgagtggcttttgagcacacaatgccaggaagccctggccgagttggaggaggcactgacgagtctctcttggacttctgggactcagatctgcagagcacaaggccccgagcagacaccaaacccgctgaggagctgcgtggctgggagaagaagcagcgagccccactcaggtatgacatgctgtgtgcccgtgaacatgcattgagcgccagctggatatgtacatctgaaggactttgagtagcaggttccatcctgggtcctctgcaggggccatggatttatttcagaaagcacagatttacaaatcagactctaaatttacaaacaaaacaggaaaaaaaaatcaaaaccctagatatagctcatcactgtattccatataaaaattctttagattttctccatgtggtttggattcagcatgtattgggtaattcctgatgtatttccactgtagatagttagggtagcaccttgggggtctaacacactgggatttctgctggggagtatgtgcataagccatcacagcagagggacaaaacttccaagcctcctgtcccttaagatggcctggctgttcagtgggctatgggaaacctccatttgcaggttgctctcagaattgtgagtaagagcttatagatctgcagttatctgtcccgttgtcacttctgcatacacagagggaaggagggatgtttaaagaaaagcacctaacagcagcagcagggcagcaagcaagcgtagggatcttcaacatctgtgccaaagaaggcgtggccagagatcggctagtccttcatgtgagcgtggataagacagaccatgctaagtgggcagtgggcaggctggctggagatgggtggggctgggggcattgaacagaccttgcagtggtgaggcagatggtggtgggcactggggaaatgaaggcacagacaggattctgcctcagacgcccttctcccaagtcacaggaaacgtgaagaagtgatgaagctgccggtttggcctcatggcttcccagcaggcctcagggtctgtgccttcctacataatgtcctttttgtcacaggttccagggtgacagccacctggagcagccagactgctaccaccattgcgtggatgagaacattgagaggagaaaccactacctagacctggcggggatagagaactacacgtctcagtttggaccgggtaaggggctgctgtgtgggccatagtctggacacacagtgctgggtagtagccactgatccctgaggactggggagataggtagctttctactggacaggtcagaggctcgtctcagagcccctaaccaagcactgaagacattttcaaaaatcaaagtaatacttagataaagctgggcaaaaatccaagagcaagagaagactgagagtccagcaaaagcagtagccccgctcaagccagcccagccccgggcccacatcagccccagccccagccccagccccagccccagccccagccccagccccagccccagccccagccccagccccagccccagccccagccccagcggctgcttggtccaggaatgtgctgctctgccagcctctgtgccccctgaccttgtgccagtcctgcttcctcttaatgttgagctctctctgagttcaccctgcatttccctttatctatttagaaggctctgcccacctcctttagtcccttccttctctctcctcacctctcagcagatgggaacatgtttctccctacaggactgtgagggcattagagggctggtagctcagacagagagtcgatggtccctggtaacccagggtagcccagtgcacacagtgggtgctcatgaagtatctgtcggattggttcctaggatccccttcggtggcccagaagtcagagctgccccctcgaatctccaaccccactcgctctcgctcccacgagccagaagctgcccacatcccacaccggaggccccaaggtgtggacccaggctccttccacctccttgacaccccatttgccaaggcatcagagctccagcaacggctccggggcactcaggatgggagcaagcactttgtgaggtcccccaaggcccagggcaagaacatgggtatgggccacggggccagaggtgcaagaagcaagcctccactggtacccaccacccatactgtctccccctctgcccatctggccaccagcccagcccttctccccaccctggcacccctggggcacaagaaacacaagcatcgagccaaggagagccaggcgagctgccggggcctgcagggccccctggctgcaggaggctccaccgtcatggggcgggagcaggtgagggagctgcctgccgtggtggtgtacgagagccaggctgggcaggccgtccagagacacgaacaccatcaccaccacgaacatcaccaccattatcaccacttctatcagccctagaccccagcaggctgccacgggaaggacccagcccacaccctaaggcattattattctattaattattgttattatggcaattattgttattaataattattgttactccactaatatttagccagccttcatgtagaagacacatggaaacacagaagtaaacttttatttatacgttgtggggatcatgtaactcaccaagaagtgactctgggtttggagggtccttgggacaccccagctgcagggtctacacaggtctccccaaaccacaggagccctgggctcaacccccccacttcagttcttccaggagagcacccttgcctaatccagcttcggagaccctcaagagccccagaggacaacagctgctacctctcagtgttatctggttcaactttgcccttaattgattgtaacacgctacaggagatttcagtggactgccattgcaccctctctccccttgtgttctgacacctcaacctagacaccttagctgtgtttccgggagttaccgcctcccctatctaaagggaactagcccttggcccaagccagccctgtgctttcttttgtcctttgccatgcacagtgtggaagcgccctctcttcctgtgcccccgttggctttggaaggatgcacctgtgtttaaggattgtccttgtagccagccttctcagtttgggaacaactacagagagaagcagccacattaaaaaaaaaaaaaaaaagtagtgtggtttcccaagatggcaccattgtgtgacggagggtgtgaaacctgagtttgccgtcagcaaatggtttgtggctctctagccgcctttgtagctaggtagatgctgcctgtccatgtctctgtatctttctataaatacactctcaggtatcctttctggtgtgcagaatcactgccctgctctatggaagctcctgcaacccagatgtacccgtgtggttcccaaaggctgcccatccatcagatgaaaacagccacctccgtctcacttcctggggtctgaagtctgtggttttggagagacctgcttgggtagagagacttagggtggaatgggggtagccactgagcagcatccttgacagaataggtttttatcagacaagggtccaggggaccaaaaaaggtttactgtcaaatagttggggccccaacaaaactcagattacactcccaggtttaattatttgaggagggctcaacggggattgctgccaacactggagcaaagactgggaggcagcagaacccagaccatcactgagctaccactgtacctagctccatacatgaagggtgaagatcgagaggcagccatggcattcattcagagagcatagcaggctgtgtgaatgaatgaatgaatgaatgaatgaatgaataaatgaatttatccaggggatgaatgcccctattccctcccatgcctgtttcacatccttctctagtagcctcagctgaaggccttgagagggggtgggacttttattcttgagggtccagaaagagtctgaccgcagaaggaagtctgcccgcctgcctgcctgtctcctgagtttagcacggttggtaagcatgcactttgcagatagtgagcattcgttgttttcatggtgttaattttcctgattgctggtgtgcctgagtctggttggtgccatcctcaggacatcactgtgacgaagtaggagtcctgggaatgtgtctgaggcacagagaggtcaagaacctgtttgacacacatggcagatggcagtgctgggtcctagccttcagggtccctaacactgaaggatatgagccctaagttttcctccggggaagctgtgtttctatttggctagattccaactcagaggggacactgccacctaccatgtgactgcaaccacaccaaatgggcaaggcattgtgggagcttggcttgagatgataggatctggtatgaatgaagtagtttttgtccttgagtcaccctgtgtccacaggcctgagcaactgacattctgggtccaggaccaggaggaaagaatttctgggagacaagagcttgatgagggaattgtgattgactgggcttggggaaggtagtcacccctggaccagttacacagatcatctggtatgtgaccacctgcctcaggaggcaaggtcaccgcaatgaggacagggataggggaacccgcaaacacaaacaaaaaccaatggcctccagggccacaattgccatgggcagctgcctagggagtggaagccactggttttagaacacagatcctcagcctggggaaggaggtcccctgctgctttaggatttttgttaacttcttgctctaactcttaaaagtcacttataaaaatagtaccacgtgttcacctgtaagagatcaaggtagcgcataaaggcttagagtcaaaggtaagtcagcaggctccatctcacatgctcagtctccagaaacccaccccagcatccatccatgtccagatgccctccccccatcctcccctccaggaccatgagcgtggtgtagcggttgtaacacagactggtgtctggccatgggtgctccaggcctgactccccttcctcaaagcatgcactgcaagtgaggtgctgtgccttggtttcccccttgtgagtcctccccagatgttagttgtcttcattcccggaataaaagcatttttatagaatatctcccatttaaatgttttaatctaaaaagctttcccccccccaacacagtaggaaacaattgtgtgacggcaaccttgcgctcacccacccagaaggtttcagatgctgacactgtgctgtttctttctgatctatttttaagagagaaaaccctgcagatacgcgcaagcccctccccaccctgctcttttatttttacccaacgaccagcttcgtgttcattcttgggttctttctctgcatcccagtgtacttggggaccccctccccagtcactgaactccgctcgcctagcagctgctcagcccactcttgctcagagacactgtcatctcctggcaggcctctggctcatcttctcatcatttgctgggacacactgcatagaaggtccttgtatgtaactcatctcgctgtctactcacaagacagaaagcaagagaaggaaggtgccggccgtcacagaactgctggtttcaagagcaagtgtttgtttcccgttttgaagctattgtgagtgaccccgtaaaagcaggggtagcaaataattagaaggagcatgaagaagaaagaaaagagagggaggaagctaaaagaaacagggttggatcctgtgtgtagatgtgacccagttcctgggctctgagcacgcagcctccctggggcctggagaagtgttagtagttctgtggatttaaggcatcatggtcttgcagctttgggcacacatgtgcacagcactagctgcttggtggaggatggatatccactgtgctctcacctcctcattctggggagcatcacacacccagccatgctaattagacattttggcaaagggaaatagccaggacctgtttggctttctcctttcccaggcaggcagtcacctctcagattgctactgggcctgaagatcagcaaccagagaattgggaagtgggctacctgtccaatgccatactagtgagcagtccccactactcctgacctgccaggaatgcttgactatggatgctacccagggccctcagctccctgtaaaggtcagggctgccagcctcatgactggcaccaagggaccgcacaccccggattctccaagacaagcttgcccttagcccaggctcactcttgcaacctgtctcctggtgctgcccttgacgccagctcttcttaggagcccgtgctctagaatgtttttcctgacaaatactttcctttgaagggcttccaatgcccagcatctgttcccaaggaggaagtggctgagtctagcctgttcggctgacccgccgggcagtttgctctccccgcagccttccaagcaatagaagaagcaatcctgctgctacagagtccatcagcctggcagctacgagtcactcactcaggcctacgtcgctcccgatgtgacttgggcataggccagcctgtcgatgtgtggaagcctcattcagaatcacccagagatggtttcacaggccaggattttggtcccaccttttatgatgctgatttgggggtcgggatgaagcctgagcattacaaacgcaagatccgagatggtatcctacacaggcaaggccatactctggagccttgcaccatcccctagatgacttcagaaggccctttgagagagatacctgagttctaggactggagaagcatgttaatagactcttaggcccgtccaggattaggggcataggtggcttagggttagggtatagggatagtggttcttaacaagctcccaccttgagatggtggtgtatctggcccacaggtcagtccaaaaaccccagaagcctgtgcctcaaggagcatgcgtactggggtaggaggggagcaagaacagaaccccctggccctgctccaacaggggccccaaaactccacagaaatcagaacaaatgactataacttcagcagaggaccagagggggctctgcacctccatttgtataagccaagtttctctcctcgctgtgctgccattggctctgagtaacccacccatactccattatcacaaaaccatggactttacagagaactgggctaactgagatgcagtggccccagttggtccacatgacattgacatggacagtctttgccctttgtcactcgagattagatctggcgttaataagatgtgtgtgcagtcttaaaaccccctcatcctgatttctgcacttggccatgggacccgggaccaatgttagctctgcagcctagaactcagtgtgactgctactttgtttccaagtctatggctgctcggtcactcactgtgagagcctgctttgggaatcacatttgggcagacccctctctacagttagaaaggtagatggggaagccatttggggtttagttctcagagtgagaaacagagaagaaggtcaaagaccttagaggcccacagcactgaaagggttacactccccttcaccagagtactgatgcccggtgtcactaacatcactcttctcttggtatttctgaaagcagaattcgggtgtgttctatcaaagctgacccccaaacctgttcatcctttttgagccaggctgctcttcctggagccttagcaagtccagcagaaggcagtgagcagtgtgagcctcagaacctggtcctgagtgtcgtgtcctgtctgcagaccctgaaagcggagcacctcctgaagtggggttcttcagggcccagtgtgcagtaggaggttaatagacaggagcgtgagcgtggtgtggagaaagatgagacagagacagagtcagaaacagagagacacagagggaagactcctgctgcaggacaatggcctcgctgagccgtggcatcctccctcactggggcctcaggaataaaagtgggcacagcaacagcattgctattttttttattgtgttttctaaaacatgcttaggatgtagctcagtagtagagctcttgcttagcctaatgcaaggccctgggtttaatctctagaacaacaacaaaaagccaataaaacaaaacaacaaaagcaatgatttagtttatttaaaaagaaacaaaccaccattgtgttgtcttcttctttttttccctgtttggttggttgccccacccctctcccttaaccttgggaaccagtaaaaatccagtcaagtattctttgtgtttttgaacatgcaattgcgattgggtaagaaagatctttccaccatagcaacaggagaacagcgactccagtaggcagacttaaccagattgacactcgtccccagaagccaaccccagaacacctcaagacctttttcctaccaaaggcactcattgactatataaaaaagcacatttgttccagtgtctggaacctggggaggggcctggtcaggactatagaagctaaggtggccttgctggtgttgataagacctagtcaatgccacgctggtgatgatcaggccatgtcagtggaccctagaccgcatactcatgtagtacacggcagagggtggatagaacagacatgggcccaggcttcccaagctctgcctctctctccctctcccactctgcctactcagctcttatgctaacccccaatggctggggcagacctacaaagatccagcatacctcctttgggggtttcaaagactttgaatgaatgtccaaaatctaaagttttcacctaaaaaatatcaaggcttctagcttacttggttggttggttggttggtttttgtctttccataaggatccaaaaaagtcaagatcaaattcctccttgaagcaatctaaagaagctgagtagcgtctggccctttaagtagagatcaggcctcctaggactcggggggggcctgtcagctggcttcaagccttctcagcctggcccagacacctccgagctcttgggacattttctctcacactgagcctccctggtcctaaggagtgacagacagctctaagcccacagaggtggagagcactggagagtcgaagcctctgggacccttcttcagggaaatagtacccttcgtaagctttcaactgcatggtcagcaggcattgatcaagactaaccaggaccatcctctgtgggccaccacgactctcacaatccagacaactagaagagaaagttctggaaacacttcagcctccccaggggcccccagctcatgaatcttgtggttccttctttcccagtgctgatcatgtttatggctagcctgcgctcattcacctctgccgttagcccaccaagttgccttgagcagtaagtactcaacttgtgagtgctgatctgctgcttttgggacaacagagggtgaggttcctgccagcctgtcacagtactggcagcatccagtccaagcacgttactctgtatagtcactgctcacagacactcgtttcatggatagtgacattcacagcttggctataacaccacacctccagcctgtgcttaggaaccaggcacggtcctgctctagggccaaggaccattttaaacagcaaaatccccagtgtggagcaaaacccaggaagaaactgcgacaagaacttgggtttatgagatgcaagccggaatcagagaacagggcatcaccctgttcagcaccagctgggcatgagcaccaggaaacttggtttcactactttcttgtgttcatgaatgaccacgaaaacaccatagatcttaacgctggggttgcacatgaagctctacgggttgctggaagcacagttcagcacctgtgaaggatggaacgctctgttcctacctgtttgtgccaattatgtggtttccaccaaatctcccatctgttcgccagagatcaagggcccagctgagtactagtaaaaaacctgtaaaaggactaaaggattctcacttctaggctcttgcatagcctccaggcagatccagcatgtagcctaatgtcagtctgagaagtgtttttgctaattggctttaggggcacatatgggcagtgccattgctgtcactgctacccagaccctgtctgcttccaggcagttggcacaggctgaaaactaggactctggtgtggatgttttggggtgcagaagagaggaacagtagcctcgatgttagcttgtaggatcttagcagggtccatgttgtaggggccctggaagaccccaccaagtcctgtgttgggattaggggagagagactggctgtcctagctgaggtcacttgccccacatcccctaacactgacctcaaagtacagcatctgattgtgatatggttcgtcctaagactctcggtccaaccatccctttctctgttccttctctgagcactggtttgtgcatgtcctgactttcttattgctgtttacttataacctatcagtctgtggttataaggagtggccaaacttgagcttttttttttttttaaagatttatttatttattatatgtaagtacattgtagctgtcttcagacactccagaagagggagtcagatctccttacggatggttgtgagccaccatgtggttgctgggatttgaactctggaccttcggaagagcagtcgggtgctctaacccactgagccatctcaccagccccaaacttgagcttttggtgcaagatttgggcagaagaaagactcccaaatttgggcttcagtgctcagagatggccatctcagattcagctggccattccctgggccatacccataccacatttatctccagagtcctctgtccatatactttttaactatgtagtaatcgacaggtgagtcagaaagagtgcttgtgtcaatcaaaaaatgctcatatcagacaaaacagactccatattgatgggatttcgcagagctcatgggctagtagggataggggcaggtgtcacatggttgcataggtacattctggaatatcttccatgggaacatggaaggataacaaagcacataacagactaagggagggagagcattccttagaaccatgtgtaggtaggtaagactgcaagactgatgaagaattacccaggcagaaacccagccaagaccctggcttgataaaagagagggtgagacattgaatgggatcagtgttggcaagggagccagctagagctggtaggatctggaaatggggtgtgatgaatggtgtcctctttaatttaagagacataaaaaattggaaggtcagtaggccaagacagcacatgtccactggcaatacacgtggaagtattggaaactgccctggacaggcaaggcacatggcgactcaacaccctctactgtggatatctgtgacatgcttccccgtgaaggtactcagggtatacttatctgtttccatcctgggcctgtgctactgctcctgatctcaaaccacatctctttaagtgtaggaagaaaacataaagatgtagatgagtctaagcaagatggaggcagagaggttgtcttagtgagagtttctgttgcttcgacaaaacaccatgaccaaaaagcaaggcgaggaggaaagggatttttggcttacatttccaaatcatagaccatcgttggaggaagtcatccaggaactcaagcagggctggaacctggaggaaagagctgatgcaaaggccatggagaggtgctgcttactgtcttgctatgcttgaccaaagcgttcttcataagtgtgaaccacagggcaacctctgttagacttgggggtgggggtggggatttcttttgttggtgcagttaatctaaatccttttacattagcctcagacagactccagacaagggcaaaacataaccacattcttcaccaaaatatcacaagaatgatatgtaggcaacatactaaaattcttctcacctgaaacctcttgagccaaaccccatgggtcaaatcaccctcagtatagctgtcttccatgttactgttaggatgacccattaagcatgggattaaagcatttcattgctttcttaatacaaagtcccaaaatccacactcctccaaacaaaagcacagtcaggcctatcacagcaataccccactcctggtaccaacttctgtcttagggttttattgctgtgaagagacaccatgacctaggaaactcctataaaggcaaacatttaattagggctggtttacagtttcagaggttcagttcactatcattatggtgggaagtatggcatcgtgcaggcaaacttggagctggaggagacaagagttctacatcttgatccgaaggcagccaggaggagactactgtgtttcacactaggcagagcctgagcacatatattacctcaaacctgcctccatagtgacacactttctctaacaaggccacacctaatagtgccactctccatgggccaagcattcaagcctatcagtctatgggggccatacctgttcaaaccaccacagtcggggctacagagagaaggaagagtatagagaaggttaaataaaattaggggtgtatgaaaaagctggtaaaaactcattgctttgtaagaacattaaaaataaatcgtttgaaaaaggagtttgaacagaggtactctgtatgagtggttaatgccattcccagaagccataatttttttaagtgagaatcccagtgccatgtttggggctacctggagatgcctaaaatacagctattgccatggcttctagttgctttcataactggatactaagaccctacagctgaagacacagatgctttagattcagggctggcgagatggctcagtgggtaagagcactgactgctcttccaaaggtccagagttcaaatctcagcaaccacatggtggctcacaaccacccgtaatgagatctgatgccctcttctggtacatctgaagtcaactacagtgtacttatgtataataataaataaatctttgggctggagcaagcagaagtcctaaaattcaattcccaacaaccacatgaaggctcacaaccatcagtacagctacagtatgctcacatagataaaataaatcttttttaaaaaaatgctttagattcgagacatagagaagtcaaactggaactgacctcctgcaaatttcttccctggtgatttgctttcacagggccagcggtgctcttcagactacttagggagagaaatcatcaatattacccagcatcaaaccctgaatatttcaatactgaccttgcaggaagatgtgcctaccagcacaacaatgtcctgaagttacagggatagccaactgtcttttgcttacctttgaggcctgctctgcaggagagaattcatgtctggcactgtaaacccatggaaagcccatggctgagggtgtcatcagccctggggtgggggcaggacgaccctactactgatgatgctaaatgaacacactgtcaaagcgtcttccctgctctcaaaagccagggaagctccgttttgccggggtcagctgtgaatgtggactcataattggttagtgccgaaaataagtgactgttgagtgtttatccctaaataggacatctgcattgaatccctgcccctaaggctcaagaaacatttcagaagaggggacaagaaaaaaggtgttaagaacagaggagaggaatgagcactgtgagatgctgtcttctggacatgttgcagccactgtgagaggctgtgcttacctgc

SEQ ID NO: 176 - DNA, 2807 bp, Mus musculus
gtgacagctttgctgtaagcgctgcttgggcaaggaaaggcatcgaggagtggatcgggaggcagcgctgtccaggcagcgtctcaggaccccgtcagctgagattggcaggcactgttggtcgaggcactcgggaactcgtgggtgacacttctagagaggctctcggtgaggaggacgaggacgacttccccctagaagtggccctgccgcctgagaagatcgacagcctaggtagtggagatgagaagagaatggagagactgagcgaacctggccaggcctccaagaagcagctcaagtttgaagagctacagtgtgatgtctctgtggaggaggacagccggcaagagtggactttcactctatatgacttcgacaacaatggcaaagtgacccgtgaggacattaccagcttgctgcataccatctatgaagtggttgactcctctgtgaaccattcccccacatcaagcaagacactgcgggtgaagctcaccgtggctcctgacgggagccagagtaagaggagcgtccttttcaaccataccgatctgcagagcacaaggccccgagcagacaccaaacccgctgaggagctgcgtggctgggagaagaagcagcgagccccactcaggttccagggtgacagccacctggagcagccagactgctaccaccattgcgtggatgagaacattgagaggagaaaccactacctagacctggcggggatagagaactacacgtctcagtttggaccgggatccccttcggtggcccagaagtcagagctgccccctcgaatctccaaccccactcgctctcgctcccacgagccagaagctgcccacatcccacaccggaggccccaaggtgtggacccaggctccttccacctccttgacaccccatttgccaaggcatcagagctccagcaacggctccggggcactcaggatgggagcaagcactttgtgaggtcccccaaggcccagggcaagaacatgggtatgggccacggggccagaggtgcaagaagcaagcctccactggtacccaccacccatactgtctccccctctgcccatctggccaccagcccagcccttctccccaccctggcacccctggggcacaagaaacacaagcatcgagccaaggagagccaggcgagctgccggggcctgcagggccccctggctgcaggaggctccaccgtcatggggcgggagcaggtgagggagctgcctgccgtggtggtgtacgagagccaggctgggcaggccgtccagagacacgaacaccatcaccaccacgaacatcaccaccattatcaccacttctatcagccctagaccccagcaggctgccacgggaaggacccagcccacaccctaaggcattattattctattaattattgttattatggcaattattgttattaataattattgttactccactaatatttagccagccttcatgtagaagacacatggaaacacagaagtaaacttttatttatacgttgtggggatcatgtaactcaccaagaagtgactctgggtttggagggtccttgggacaccccagctgcagggtctacacaggtctccccaaaccacaggagccctgggctcaacccccccacttcagttcttccaggagagcacccttgcctaatccagcttcggagaccctcaagagccccagaggacaacagctgctacctctcagtgttatctggttcaactttgcccttaattgattgtaacacgctacaggagatttcagtggactgccattgcaccctctctccccttgtgttctgacacctcaacctagacaccttagctgtgtttccgggagttaccgcctcccctatctaaagggaactagcccttggcccaagccagccctgtgctttcttttgtcctttgccatgcacagtgtggaagcgccctctcttcctgtgcccccgttggctttggaaggatgcacctgtgtttaaggattgtccttgtagccagccttctcagtttgggaacaactacagagagaagcagccacattaaaaaaaaaaaaaaaaagtagtgtggtttcccaagatggcaccattgtgtgacggagggtgtgaaacctgagtttgccgtcagcaaatggtttgtggctctctagccgcctttgtagctaggtagatgctgcctgtccatgtctctgtatctttctataaatacactctcaggtatcctttctggtgtgcagaatcactgccctgctctatggaagctcctgcaacccagatgtacccgtgtggttcccaaaggctgcccatccatcagatgaaaacagccacctccgtctcacttcctggggtctgaagtctgtggttttggagagacctgcttgggtagagagacttagggtggaatgggggtagccactgagcagcatccttgacagaataggtttttatcagacaagggtccaggggaccaaaaaaggtttactgtcaaatagttggggccccaacaaaactcagattacactcccaggtttaattatttgaggagggctcaacggggattgctgccaacactggagcaaagactgggaggcagcagaacccagaccatcactgagctaccactgtacctagctccatacatgaagggtgaagatcgagaggcagccatggcattcattcagagagcatagcaggctgtgtgaatgaatgaatgaatgaatgaatgaatgaataaatgaatttatccaggggatgaatgcccctattccctccc

SEQ ID NO: 177 - protein, 451 aa, Mus musculus
DSFAVSAAWARKGIEEWIGRQRCPGSVSGPRQLRLAGTVGRGTRELVGDTSREALGEEDEDDFPLEVALPPEKIDSLGSGDEKRMERLSEPGQASKKQLKFEELQCDVSVEEDSRQEWTFTLYDFDNNGKVTREDITSLLHTIYEVVDSSVNHSPTSSKTLRVKLTVAPDGSQSKRSVLFNHTDLQSTRPRADTKPAEELRGWEKKQRAPLRFQGDSHLEQPDCYHHCVDENIERRNHYLDLAGIENYTSQFGPGSPSVAQKSELPPRISNPTRSRSHEPEAAHIPHRRPQGVDPGSFHLLDTPFAKASELQQRLRGTQDGSKHFVRSPKAQGKNMGMGHGARGARSKPPLVPTTHTVSPSAHLATSPALLPTLAPLGHKKHKHRAKESQASCRGLQGPLAAGGSTVMGREQVRELPAVVVYESQAGQAVQRHEHHHHHEHHHHYHHFYQP

SEQ ID NO: 178 - DNA, 106315 bp, Homo sapiens
  misc_feature (1)...(106315): n = A,T,C or G
gtagagttcagtttctcatacttctgtctctctgagtggacttgagggcaggcagaggccctgtctaactcattcctgcatccccagcgcccagcgctgtccttgcacgtgggagggactaggcacccatttgctaagggaccagagaaatcatgctggaggcagagaggggatttggggaacactggggcagcaggccccagtccggcatccccaccccaccttttccctcttggagacagcctggtctgagttatttcccttcccgacacttccctgcctccagggcacattttctccaggtgagtccacccaggcagagggcgaagccagcaggcacaggctggattcctgcagaggcgcgcatttcatttggcctgcaccatggcttcacatttttaaaattagttgccgatattttacaatttggagatttcacctagaaacctggatttccagctattcttgaaaaatcaaaagatctagcagccctgggcctgcagctggcagctggtgtgcagcagccactgttcctttgtgttgggtatatgctgctcagtttgccaccagatccacctggtccaagtccccctcccttatgactcctgcccttcccctggtgaacctgcaacccctggctctatggagcgcccgggccatcccactaacctcacaggtcttggtttggcaaatcatgaccgtgccagggtctttgcctgtggaacgaggatctgtgggggtgccttccaaatgtgccaaccaatgctcacgaccaagccttcagtgtaacgatctgcccactttctcctcctccccctgcctccgtgagccagcgaagctgctgccctgtttggggacacaaacatacacacgttattagaacctcagatcaaaggcggcgtcctacagcctgcctctcaatggtccctttgtgcaggcggaagcctgcaagagagttagaatccagggagaacaggaggggctggagggggggctcaaaacaaagatacttgtcaccctgagaagtccgcagaaatgatgttaaaagaggcgccaggtggaggatgtaccccggctcgctgctggaagatgcaaatggagaattctcagttctgcagaggagaagaaaacacccctgtcccttgtggtttcagaggaaggggtgacagtggctgcccaccccctccgccagcagcagcctgcgtctgccttcctggcctcgccaggggtggatgtgatactggcaagggcttcttggaacgaaaaggtgacagtgaccttgtcttgggcacagagtcagaagaaacaaaatgatgtggggggggggcctggggaaggccaggggaagccgtgggggcagcgtcacctctggccagatgggcctgtgtgttcagcccttcaggcctacagcaaagcatttcaaaagcccctactgtgtgccagccacagtgtgatgcgaggcaggagcagagaggattaacttggggtcaggacctcagcggaggcagagagggcgacgctgttctaaccagggcatcagagagagctagcatctgctgaggtcccctcggctggatgccctacgcattttacacacattgtctcatttatctctagggttggtttgaacaaagaagtgctttgagagttcagatgtggagccaggaaccctgcctgccatgggatgcagggagagggggtggcgagcaggtatggaagagagggttttctaggaggggaacagaagccaagaggccgccgtggtgctgggatgcgcaggaggcaggcggaattcaccggtgtctgcggcctgcgacacttgcagacctctcatctttgcaaggccatggggctctctccttggccctcttctgttctctgtccacagtcattccccagggcatcacatccagtgttgggctttcaattccatctgcctgcttatgatgcctgggcacatatctgcagcctgcagcttgcttctgtactctgggctcatagatccaactggccactcaatctcactgccaggacactcaacggtcgtctcaaaacaacgtgccaaatggagctcctcttcttccttgcctggcagaccagctccacccgcaggcttcctcattgcagttcatggcagctccatccttggagttgcttaggccccgcatcttggcggcttccttagtttctctgtttctctcccactccacgtccaatacatttgctaatgctgttgcctctaatttcaaaatacattcagcgtccaacttcttttacctcctccactgccatcacctggtctaagtcgccatcatctcaggcctggcgccccaccatagccctgtgacccacacttattctcaacacagcagcccagttgctctggttactactctctctttttttgagacagggtctcactctgttgcccaggcttgagtgcagtggtgcagtctcagctcactgcaacctctgcctcctgggctccagcaatcctcccacctcagcctccctagtagcttggaatacagacatgcatcaccatacctggctactttttaaaattattttttgtggagacaggattttgtcatgttacccaggctggcctcaatcttctggttgcaagggatcaacccacctcagcttcccaaagtgctgggattacaggcatgagccaccatgcccagccacaactctcttctagtaactcctgtctttctccaggaaagctgaagtttttgatgagacctataagggtctcatgatctgtccccgtcacctccaacctcatcttctccccaatactcccaaactgtggtctctctgctccagagccaggggcctctttgctgtttccaaaacattcctggcatatccttacctcaggccctttgcacatgctgttccctctgtttcttcctcattttcaagtctttgcacaaagcttatcctctctgacctgtctatctaaaatcattagctcctgccctggtattttttctttctctttatcacttgaattttttctcccatagacacaccacatatttcactgacttatgtatttattgtctgtcttcctctatgagaatataaacttcatgaggatggcatttttgtctgttttgtggacacaagagcctgatgtaaattaggcgcccaacaaatcttcactgaatgacatgataaataaaagagaagcacccacctttatttcttggttgcctcctccctgactttggcctctccatctcctccccagcatggctgcttatgcgaggcaagggcaagctatgtaaccttggttgcttctgagaaggcttaactttctagagcctccaactgtgtgtggtctatacaccagcaccatcagcctcacctgggagctggtgagaaatgactctcaggctccactcacactgcatctcaacaagatcccagtgaattcatatgcacattaaattccagggagccctcctctaggctatttgaccctagctcaagaaagggggattaagagtcttacagggagggatccaaggtcagcatatacagttagtcagggaccagtctgtctgtgtctctctctccatggggtttactatcattgctttcccctaatggttcttactcctgcttcttcctgcttatttttcagcccacagcgaccccaagaagctgctccaacccctgggactatggagctctacagctgtagagaccaccaggaagtggactgcaggcccctggcctctccattcagattctgcaaagagatcctgatgggttgggccaatgggtcaggcatccagtcagctctggctaaggggtgaaggagtcaggtgttaccaacgtggtggcaggggccaccttgaagctgtgttctgtgccatggaagaaggaagaggaggaggaagctaagctggaagggaaggcaggtgatacaggaaaattaactatgagctttgctatagtgaccacttttccttcactccttgagctgtggccttaagaactgtgtaccaatgggaggcacttgcatagtaagtgttcatttgctgaatacttacagagggctataagtggacaaatatgtccaaaaacacatgaaacacacaccatcaacacttgcagatggtctccttcagggaacctttccacactggctctcccctcactgagctttccttcctatcaccctcccagtctaggctcctggagtcagtagttggaatctcagatgggaagaaaccttaaaagtcatctggtccagtattttccaaagcatgttccatgaacttgttttccagaaatggtttcctggtctggtgagtttaagaaaccctgcttatgacgatgctctccatttagagaatcacaaagcttggctactcaatgaaagctctgacaagtcctgcaggaaaaaacttgtcttcttttggctaagctagggctgcccaaagtttctcatggagtcctttcttgcacataataatagcatctcacaaaccagtggtcgggggaacccattacgggaaatgctaatcttctggacccttccttctattttataggtggagaggctgtgtggtggtctggttggctgcatgtaactgaaaaacaaaggcttaaaaagataggggcttcttttgctcttttgttaacaaagtctgggaatagtcaaagactggtactgtgactagaaaggcttctgatatggtttggctctgtgttcccacccaaatctcaccttgagttgtaatgatccccatatgtcaagggcaggatcaggtggaggtaattgaatcatgagggcagttaatcccatgctgttcttgtgatagtgagttctcacaggatctgatggttttataaggggcttttcccctttgctcggcacctctctctcctgctgctatgtgaagagggacgtgtttgcttctccttctgtcatgattgtaagtttcctgaggcctccccagccatgtagaactgtgagtcaattaaacctctttcctttataaattgcccagttccggtatgttcttgtagcagcctgagaacggactaatatagcttctctgcccagtgtgaagaagagcagagaggcagggctgggaggagaacaaggcacctgccaaggagatggggaggctgggctggctttccctctcctccaggctcacctgggaagcctgtgctctaaacttgctcaaacatcctgaacccaggaggagttggtggtacacaaattcaattcaattcaaccccacatccagactgtactcaagcagcagtcttttggcccagtcatctccaacctcatcttctcccctctactcccaaaccatgctctctctgctccagagccaggggcctctttgctgtttccaaaacatccatggcagtctccacttcagggcctttacatgtgctgttccctctgcctttagtacccaaacagaatggcttggagaccccagccctagttcttggggaagcccagcctcctccatctcatatctaaggcctgaggcctcctggctgcctctggctcccatcttttctcctgcagggtatctccactgtgaagattgctgttggccccattaattacctgtaggagtcatctttctgattccttaattttgtcctgtgccactaacccaggaagtggctaggattttgctgagggcttggagtaacagaggaagaagagagcactgccaatcgcatgttagagctcactgtcccaaaagtgaattggccagtccccaccttgctggctgtgccttcttaggccccattatcactctcttctcatgctgtttcctttgagatctttgttttcccttccctccaaaatgcctgatattttctcaggcagagtagtctaactttcccctcctcacccaaactaggcttccaggccctttagcaatgccaaaactcaccagggaactataaaataaagcaactccagggatccaggaggaaccagtggagacttgggaactgattttctccttcatatatccaagatcgtattattggcagtactccctccttattgaccacaacatgctcctggctgaggctgggcagagagagtttgtctccttccacagcaggtgtgatggcacctgctataggcagtgctgtgttcggcattgcattcagagatgcaagtaaggcaagaaccctggcctcaaggagccctggctccaggagtgaaacttagcctcatgcataaaataagtggagatgggagggggcagggaaaccttggctaatcagagcagagaagagcccttcaggttggaaggtcaaggagggcttcctttaggaaatggcatttgaaggggccagatcagatggcttaacttcggggacaagctttggagcagctaacttgggtgatgtaggattttttttttttttaaatctcccagctctatgtctgacagatttcacctaaaccagccttgttaaatctcaagccccatgaaacccgtttctgttataatctctctctcttatctcttccttgccttcctttcccattctcctcccccaaaggataggaaatcttcaaagaaaaagatgtgtcactgcaagtatacagcccaagaaatgggccagataaattattaaaacacacgaaaagacagtgagttatggggtgggaagccctcggaggccgaatggccaccccaggtagacagcatgctggtggcccctggagacccccttctcagagacctggacagactaacattttgccacaaggcccatctcttgggttctcaccccagatccgggtaagggtatcatgattccaatagcagtgaagtcccaggcgcctgctgggctgggaggcaccagggtgaaggtggaggggggctttgtgtctgggctggacatttgggatttactccccgcaagactcaaactgctaactgcagttttagttcttgcttttatctctttttgaactgtaaaaagaaattcccaaggggaagaggggatacttttttctcatggaagaagaaagccaggaccggtttaagaaagtaaccaactttctaagcactgtgagaaaggatgctccaagttttgctttgatttagaggcaccctggtaccagcagggaggggtgagaaaggcaaacaggaattccagacgaattccattgccttttgaggggtctgaaagagggtgcccactccgactcagatgctcaaacccctgcctccctcctacacctgacccccgccgttctgccccactttttcatgttcctacagctcaggggttcttacttcagcattacccacatttgatgctggatcatttgttctggtagggtgggggggctgccttatgcattgtggtatgtgtagcagcaaccctggcctctacccactagatacctccaggcattaccaagtgtcccctagagggcaaaattgtttgctgtcaggtccttatgggatggaaagaaagaaaaatggcctgttacccctggtgtaacttactacactgtttactaattcatcatttattgtttcttgcctatcttccccctaggtgagtgggagttcgatgagagtggcagttgtctattttgttcaccgatgtatcttaggtgactaaaacaatggttgtcacatggctggcccttcatatttgtttccagatggaagactctctttctagtggtggaacattagttttgcactgtgttgggacaacctgatgtagtgaaaacaagcctgggcaatgaaatcaacagattggagttcagttcctaattgggtcatggatgaactttgtgaccttgggcaagtgagttcacctctctgagttgaataggttccctcctttctagaacaagtatgagtctgcatcagagagtggttgcgagggctacacatgatggaggatgaggactggcacatcagaagtactgaatgaagaattgtaacataaaaatgacaacagtaatatatttttgtggtttcagcactcttcaaatgaaaccacctggccaacaggattttagtgtacctgcttataacattagccttcgtttccaccaaaaagggtgttaaaaaaggaagcttggaacatgaaagtaagacacttggatgaagagatttatgactctggggggctgtgaattcctaatgtccttttgagacatgtagatcttccagagcgatgctgcccaatgcagtagccactagccaagtgcaaatggtcacttgcaatatggctagtctttgagatgtgttttaagtgtaaaatacacactgaattttaaagacttagcgcaatacaaagaatgtaaaatatctcattatatcttgaaattatactattttggatatatggtgttcccttggtgtctttggggactggttccaggatcctagaggatacccaaatccccagatgtcaagtccgctatataaaatgtcctgtagtatttgcatataacctacacacatccttctgaatactttaaatcatctctagattccttgtaattcctaatacaatgtaaatgttatgtaaatagttgttatactatattaaaaagttttttattctttatttttgctgtattattctttttgcatattttcagtccacagatggttgatgccacagatgtggaacctgtgaataaggagggctgactgtattgagttaagcgaaatatattattaatatttcatctatttctttttacttctaaaagatgtggcgacaagaaaatttaaaattacaaatgtggcccacattatatttctattgggcagtgctgctctagagagtcggcaaaaagggcagaatggagcctccattatacagatcacaaaactgagcacaggtaattcactccaaaggtcggggctggtctcactctgagctgcgggttttcttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatggcttagggacgctcccggccgccgcatccccagcatggggaaacttcactccaagccgggtcagtgcccccgcccgcgcgctcgccccgggccccgccgccgtcgccgccgcggtcgctaactctctcccttcctttctttccttctcccgccgccgcggctgccgccgccgccgccgcctcgcgatgtgcctgcagccgccgtgtgcaagcgcagggagagcccggaaggtaggggcgcgcggggcgcagacctcggggatggacgcgggggacaccgcggccgcggcagaacggcccagcccgccaggtcttatgaccagggccaccccgaagccccagttccggccaccggccccccaagcccgctccctgagcagccttcgcgccccctcctctgtccctcctacccgctccccgcggtcctgcgctcccaccgctgaccctcaacccctccccctcccgcgtccctgccctcggctctcacggcaccctctcttcagacccccaagcgcctccccgcaagaccctgccccctcttcctgccccccggcccttcttccgatatcctggctcctgcacctactgcggcccctctcctgacccccagccctctcctccgcagtcctggctgccagtgctccctggtctgatcctaaacccgtcctcctggggtactgctcacccctcttgcccccttctggctcctcgctcctagggcttcgctgaacccccctttacttacccgcgtccctctcttggctcctgccccagcccgcgaaccccctcctggcccccgtgccgtggtccttcgcctcccaccgcgcctccttcttccctccgcgggggtaacttttggcacctggagccagactcaggggcttcatgtcgtccccgtcccaggtgacagcttcgccgtgagcgctgcctgggctcggaagggcatcgaggagtggatcgggagacagcgctgcccgggcggtgtctcgggaccccgacagctgcggttggcgggcaccataggccgaagcacccgggtatgattccccacccctgccccacctcctggcctcctttcagcctcagagatgggtccccaaacccatgcaccccaactttgagcactttcctgcacagcttctgggtctgaaaatctcttctcagctgccccctgccccaccaacgcgaccctctgcccgcatgccttggagaacctcgaagtgcccagctggaggcagagggctgcctgggggaaaggtcctaggtggggaggtggtgaaggtccagttgatggggaatcgtgtctgtaccggcgggatttgggggcctgctctgacttctaccttgtttctgccaccagcattcaaaggtggaggtggagtaggggctagagagaagggggtattaggggtgtctgggtggaaggcagagctgtgctggccccaggatctgaatatgttctgattgtctgtggcattcatcagtaccacctgtacaggaaccccagtagagcaggcggccctctgggtagcagatctagggggactgagacctggaagaccccttacttggcatatgagatagagggcctcattccactgtagcctgggcagagccctgagccttcaccccgtgtgtctctgaggctggagttcctggaggagcactaagtgtgatgggaatgagtgagtccagccccagctcctggcctgggacttggcgttcacagatgtcctgtgagctccggaactctgcacggggctttcaggcagtctgcgtggaactcgcgcaagcctaggatcaaaggatgaatcaactttttgatgtgacatttaatttttttttttttttttaacttagagggggaatagactgagtctcaggtctggttagttctttggtcttatccatgggctggggagaggccagtggagacttcagatgtgtttgtatttgggtggtgggacctggcagctcgcttgcagtgctggtgtcgggaggtggacctgtggataaagtcagttcctgtgtgtggatgaaataacctctgggcctaggagaagctcccctgtcctcctccaccgccactgcttagctgggggcttctctgtcttctgttggccgggtcggacttggagctgctgtcccctagtaaaggtcaaatcttggtgggcggggggcactgcagttggggccctttaaaaagagaactacaaacctctccttcttcccctgccctttctagtttttgatctacttatttatttaaaggccaacgaaaacggtctaatttagccgtatgaacaaatgcatttacagctccagacagaggccaactgagtggatttccattaatcaagttttgggttttttcagcctgtttatttttacaaagtattcctgcagaatgacatttatttgcagtccctcctttttctttttcttttcttttttttctaaactgccaggcagcttgctccatgctagagggaaaacttgaaatacagcgagggcttacttcaattgacttttatcttcaaagccataacaaatgttacccgcatgtttttggtgggtctccttggcatccagtctgggaggatgggagggaggaggaaagagggagaggaaaacaaaagtctgtcgtttttaattaaatagtagtgttcccagcgagaggaatgcaggccactaaagttgccattgggggaagtgagggagggtggggagggggccccagcttaagtctgtggctttggtgaagtcacggaattctgttgcctagtttcttcccccagctgaggacagcatgggatggtgcctgtccccctctctccctcaccccctctctcagagaaatgctgagaggtcattaatgtttgttcaaagtacttttgaagatgtgaggctcagagccgttggcatgacatgtgtcaggtggttggagggtgggccgcagccatcaaagttgttatgcagggggccggcctctgtctccttgggagttgttcttgctgctggggacccagacgcctgggttttcaccaaccttggccccagatggcccagccagtgtgtctgcagaggtagggataaggagtcagaacttcagggggagcccagggtgtggaacagcactccaggcatcctccaggtgatttcaggtggaatctgggggaacattttaaatcttaatagttatctttttttttttaccagaaaaaaaaataactaggacatcaaacccatgattttgcagattttattgcttaggatgaagctaagttaaaaaagagtctaacgtgaagtccattcagagaaaaatattaagtacaagtggtcaaaattgtgaatgtgggaatggaatgccccaagtttgggaagcactaagatattgaacaggacagcaatgggcaaccctcaggctagttcatttccctgattccctctggtgccgaaggggtagctggtaggttcttccatgatatcatcaggatgtaggagggcatgggctccaaagtctgctggtttccaagggctggcagaggtcctcccaccaaccccaggcctgttttggggctagtctctgcctctagtcctttacgtggcctgtcaactaagtggctggagacacagtggctcatccaactagtattattgttattgcaatgataactagtatttattaagtgcctatatgtgtcaagcactttgcttacattatcttaatcctccccataaccttgtagtgttgacagcccgctggtgtggactgtgtgtttctccctttctggagcactttctaggagaagccatttgtagagaagccctgtgccagggcatccgcctggagggtgctacatacaaaactcccagagagggggtgcttcgagatgagccagtcgtggggcaggcagaagcaggagtggcccctgtttgccctcttccttcctgatgaggtctgaggggcttgggaaatgtcccagatgagtccaagttgcctgcagggtcctgagatgtgaaagggtgaccatgctggcattaaactaagcctgccctcttaaatacagaaataaatgaggtcaggctctgtcctagtgatttgtcacctgtgcaaaccattttgcccttgtataccttaattagctcatctgcaaaatgggtgtaataatattttcatccctggcgggttatgatgggattataactgttgaacctgggaaggaagggaacctactgggagattcactgaagacatttgtagggttggagatgggggcctacaaacagggagtgatagggctgggataagaatgctagaggctctctgcctcccccactgtcatggcaggctcacttggagggacgcaggccaagggctgggcttttgccctttccatggggacatgagcaagtccaagggaatatggactcataggagaaaaggaatgagaaatgggaggcgcacgagtactgtggaagaggagcaataaactgatcagcacacgcggcaaagaacaccatgttaaacaattagaaagcaaaataagcatcataaactcagagagaaacggaggatgctggaaacatgaagcagcaacaggcagttagagaagaaaaccaattggaaacactgggtgtggaaaatagaatggacaagtgaaaaagcttaatagatagattaaatagtgcagtggactcaggtatcaggtgggaaacacttggtgaagacctgtgtgcctctgtatatgctcacaggctgattgtgaatatgtacaaccagatttaaaataatctccccatggccccggttggcccttttgttcctttacagcagagctgcctgaagaaataggctgagagccgtggtgcaggcaagcccgcctctggatcaaaggcggctgccaggcagtttggtaatttgactgggggtacctagtgcactttgatatttggagaagatgaggagggtgcaggcttacttggagcccatggggacgtgtggggttgggtgatgagattggaggctggcccagctgttgcccgagtgccagattccaagggaattacccttgaatgataccagttggcacaattaaaaggccccatgtctttgccatatggaaagtgttaggcttctttacgtggtttcaaagctatgtgatgggaggtgggcttgacatttgaggtagagcataaattaaatatttggtgtttcaggattaaaagatgatttgctttaaggctggagaaggactcaggatggaggtgtttgggccttgttcactggcattttcgagttctccagggagggtcccctctgctcatgggcaccagggccagctgcctggcccagcctgggcactgtctttcctcctgggggatgggaggcagaggctgggagagcttgggctgggcagagtgctggggagtggggggaccttctggttttccataggtccctcaggatgggtgggtggcggccatgggtgtcatcttcttagcgctttaatgggtctttgtgatgtggtctccggtagaggcttcgaggagtgtcttgtcctcactttgagacttttcttcttggggaaggaggctggatgcccctgagccagactgtgcatgccttctgttctctagagcccaagagcaccctcttcattcacatttttgtaggaaacctgggggaaatcaaatccaggaggcacctgctgtgggtcctgcaaggtcctagaactcaggggatgtttcctctgctcgcccagtggggatgttggaaggtggggatggatggatcgatggacagtgttgttgtttgtaccaggaagctcaggtacactctgggatcaaactgtccccgcgagggcaggaaacatcaaggctgaactgtcagcagcaaaaaaagaagaaagaaatgaagatagattaggtcaccctccctgcctcctttttccccagctcctcttccctggtcagcttctttcctttaattcctgcttccaaattccatcttttcccaggtccttctgtctggagtggaagggtggaaccaggctttttcttttaggcactcagcttaatgaattagtataaattattatcaataattctttgtttattattattattttttagacacatagtttcactctgccacccaggctggggtgcagtggcgtcatagctcactgtggcctcacagtgatcctcctgcctcagcctcctgagtagctgggactataggtgcacgccactgtgtccggctaattcatttttattttttatagagatcgggtcttgctttgttgcccaggctggattgaactcctggcctcaaaccatcctcccacatcagcctcccaaagtgctaggattacacatgtgagccaccacacttggccttgttattaattatgaattaataagtccctaactgggccaggctctggggatacagtggagaataagagagatgtggttcctgccctcctgtggcatccagtctgatgaaggggacaaagcagcagtgagtacccaggcccactcctaggaccacacagaggcactctgggagggagggggcaggatgggccgctgaggctgaggagagaggaggaaggagttggaggtggggggaagagctgaccgaggccccaggctcaagctgccctggtaggatggggttggggattgccgggaggcttctgtgtggaatcaagcgggtaatcaagaagggaatgtggcctccaaatggctctgcagcctgtgggaactggaagtggttcctggcactgtctgtggaaagcctcgtgcattggtggctcttggcacatctgagttacctgtctgtccccctggacaggtatgttgggtggagcagggcgggcagtcagcgagcgtgctgcccctgtgtcatggacaggtccttgggggctcaacctggcctgttggggttggtggccctgctgttgtgttgggggaggaggtcagctgcagggctggaagcttagctgtcagggctgcggaggacctgtggggtgaggttgctgctcaagaaggaggctcttcagggaccagggaacaagagggagtgaccagcaaaccccagagagagctaatcatgccccagaactgcagcgcgcctgtgcctatggaaggagggtcccccatgtgggctgagcagggctgtccgagacaggatgtgcagccccccggtactggtgagctggggggtcctgcagccccatggctgcgaatcacaagatgcttggatttagacacttttggacttttcacatcacttgttggattccaaaccaggcacttctggctgcctccctgccttccctctctcttgcccactcacacgtgttctttttgccgctcttgtctctcacagacgttctttctcttcctctccctccccacgtcccttcccccccaccctctccctgaggaaggaaaaaattcagtctctcacaaacaaaatatctgccattccatcggagggagaactgaggcaggagcccagaatatcctggaaggaacgcaagcgagagttgaaggcctcagttgtttaatctggaaggaggactttgatgtcaccctgctccgtttatcctgggaagcttcccgctgcttcatggcttcgactctctgtgtgaaagatggctgagctcctccaggggctggaggcaagcctgagcagctccgaagggcagcctggtgatgctgcgctcctgccaagcccaggtggggtggagaaccttttctaaacaagcacttccagagacataagtaattctttgatagcttcctgggaaggcagaagggagctgtttagccttgtgggcaccagtcgtggggctctgggaggaaagcctcaggtctccgcactgaagtcatccccagcctcagagcggtggcggcttggcccgccggggtgggtcctggatgtgtttgtttagagggctctgaggcatgggtctgggctttgctttccttacttgttaagtcacatgggctgtggcgtgtgcgtgtggccgacgcctttcagaggacaccagggtactgagagggcttcacattggtgtggcctcagccaaaggctccctgcctgggcttcagattctccagctgagaagtagaataacatcatgataatttagcactatctattgagtgcattcattcatgcatctgcagtagggttttttttttttttttttttttaaatttagagacagggactcactgtgttgcccaggctggccttaaactcctggcctcaaatgatcctcctgccttggcctcccaaagtgctgggattgcaggcgtgaaccactgtgcccagccttatatatattttttaacttttattttaggttcaaggtacatgtacaggtttgttctacaggtaaattgtgtgtcatgggagtttcgtgtgcaggttatttcatcccccaggtaataagcacagtacccaacaggtagttttagatcttcagcctcctcccaccctgcaccctccagtaggccctcatgtctcttggagtgggcattgagtacctgctttaggccagggacacctgtgcttggtacctagagtgaaggccttgatttcatggaacttaccatcttgtaggaaaacagaaatattttcataaacaagttgtgcaatttaagttgtgatatgtgcctccaaaaagtactggatgttttgagaacatgtaccagggatcagaactcatctggggtgtttttcattccacaaatatttgactgctttatctatcccacgtgctgtgcttagggtgttgtggaaattgtgaggactaggacatagttcttgcctctgtgagagtggaactaagctctccccatggcctttcatcgatttttcttctcttattgcattggttagaatctcattgcattggttagaatctcatactctgtttaataactaccaagtatgatactttttgtttaagaaagcttccttcaactcctggctttctgagctttgtaaaatcaggaataattattgaattttgtcacatgctgttgggatgcagatggaatgcatcattctttgctaatgtggtgtgtgatttgtatgcttgatttacattgctggatttcctagtgcaaccttcttggccctccgaaattctttgtcatgatagattattcttttaaatgtgaccgcatttgataggctaatattttactttggatctttgcatgaagtactcagtgcaagttaactgttaaagttataaaaccataagggaagcacagggctgtggaggttggggagggtttttttgaaggaagtgggcatgtgagtagggatttgaagaatggtaagactgagatcaggggttagaaacttaaggacctacaggggccagagaggtcatatgaatgaatgccacaggctcagtgggagacatctgagaggggtgggaaccggggtgcccccggggaacacacaccctgcctcaagggggcagtgccactcaaccccagccaatcactgccatgtgggaatatggccctggtgttgccacacgggctgatcattaagaaaatccagctgtctgaatttttatgtgaaacttttccaatttaaaaaattattgttaaccaattaaaatttttagaaaacaccttctttgggtgactcagacgactggatttggcctgttagtacactggcttgtgtttgctgatttagacctttaagattctgatggtggtggtggtagagaagcagtatgttagtgataaaaggacacacgagtgagtatcatatggactcaacattgtgcctaatactttccatgcattctcttgtagaatcctcacaactgccttaggtattattccgctatcgcatagatgaggaggcaggcccagcaaattagagtcactagcccagccagggagagctggatgcaggctgcatccaaggcagagagtgcaggccaagcaaaggctcattgccaggaagctgtgcacagtgtatttcagtctggtgggagagcaatgtgggaggcacaggaagggtaagtaaagatgtgggctgggatgggaggccgaggttggtggaggccgaggttggtggatcacctgaggtcaggagtttgagaccagcctggccaacatgacgaaaccccgtctctgctaaaaatacaaaaaaaaaaaaaaaaagaaagaaaagaaagaaaaaaaaaatagccgggcatggtggcaggcacctgtaatcccagctacttgggaggctgaagcaggagaattccttgaacccgggagatggaggttgcagtgagccaagatcgtgccattgcactccagcctgggtgacaagagtgaaactctgtctcaaacaaacaaacaaacaaacaaacaacaaaacaaagatgtgggctgggagactttatgctgaagaccagcatgtgcccatagaaggtgccagaggtgtgcttagaacttgcagaatcagacttcctgggtctgagtcccagctgcacttctccccagctcggtggccttgggccaagtgatggctcatctctgattctcagttttcacatctgtggaatgggtagagtaatggttcctacctcattgggttgttttaagggtagaaatgggttcatttcagcaagttaaagaataaaggagatgtcaccccttcttttgcagcttgccagtgttgtttgctagtgatcacctggatgtgtgctcagtgtggtaccagtgtgctaagtgcagtgaaggaaaaggatggggaaggagaataacggaggattctacttcagattagggagtgatgcgtaagtcgttaagacccaaagaataaataggaaatagctaggtggggaaaggtttattaaaaatattccaggcagaaggcacgggatgtgcaaagggcaagaggcatgcagggttggtgcacagagaaagtgttcagcctccttctcggtgtctgacttggaaccacattccagtctctgaggtgttagagcagaactatgtggtgcagcagcagggagtgggcagtgcctgctgggctgggtggtaccactgtatgttgcatcccgtcatgaggccttgtctccttgccgcaagtcttccatgaagtgttactggtgtctgtggactccagctttctggtcaggttggaagaggtagggaggagaacctctcagtcacaagaaatagtgtcaccctggagcggattggctggcctgctgggctgcccaagccttctggccttgagcatagagctggggtcctgaggaggggagaggcagagcataaaaggaccctgttagcaggatggggctgtcttccctcaggccacagcctccctaatgggctcaggccggaggatgtttttctaacttcagaaggctgcgtgggctggtgggcccctcactcagaggcctcggcttgcggtggctccagtgagtgggtttgggggtgctggtgtgtggtgccatgcccattccatgcctggtttccagagggagccttgttccaggacagtttttgaccctgactttgttgttttacccttctttcccccttcaaaggcaaaaagatgattgaagagaactactataatccaggaacaaagttgccttttcagcgggcactggggactttctctgcttcctccctgccctggaaagtccaaaggcacccactgcctcagctggtcctgggcacgtgcctgctttctcagtggctgcaggctcagtgtgcccgcgagctgcccactgtgtgcatagccccgtgctgagtctgggagctgcagcccgaggaggaggtggtaacagcgtagctgctgcttgctgcgtgtctgctgtgtgccaggctctgggccaagcactgttcatagtgctggattctcagagcactgttatgaggccgctgttattattatgcccatcttacccatagggaaactgaggctttaaagaagtcaaccatattgcccaaggtcacttaacttggaagtggaatcttgcttcagcaagattcaaattcagatcactcagtgtgattttagagccatcttaaatcagtttaggcgagtttttttttttttttcaactgtatgtctcagccccattcatggttcatgacatcaatttagtgaccaaaatgaaatagagtaaaaatatgagaaaacattatatatagtaagagtaaatattgttttgtgtaattttttgttctagttaaaaaaaatgtatacacacactttacacacacctatacccaaacccatctatctatctatctatctatctatctatctatctatctatctatctatctacagcagaggcatattgtaaaatataattcttactataggtcataatcagagtattagaaaaacgctggtgtgggtcactggtgcaggccctgagcctgaatgcctggttttgagccctggctctacttctcactagcagtgtgacctagggcaactttcctgacctctctgtgctttctgagctgtttggtttgttgacttttgggcctgggtcagtgctcccagggatgctgtgggtgcttgctgctggctcactccctttgcttagggaatgaagaggatgagcagtcccatggagggggggcccatggcttctcccctgagaagccaacagcagcagcttcatcccaggagaaacacagacatggctcagtcatcaggggttggacacaatgctgcgctgggaaccctgagcctgggggtgcctccagcttagctatgaggtatctattatgacctctcctgccttctgcttcctcctctcaaaaatgcattaaaggaaaggagaaggctttgtttctactgctgtaaaaaaaaaaaaaaagtccaaagattagtgacttgatcactttgtgacttgcttaagagtatgcactttggaccaagcctgggagggtcaacttgtctgtggctccatgtagcacagttagggtggctctaacagcaagggtctgactgcagcagctccaaataagtgacatgtctggggcttcagttctcttctagttggcctcacctcatgagtagcttgggcttcctcacagtatggcagtctcagggtaatcagatttacatggtggctgtctttcccaagagtatagaagcaaaaacggccaggactctttaaggtttaggcctggaattagcaacaacacattctcttcattaaagcaagtcacaggtccagcctagatttaggggaaggaactacacaggggcataaatactgggaagtgggattcactgggggccatccacacagtctaccggagagtaggtggtctcttgcagagagagtggagttatagaaaaggactgagacgtgtcccttgggtttaggatcctggcggtcacagttgggtctggcaggaactgtcttggtgaagtgacagcagaggtgagacttgggtggctcacgaagggactaagaaatatgtgcaggggagcagaagcacatacttacaagaacattcatggctgcatttggaagaatgaaaagtttttgacaactcaaacatccatcactagggtacaaggtaacagtggtgtggacttctcattgagctctctgcaactggtcaaagcccagcgagtaagggcctctcttgctgacaggaaagagaccctgagacgctgctgaatgagcaaagcaactgcaaaacattcataggccatggtcctgtttcttacagtgtgaaaaagtctattcaggcctgtgtcactgtgtatctgcaggtgcatagagaaagatctggaagggtacactgtcaaggactatttccctgaggaatggagaattttgcttttcattttgtacatttttaggttgtttgattttacaaaaaatgagcatgtgctactttttgtatttttcaaaaaggtgatgtattttaaaagtgaatgacagatgaggaaacagcatgtgtaggcaactgtatggagaagctttatcagaaggagtggagagagaagacagcagccagagggtgtggagttggggagactcgatgcggccgaggaccacctacatctgaatctcttgggtgctattcaaaatgtagactccttggggtttcctgagcctgagtcagaacctttctgtactaggcaacagctgggccgactggaccctgaaggaaaggagagaggagggtgcaggagttggagagggatgaggggggaggagggcactccccatttgtagtgtagcgggacctaatgagcgaccctacagagaagccagtgcaggccctcactcatgacaagctctcgctccatggttctctctcctcttcccacatccccataactgtggctgcttaaacttgcaagcggatttagagctaccctggcagtcactgacacctgcctctcttgaaagggctgctaggtcccaccaccaccccccccccccgccgtagaatgggtagaagaaggggctgtagaagtgacctctagactgtgctgaccagtagaactttctgatgatggaaatgttctgtgtctgcattgtcccctctgggaacctgtggcttagaatgtgaccactgggactcagagactgcctaaattttaagatatattttatttgaatgaatttaaatgtgaacttaaatagccccatgaggctagtggctacctcattggacagcacagccctggacgcatggagaagatcctgtgtgtcaggctaaactccatcctcagtgggcacagtcctggacccatggagaagaccctgtgtgtcaggctaaactccatcctcaatgggcacagccctagatgcatggagaagaccctgtgtgtcaggctaaactccatcctcagtgggcacagccctggacccatggagaagaccctgtgtgtcaggctaaactccatcctcagtgggcgcagccctggacccatggagaagaccttgtgtgtcaggctaaactccatcctcaatgggcacagccctggacccatggagaagaccctgtgtgtcaggctaaactccatcctcagtgggcacagccctggatgcatggagaagaccctgtgtgtcaggctaaactccatcctcagtgggcaagccctggatgcatggagaagaccctgtgtgtcaggctaaactccatcctcagtgggcacagccctggatgcatggagaagaccctgtgtgtcaggctaagctccatcctcagtgggcacagccctggatgcatggagaagaccctgtgtgtcaggctaaactccatcctcagtgggcacagccctggattcatggagaagaccctgtgtgtcaggctaaactccatcctcagtgggcacagccctggatgcatggagaagaccctgtgtgtcaggctaaactccatcctcagtgggcacagccctggatgcatggagaagaccctgtgtgtcaggctaaactccatcctcagtgggcagggaggcgtcaaaggagtgcaaaggagtgattcacagcaggtggtcatggaaagaaagctctcccccacaggaagtactggttaaccgtctttggggcctgtccagagcccccttccttgtaacatagctgtgttcaggcttggttagccctggctggccgcagccatggccatggtggggaatgatcatggtcttccttctagatggttggatcagagcaccttcttgtgatgtcacaaatcggggcctttctagccttcttaaccttggaggttctgctcagcagctgctactggcgtctcgtcctcttggctctgggtctggggcactggaaggtaaactccctgctgagttggaggcagcagcattgagtgggtggctgttttccagccaggatttacccagggctttatggcttgcaaagccttcctcacagggctttgtcaggcatttaatattcacaaaaatgtggccaggatcaaaattattattatggggaaactgaggccagactgtaaagtccacaggtcaggttctttgtggctcactcttgtatccctgggccttttgcactgattggcacatggcagatcctcaagaacattttccaggtggatgaggttcagaggggccatgcagcttggccagagggcacacagccagagaggcagggattctgttctgttctgtccaagtccccacctcttttatggagccaggctgttctgtgtctttgaagagagcctctgcccttcagaaagggtcctcacctttttcctttctgtaaattaagtcgtacgcatggttaaaaaaaaaagaaaagaaaatccaaaatagtactgaaggtatgcagtacacaggaagcctccgcccacctccacctcccagcttccccctttggaggtatctgctgtagtgggctcctcaagatacttctagccatgctctgtttgtgcatgcttatccctgcacagacagcagaagctgtcttggccaacaagaccaggaagcattggtatttgcaggttaattgaaaaattcatttaaggtggagaaccataaaaaagtgatatagaggctgggtgtggtggctcatgcctgtaatcccagcactttgggaggccaaggtgggcggatcacaaggtcaggagatcgagactatcctggctaacatggtgaaaccccgtgtttccttcactaaaaatacaaaaaattacccaggtgtgggcctgtagtcccagctactcaggaggccgaggcaggagaatggtgtgaacacgggaggcagagcttgcagtgagctgagattgcaccactgcactccagtctgggcaacagagtgagactccgtctcaaaaaaaaaaaaaaggtgatatagaagccaggtgcagtggctcatgcttgtaatcacagcactttgggaggccagagtgggaggattgcttgagcccaggagtttgagaccagcctgggcaatgtagcaggaccccatctcttaaaataacaacagtaacaacaaaaaactagccaggtttgtgatgtgtgcctgtagtcccagctacttaggaggctgaggcgggaggatggtttggggccaggagttcgaggctgcagtgagccatgtttgcaccactgcacttcagcctgagcgacagagcgagaccatgtctctcagcaactacaatgaaaagtgatacagaccttaacttaagattttcttttaacttaagattcatgtatacatctgtctccgcaccttgctttcttaatacataactttttaaacttatcttggaaatcatttcatatcagaatgtataatcttattgttcttcatggctatcaagccttctgttataaggatagaccatcattgcattgattccttactactgggcatttagatcatttgtgggcttctgcctgtggtcgactttagagcaacagtgtgcatttctgcttccaccccttgccctgtgcccccgacacacactgcacatcctgatatgatcaccaggtgtggctctgctatttttctggcaaagctggagtttttccttctggctggtgtctacaaaatcgaggaggaaagcagcttcagggggagcttgtggttaagtaggtgtgaactttctctgtggatccgttgggaccttttggatttcaagcccttgtcaactgtttcatacagtcaagttcttggcttgtgtaaccagggagtggacttcagttacagctggatccaccagcccaaactatgtcccaggacagcaatctgtgtcttcatctctgctttcttttagattggcttcatccttaggcacacccttcccaggtaatggcaacttggctcccagcagtccagactcccagcttcagttgttagagaagaaagttccagcaaaaacccaggcggagctcccattgttttgacttgggtcacatcccggaacccatccctgtgcctctgacagtcctgggtcacatgcctgtcctggagtggaggctgggatcacccccgtccccgcatcccttgaacctccctaatgagaaactgacttgagaggagaaggctgtagaaagcacactgtatgggtggagccaacagctgtggatggcctggtccctggaatcagaatcactgaacaaggctctggtcagcagctggcaaggctgggtaaggacagggcagctaggtagctgaccattgacccacccattgccattggatcttggaagaacctaggtggtttgccacctcctccatgcagcccacctgggttacagccttcctttcaagcttctgacctctctatgatgatcataggttgatgatttttaaccctcaaggagtgagtaacaagacacttttgggaatccaccaaatctcttgtgtctctctccttagataaatgctcttacatccgtcattccaatttcagggcacctatggccccaggttaggaactcctgttttagtttttatggccccccccctttttttttaagacttaattgcattacttcactcctttttccctatgtgatctcccaatttgaggggtgcatagagcttaggaccaggcttcagacttgggtttatactgaaccgtgttgacgctgggccttagttttcttacctataaaaagaggaacagaatgcccaccgtttggagttgtttcaaagattaaatgatgaagtaatgcatatggccactgaagtgttagcatgcagtgagcacccagcagatgtactcagtagccctttaaggcctctggatctgctgctgtgttctgaaagattcccagtaaaccggtctccatttctttggggccgaaaatagcacctggaaggggcgtgattgccgtttgtcagaagaagatgttgagaggggacatcacatttgattgctcaggagttcccctgagatgattgctccccatttatagatgggaaaacccagccctagggaggtttcaggggcttctctaggtgtcttggagttagtttggtttagctgtgagtgccttttacactctgatctcgggacacccctcacttattttataagctgtacctcctccttggccaaggacaggccacaggtgacagctcccttgtgtgttatggccctttggcagagtccccgatctcaactgagtcctttctggccccagatcccagccatggctccgctacctgcctggctggacaccaggtctggggtggtgggtattgttctggtagaaatgtgaactggtgctttgctttgagtatattaagacacaaagtccctgtggttaacagcaaattaatcacagtgttaaggagggcctgtctcgggtagacatgacttcatgagcttgtcataaaactggcctctgccatatttcactccccaagatttttgactttcagaaaaggaaccgcagatagagttaccaagttttacagaaatatttttactgggcagaagattgctttatggcgagagccagttatttcaggagacaagcaaagagccctttattctcacgttctgtgggaggaaaatatgatgccagaaagcccgcttcttggatgggccctttgagggggtgggctgcatttttttggagttgggagtgggtgacatgaattggcttgcgaaggcctggggggcccctgagcacccgcctaccttttcttaaccatctctggggatttggggcttattttgcaagcacacggaagcctaagggtgttgaacagggaagagacgtggttagcactgggcttgaaaccaggaccgcatatcagagaggggaagaaactgagagtggtaggccagcctatggggggccccagctggagacacaggaagtccaggttagagctggtgctgccatttcccagccatgtgattctgtcatttcttgttgtaaactggggataacagcaggacctgcctcatgggctttcaggagaattaagtgagagcatctgtgtcaagcgcttcctcatttattcagtccataatgtctatggtgatcgttggcagcgagagaggggggtcttccttcatccacattcctgaatctactcatcccacagcttcctttgcttgtgcctttgagtgcagtgggccggcgcactgggaggtttgaaatctgggcctccttagcaggttggagatttatgggcctcattctttgagctccagtcagcacctctgtacatggaagggactgttctttcttggaaattagggggaaacagattggcttgaaattctgcccccccagaggatgggactgacctttgtgtgttaggactgggtgcttctctcccccaatgtggaagaaggatgcatgctagaagttttgtctgtgtctggagcagccgtgtgcctgataaggagatggctcccttgctcccgtcttgcttctgaccataatccctttaagttgggcagttggagaaggttgatttgtctccttctcttccccaccttcccttcattatttagaatgtgagggagagtttatctggttctctgggagatctatcatctcagctttggaacagcatccaggtttacagaatggaatctggtgcccagcgccttctgataaatattttgggaagtcagattccgctgacattatagtctatgggttgggcagtggatgctttcccatgtctgggtgattgaacttggactatcctcataccatgcgctgtgcaccagcttcatgctacagcgttttagcgcccagaattctggccccttttcctgcttccaaggttctgcttgtgcagtttcgcccatgagaaatgcacttattgcttctgtgttccctgcaaatacatacacccctgctttatccttggctctctgcttccttcttccctttcatgctgcctccaagttcactcacgccctccctgaagccctctctgaagctgccctccttgttcttaaaagcttccacatggctttgctaacatctttgttctgccctgggttggccaagtcaaataagtagaccctgggcaaaatccatggtctgtcaagcctcaatttccttaccaataaaatgggatggtaataatagaacccatatcccaggatgagtatgaagattaagagaatgggtgagaagccccagagcctggtgtgcagtagggttggtaattatttcactcctctcctcccacttagattgtaggctgcttgagggtagaggccagttcttactccttgttgtatcttgtgagctttttagcatggtgtcttgtctgtaggaggtccaagaacttattaagtggaaccctctggttaggagtgatggggttccttggatggaggaagtcccgcataggtggattttcaggagttttggggaagatgcagaacattgctttagcagagtggttggagccgggcgggcactgcctaccatggcagcctctgtcgtgatgcagccactgaacgtttgaaatagggcgggtctggattgggagtgctcaggggatttcaaaatcttaacgtagaaaaggaaaagtatgtcaacttttttttattaataatttaaaaaaatcacatgtaacgatagtattttgaaatgtcggtattttggatatattggcttaaataacattgttaaaattaatgtcacctgtttctttgttttttaatgtggctactagaacatttaaaattacatgtgtggcttgtattctgttcctgtcacacagcactggccttgactccatggggatgatgttgaccccaaggaggcagaaattggttcttggggggcaaaggagtcttagtctttttaagtataaaacacagatatacatccagtatataaacagatccacagaatacctgtgatattaaaatgttatggtctacacaggctctgtatgaagagggaagataatgggaactgagatacactgtactggccccagagatagccaggaccgattcagatgctggccctgccacttactagctgtgtgacctttgggcgagtgccttaacctctctgtgcctctgtttcttcatctgtaaaatggcagtgaaaatggtgcttagctcgtgaagctgtcatgtagatcagatgagaatgcctgtgaaacacttagctccgtagctagccacagaaagcaggtgatacgtaggacagttattattcacgtgctatgtgacaagcttggccagcctttggaggcagaacggggtaggacttccactcccaggatctatggagtgaccatgtctattagccttggtttttccatctgggaaatgtgttgccaggagtgcggtaacatctgtacagcaccttgtgctgagggtggaatgtggctggcaggtattggagtgatgtagcccccaccccagccatagcagccctgtgccaggcacagggaggcttctgcactgagggctggctggtggtatccttcactgggctcatggcggaccctcctgggtgtgcacctgtcccgctgtcagggccaggctgtgctggacatctcctccctggggctgcctttgaagggagagctgagaggaaagtggaggggaaggaggggctgcccatggcctgctcaacacagacagttggattaaaggtccctttcaaggccttggaaattgtcagtgacatgggctctggcctagggggctgcaggtggcagccctcctataacaaacccaaattctgtctttggagatcactgtttgagagacacagaggccagggctctgcctcctgtggggagatgtgatccggagaggggaaggtcagcaatgcagccaggatgaggacgagcagctggccgcacagcctggtggaaccagggtttgtgcacatggaggctttgggggttggtagggaccttgggagtttcaagtgctccgaagacctgggtgccctccactcactgccgctcacacacccaaacagcctgtcggaagcagccttccccaccaactcttgagacccatctgcgctcccagcctcccagtcccagtgacgggctctccattcatctgttgctcagagaggcatcctggggggtcattcctaactcctccccttccttccctgcagagctgccagatggacacctttcgtcaatctatgactctgtgaatctcagatttgcccactgctcaccatggtccccatcctcttctaagccatcatcctgttgctcctggaggactccaacagcctctgaatttcttctccctgcctcagccaggctgactttgcagaacccaatgagatccactccctctcctacttgaatctctactgcggcttcccacagtccttagaggaacatctaaattccttcccatggtccataaggctgagcacaacctgcccctttcctgcttctcatccccggccgcccttcacctcactccgtcccagccgccctgctcccttctggaacacacccatcacatgcccaactcggggcctttgcacgctctattcctgcagctggagatgcttcccagtactctcccttgttctccccagctcaccctccaggatggagctctcacatgtgccttggagcagctttcactgtggttccttctcctaacatcctgttccttctgcctccttggaatgctcaccaccattggtcatttgtgacttattcatgtggcagttgagttactgctcacctcccacaggaacagcaaggagttgtggatattgttattcacctgtggtggcagggggcagggtattgtcacccctctggtggcagggggcaggatattgtcattaactcctggggctccacagccttgcacagggcctgacacatataggcatctgttaatccttggagaatgaaagtgctttgctgtgtgctttggacaagttctttcaatctctgagcttcagctatcctgtctgtaaactagagggtgggggtagttgcttccatcttggatttttttggggaatgaaccccgtgtgttacgtgggcctggctcgatggctgggggtagtggagttgtctgctccgccctgtcttttgtgctctaactcaggggaggcggcagattggtgagaaggggttcaggggatctgctgtgggactctgggaatcagagaaatcctctctgcaccagtttgcccatctctaaaaatgagtgctgaccacccctatggttcgtcttcttacccagcttgggtgcagcacggtgtccgggcttgagcttgtccctgagtccgacagagacagatccaaagccagtttctttcaagcccaggagatgtggaggttagaaagagtgctgaccaaagtcagtctctggagccaacaggatcatgaggtcggaaggggtgctgacctgccccgtgcagaagagggtgggagagtgggctctggaatcagatgagtttgagttctgggcctgctgcctagcagttgtgcaaatgtaggcaactttcctaatgtttctgaggcctcagtctccccatctgtaaagcgaaactagtagttgaatcttcctcctggagttggtgtgtgaatcagtaaaactgtgtggcctggaggtgctcagtaaggctgctcttatgactaattatcattccctccaagaagaaagtcctttctggaagtcttttccccgccatgggaaggtctttgttatttctttctttgctggaacccgtacctctaccttcagcaccacacaatctcaatccctgtggtgcccccctgcaccctgtctggtctccaggtggctgaatgactccagctggagggttgctatggagacctcctgatgctgaagttgccctgtgggcaggtggacattccctgttccttctccccccatcaggttaaagcgaggccctttggagcttctgggctcttcttcatccccttgacctgccctgcagtgtgaagccgggtgctgcggggaaagagccagcaagtgctttctggggtcagatcagagttctgctggtctctgcccctcaggacctccccttctgggttctgcatcttggctcagagctgggagagggtcccaccctgacagccctttagaatctgagaccctttgcagatgtaccgcttcctgagggctaggaggagggtcgcaccctctctgagcttagccacttggatcttctgaatttatctggcagctgctcctaaaagtgtctctgtgtattagaatagcttggggaaaattgaataacctgggttcagctcctggtgattctgattcagttaggtgtctgagaactctcacggaaacgggttgggctggcctcagccacaggggctgagaggggagcaggggcgggggtgagggtgctgagctggcacaaacaacagctgttgactatatatgtctggggtgcagcccagcagtctctttttaacacacatgtatatgacatatatgtatgtatatataatgcatgtgtgtctatatatacatagaaattttaaaattttatgtcttttcagtactttttgaaatagtctcactcccgttttacagatggtaaaactgaggctccaagtggcagaatgtcttcttcctagtcacatgggtattgggtgatagaacttgatgctggatccaaatgcaggactgcctatgttcattctacctcaccactacctcttctgggactcaattttctctcctgtcaaatgggtatacctcccttgtcttgcccaacctcctaggtacacaggccttggacagtgggggctagggattggaaatgtgggtgtgagtcagaactgggggctgaggtgtcctgggagggcctgtttagtttggttgacatttcaaaggatgctgggcctcactggtgtcctggctgagtcgacatagccgtcttcccccagggactaaatttaggattccttgggacttggctgggcctcatcttgtttttggaaactctccattttgctcctcctgctgctggtggccgaggcccaggcacggccgaatggcagtgcagcgtggtctcgccttggattgatcttgttggagttcattagcagctggcctcgcaggcctggcctccagcgggcaggaggagctgtgcctggggcgtgccaggagccagggggtcccctccccacctccttgcctcgttgtcgtcccaggcagaggccctctgagggaggcgcttgggttttctttggcacttggtgagcaaatggctccctctcccttttcttctgagccctgtaaaaataaaaagttaaaagaccctaaagtttgaacagtaaaaccaaatacatgaaaccaagctgtttctatgtgggggccatggtctgtgaacacccaagtttgaaacttcctctccttggaatttatggaagccttggaaactttttccttttccctttaaacatcagaattggcttagggcattctttaaaagcataaccctggtgcttctcacagcttgatttaatacagcttgaatacaatagtaacttctgaacccagctgtcttctgagagagctggaaagttgtttcatgacaccagtaagtaggtgttttttttttttttcctttagccaagaagtatattctaagatttattagattctctactgccctccccctagtaacccagattttcgctggaaggaaaggaaacttgctcagatcaagttctttaactaggggctgagagatagggaggccagtcttctggggtaacgttggcactaaaagattcaccagtgcccagaggctggctggttttataggcgggtggttcacaagtgtttgcttcataggccagagccggcttagggcctggttttcagaacatcagcgcgagggtaattgtattttcggggagaaagaacaaatggggttgtctgtgttcctgggagaagggatttgaagagcccctttgacaggtgatcttgtggcaatattccccccagaaataacgtgggcctccctttccagggctccttccccgggctgtggggacggacttgctcttgaactcaggagctcgaacactgagaagtaggttatgtgctttttcattttccatctggacttagcagagggcttggtggaggctctggccagtgacctttacacatgctttttggctttagcagcataaaaatatttaattaattgccaaactttaaaaatggagacatatcacataaaaatccagatagaagaaaatggaaaatgggaaaacaccaggcctaaattctggtgtggccaccatttgttgcatcctttggagcaggggttctccatggtagcacaggacatttggcgatatctgggtacatccctcattgtcatggctgggttgggggtgctgctggcctctagcaggtggaggtcagggatactgccaaccatcctgcagtgcacaggatgtgcccctgcaacaaagagtgaccttggccccaaatgtaaacagtgccaaggtggagaaaccctgccgtaggggagcatctgggctgcagagcccaccaagcctcctacctgggctcaagaatattctagaagattctgagttcccagaattgattgctagcttcttggcttattcctgccttttgttgggactatatgctagtttgcccttactctcctgagggtcccacccaggccctgaacaggccctggtcagatggaggcttgatggtgggcagatgtgggtattgccttcgcaagcctcagagcagagctgggaggagcagctatactcacccccatgtccaattacatgaagacattcagtcactccctctcctctcctcctccagatagcaaagaagatgtaacccctagtgatggtaattcctggtttaaatattgataatgaatgactcataagattatccatccatagccagattgctatgatcaaatggtgattgttcagaagtggaagcagtgccttttgttatgtttctgattatccttggtggagagagctgggttagaggacaggatttggggtggaagcctcctgagtatcctgaaaatgcaccagaatttggcctgagagctgctgcaggaaacttggggagattgtgggtatgcctgtggcttttacggtggtgatgatttcatgggtgtacccttatccccaaattcattgagttgtatgtattaaataagtatagctttttacaagtcaatcatatctcaataaagtgcttttttttttttttttaaagaatgacttataaaaactcattttgggaaaagaagaaagttatttaccaagtatactctgtccacccacccagtgacccactgggaaggtattcctaccatccccgtcaacaggtgagggcatgaagtcaagcagcatgtgactccctgcagtcagtgatgagaggcccctgctgggccctgtgagactgcactgatggatggcctgagtccctgccttcaggaggtgcccattgtgttgcggaggccaccatacctggctggccctatacaaggcagaaagtgatttgtgggaaatgatacaaatattttacaccattcagagcaggttgggttggtggaaggaatagggtcttaagttaaaaccaagctctgcctctaccagtttcatgaccttggccaagtcactacacctcctgaccttgtggccctcacttgttgatggagatagtaggaataccttcccagcggagggttgttgggtgggtgggtagagtatatttggtaaataaccttcttttttccctaaatgagttttcataagtcattctttattttaaaaaatcactttattgagatatgattgacttgtacaaagctatgcttaattaatatatacaacttgatgggtttgggaataagcatacacttatgaaaccatcactaccatcaaggccatagacatgtctataatctgcccaagtttcctcctgccctctttattattattatttgtgtgaaagagatagagaaagaatacttaagatctgccctcttagaaaattttaaatatataatggagtactgttagctataggcacgatgctgtgcagtagatctccagaacctatttatcttgcataactgaaactttgtaccccttggccatcacccctttccatttcctcctttccctagcctctggcaaccaccgttccactctgcttctttgagtttgcccattttagattccacatataaatgagatcacgcagtatttgtctttgtaagccattcttaatcaaggtaggcatagctaagcacccaggggtcttaaagttgacctttatgtagaggcattcaggtgggaggcattgtatgtaggaggtggtgactgatctgatttagcagatagattttttcctgtattgcttttgccttgagcttcttaccccagtgaggacttattttcttgacccatgtattcttctttctttccacttgtgttttagctggggcaactctggttgttgtagtaaagacaccttgacattgaagtttagaattttatttatcactcatggaccagtccaatacaggtaccttggttggaaaatgagtgacttagtggtccaggctccttccatgttgtggcttgttcatctgtgagagcctctgagttctctgcttctacttggtgaaaggggaataagagagtagaaaaactcttcccactgcttaagatccctgactgtgaatcattctgtaccacttctgctcatgttcgattagtgagaactaatcacatggccccaccctgatgaaagaggtgctgggaaatgtagtcccatctgggcagctaccttctgctgacaactctacactgtggaagaggaagtaggaatatttgggggcaggtagccatctctgccatagtaccagcttgagtcgttgttccctttgcaggtgcccttggtacctgagcctccttttctgctggcttctgcttcttcagctggccatgtccagctccatgttccagaagattctgcctcttttactgtgcggagtgatgttcccctggggatctactagtgctctgctgagagactcacacccaggttctgatcagatacccacactgtgtacatttctcatattgcagtgtctgtcagtcagcttctgagaaatctgtgagagcagcattccatctcctatgattctgcaggtgatcaggaggccttctgcagcctgtagttctcctgggcagcttagtagctggctggcctggatgcaagaccactggctatgtctcggtcactgccttatctcatcaggggctgcttttgtctctgggaatgcaaatgtcactatgatcacctggagaagtcacttgacatccatgagcctcatctttaaaaacaaagaaagaaatatttaaataaagcctcagccacatatcacatgggctgttatgagggtctaataaggctgtcattgtgcatgtgttcctgctacacatgcactctctcagtcccacaggctgcccactatacacgcactctaacctgctacacatgcattctctcagtcccacgggctacccgctaccactctaacccgccacacatgcactgtcttactcctgcgggctacccgcaacacacgcactctaaccagccacacatgcactgtcttactcctgcaggctacccgctacacacgcactctaacccgccacgcatgcactgtcttactcctgcgggctacccgctacacacgcactctaacccgccacgcatgccctgtcttactcctgcgggctacccgctacacacgcactctaacccaccacgcatgcactgtcttactcctgcgggctacccgctacacacgcactctaaccagccacacatgcactgtcttagtcctgcgggctacccgctacacacgcactctaacccgccacgcatgcactgtcttagtcctgcgggctacccgctacacacgcactctaacccgccacgcatgcactgtcttactcctgcggggtacccactacacacgcactctaacccgccacgcatgcactgtcttagtcctgcgggctacccgctacacacgcactctaacccgccacgcatgcactgtcttactcctgcggggtacccgctacacacgcactctaacccgccacgcatgcactgtcttactcctgcgggctacccgctacacacgcactctaacccgccacgcatgcactgtcttactcctgcgggctacccgctacacacgcactctaacccgccacacatgcactgtcttactcctgtgggctgcctgctacacatgcactctaacctgccatgcatgcactctcttagtctcctgggctacctgctacacacgcactctaactcgccacacatgcactgttttggtcccacggactacctgctacacatgcactctcttggtcccatgggtacctgctgcacacgcaccctaacctgctacacacatgcactctctcagtcccacaggctaccagctacacacgcactgtcttggtcccaccggctagtcgctacacatgcactctaacccactaagcatgcaccccaacccgctacacatgcactctctcagtcccgtggactatgtcttcctttgctggcctctccaggtgggctttctgtttttagttttgatttgagaatgaattctatttctgaaaaggaccttagggagtgttgtcatgacaccatgatggatccccttgatggactggccattctggcctcacactgtgtgctcaccccttcccacacatgccagggcctgcccaaggagaggcgagggcccagtgcttagagcggtgccttagcaaaggcaaagtctgcgtctttgggaggccctcaatgcaactggcataatagcaggtacacgcagggaatgcagtacacacgctcagtgaatgcaagagaaagcactcaagagaataagggtactcaaacccttgtcaaagggttccctggccagagaagcttgggaaacgggtggcagcaccagtcgaatgagcgttactctgtcatttttggcagaaattgcaacctggtgagctgactctagctcccaggaatgttttgtttgaccctttcaattttttaaacaatttgagccaacatttaaaaatgaggaatttcactcagaactccagatttctgacttctttttaaaaattggaaaagctaatatcattggcatcaacctcttagcctggcaatattcaagtggagctgaatgtggctgtgctcttggacagggcctgtgtcccccagagcccctgcagtgcccaccaaccctgtttctcatttttctctctgtttttttcatcattgcctttgcacattggttttctatagaactatattgcttttaaataaatgtttctatttctctcataggaaacaattgctatcaaagatggaagagaaaagatgaaccaaaatggttgttttctgaaaaattagagcatatttcttcatggagatgaagagtgtttccatatgccttttatgcaaatattaaacctgcccccatttaacttatttaaataacttagctccttagctcctatgggattggggcttgcggtatctgccctgtactgatgtattgcttaccagggacaatatttcctaaatatattatcccactggagattctggggaaaaaaagattctttgcaaaattagtgttgtgaaacaattgctgcaactacccattaaataagttccttaactgcaggaattctcagagccttcactgtcttaatgtgcattgtgaatctggaatatggagttttcgtattactcaggattccttcagtttagggaccagtttcccaagcttctctggccagggagtcctttggcaaacagtgctgcagggttttgagtgctctcattctctcgggtgctttctcttgcattcactcagcatgtctattgcattcctgcctgtacctgctattatgtcagaggcatcgagggcttcccaaagatgcagactttccctttgctaaggctttgccttctgccagctcctattgctttgtgggacccctgccacttactcagaggcacctcggatggagagaactggctaaacagcaagtgtctgctatctgtggtggatttgaggccctgagtacttttggggcttccacagagctggtgatttatttttctgatccaggatgatgaggtgctgtcttgtagcagctctcagtggctgttagcttacagaggagtgggacctggggagggcagaattgtgtgtgtaggcatgcgtgccctttattgctgttagccttgatttggaaagggcagggtggttcaggaggcagagagcatgttgctgattgctcagagcaaaggattttgtgtccaggatctgagtgttgcaaggattggttgtttggggctgctggggtggaagggattgccttgttgatctctggaagctgtgtgtagttcttgcccagtaatgcgtttgtctctttgcccagccatcgtaaggcagctcatggaccagatgccagccttgatctgctgagctctctgggatgtttctgagaaggccagagtgcattgcccgcccaaggatgtctcacctaattagtccattagagtcagtgggcctcagatcatgaatctggagctgtttgctaattatgccttgaacgtggttttagttagatgattaaggactctcgcagggctgtcctccctacagcagtccctcaggtctgtgcctagagccccagccaaaatgagattcaaaatgccctgagagagagctgccccctcccacatatcctaaagtggaccctcccaggggagtctggatcttgcaggtgcccatttttagactgaggtatttgcaaagaatgtggttgcctcataccttccagacatccctgtgtatgtgcagggagaggaacattgccattcagtggtcatcccacacattcattcattctggaatggcaccttggggcactctcgtgacacagcagggattctggggttccaaggctgctacctttgtcttgatgttcatccacgaattatctgtggttctgctgggaatacaccatttgtttactcaatgcatatgctgcagacccatcccaggcctgctgcccagtgtgcattggggtaaaaatgcattattgtggccaggcgcagtggcgcacgcctgtaatcctagcactttgggaggccgaggtgggtggatcacgaggtcaggagttcgagactagcctggccaacatggtgaaaccctgactctactaaaaatacaaaacttagccagatgtggtggtgggcacctataatcccagctacttgggaggctgaggcaggagaattgcttgaaccctggaggcagaggttgcagtgagccgagattgcgcccctgcactccagcctggcgacagcgcgagactccatcccgggaaaaaaaaatgcattattgctccatttcaggatgtgtgctgctaccgacttgggtgttaggcagagggggccgcgtgtaggaggtgagaggtttggtggcttaaagtggctgcaacttgttgccctcccactgagaggtagagtttactccccacttggaatctaggtggcccctgtaactgctttaaccaacagaggcagtgggagggatgtgtaagaaagcctggcagcttttgcttttgtgcttttgagagccccaagctgccctatgagaggtccagctaccttgctggagaaactacttggagaggtcacgtggagagtgaggctctgagaccgaacaggacaagagagaggcccagttctcccaatgtcccaattagtgtcccagctgagcccagccttccagccacccctaccaaggcgtcagacatgagccatttggggtattccagaccagacaaactcctgatgacagcagccccagccttcctccccctgcaaccacacaagactcaggagctaccagcacaactgcccagctgaggccagtctgcccaaagcatcaggaaagatagtaaaatgatggttttaagtcactaagttcaggagcggttttttttacacaatgatggatagctgacacagaggtgtagcttcatgtcaggctggcatggaagaaagatgccgtgtcccctggcacatggtagagcattgccttttaagtatataaaagaggagaacagatcaataaagggttccatttaaaggacatgacacaggtgtgatggagcgagtagagttgtgactcctgatgtggcttgatcccttcatgggtattgtcaagaattctaaaatttgaatcctgatctaaacacagtaactttttgacaatccctcatttaaagcaaaccctttgatttaaatgtctttctcactcattctcttaattctcaggcagttattttcttgtgtcaaaagagaacaggcagtgcagttggcatatcagttagctgttgccatgttgcaaaccaccctaagacttagttattcctcccacatctgcgagtaggtgggagctgtatggacctgggctgggttgatctgggctgggcttgctcatgcttcaagacagttggccacagcttcctggtctagatcagaattggctgggaccagtggcctctccttgttgtgtatgtcctatccctccagcaggccaggcgtttcttattgcagggacagggtctgagagaggaagtggactccccagtgccttatcaagtttctgtatcacattcactaccgtcccgtctgctagagcaagtcacgtggctaagcccagtctcagtgtgggagggctcccccaaaagggtatggaatcagttaggcatgaacaaattagtacatgaatgtaatcagcctgccccagtttggttgaagggtcttttcccagcccataggtcctagaattgggcaaggtcctacctttgctgctttccaaatgtgtaactttggggcattatttaacctgtgcctcagttttctcatctgtaaaatgggtatgataatagaagggatgttgcaagggtttgaaaaggggataaatgtaaagcatgtggcacagtgtctggcacagagtagccgttggtaaatgttagcaattattaaaataccagccagcttataagcaacccaaggccataggcacatggagaattgagagctactggggctgtttggtttctttcccttgacctccatggataaacaagggtctctttcatttaggatgtcacctgctgagccctttatgagtgtggacagcagcttcttgacacccctacacttaccctatagcacctgtgtatctgagggctctgggctgtcgtctgtagatcgtaatgaggcccaggcgcccagactgaggtccgagatgtgggcctggctgcacggacccccgattgaaggcacctgctgccgagcccaggcatggcattttcccttgctgtcctcaggagtccgagtgctgccagatttggggtatgctgctttggagaacagagaggattcttttttgttaatttttctgtaaaacttgttctttcatgggatttccttccagtccctggagaaggtcacaaaggaggtggatggggaaacctgtcattagattccgattttgaacatgtagtacctgccactgtccaggtgcagaggaaccaagggggatagctaaagtccctcatgggtgcttgtactgattacgtggctggggcaggagctggggatgctggcacttcccaattcctgggctcaggggctggtagggccttggtgggagcagaggagaaggcgcccggcagctgggctctgtcagccgcatggagacgtgaaccctgccggccaaggaattcggggcctgagtctgagaggctgctttggacgtgcatcctgggccttggaagaatctgagtgccctgggcagcaggcccgatgggggacgtggggcccggatgccgggaactgaaagctggcctgacttctgaggccgtggagctggctctccagaggccttgctgcctccaagatccagccgccaagcgtttacccaggcagggccttccccacgccccaagtcattcccgccccagccctcagagtcttgcattcctcctctctgtacctcctcctcctgggctggacactgtgctctgtgacactgtggtcttgtttccattgggagtttggtaatagtaataactgatagcagtgggaaggaccgtgataacagctagcattgaacaagtgacccctgggtgtcacagacgtgctgatcactgtgtgtttgtcatttcatcgagtctgtgccctgtttaacggacatactcagtaaagcaccctcttcacaagggttctgttcctgtccactgttggtgttccttggatgtggtgcttacagcatgctaggcattgctctaaggtttcacgaggcagggattcttctcatcttcatgttccagacaagaatataaggctcagggaggtcttagattcaccctccacccagggtggagctgaaagtttgaccccggtggtcagactctgaccctcagccctgctgcctccatgccaggtccatttccctggcctttgacattttagaaggcaaattcccaacaaagttttttcattttcacctcgttcttctgtgaacagagcaaaacttgcagtcacttgtagataccagcacgtgggatctggttagtcaaggtggtggcccactggtgagtggatgggggacttcttcaaagagtttccctgtttgagaaagcgtggatcactgagtcacagaggcgtctccttgtttgggcggggggtgggtggctgtctccctacctcccctcccatctccagccaggggtcatttagctctgcttattacctgaggaccaccgtgagccacgtgtctgcagtctaggttgagggaggtgctggggctgaagggttaataataggccccatcttctgttccgacttttgagaccacagaggtttcctagtatgtcataggccatagcaacccacaggcagcttttggtggggaatgggagcacacccaccttctggttcccagtagatatagaagatgccttcctggccttgcaattagagagaaaagttcaacccatcaagactgactcctttgtgaaatgggaatcctcttctgtgcatcctgtacagaaggcctcccagcatctgcttggatacctcctgtgacaggaagctcactcccttgattgtcctttgttggacaactctagctcctggaatgatagagaatttgggccttatgtgtcattagtcctgctctgccttcaagaaatatggagaattgtccttcttcctctggtgagggagtcattctctccctgtctgaaggcaggaagctggcttcttccatcccatctctcaggtcgtcgtgagttctcactgttccttgaggtcctaccccttcaccattatgccatcagctccacgactcgaaagctgtgtggatataaagtactcacatgtattaaaatagggcttggtacgtgctaggtatatcaatattagctgtaatcatgcagtcatctttctggtcatccctataccagggtctctcaaacttgaatgtgtatatgaattgtgtggggatgatgcaaaaatgcagattctgattttgtagggtagatggggcctgagactctgcatttctgaccacttcctagactatgtcaagactgctagcccttagtccacactttgaatcgcaaggctggtgtagctatgtctttctttatatatgagattttgtttgcaggtggcacctaacctagtagaaaatagtagaatcgtcacctcccaaaatataggtgtaatacttctattaacatagcccaacattgtattactttggggggaaaagcattatctaggctttccacgtaacttttgttctctggcttctatgtctgacatggaaaaattgctctgcagtttgcatatatcttgatggatctgaaagaaggtgtgggtcactaaggagagatgctttacctctggacttccctctgcttctacagctgggatgtatcatggacctaagtccagagttgaatcagtaaatggaatcccaaagagttccctagagcagggatccccaaaccctgggccaagggtgggtacaggtctgtggcctattaggaactgggcagcactacaggaggtgagcgtctgagctctgcctcctgtcaaaatcagcagtggtattagattctcacagaagtgcaaaccctatcgtgaactgtgcatacaagggatccaggttgtgtgctccttatggaaatctatcaaatgcctcatgatctgaggtggaacagtttcatcccgaaaccgtctgccgacccctctccctttgcccccatccatggaaaaattgtcttccataaaaccggtccctggtgccaaaaaggttggggatcactgccctagtgcagatgtcctcagggcaggtgtggctgatttgggtggacagcaaatgaaacgggaatggctggtggcctggtactgatgggattccttaatgtccaggccacattcatacatggaaaggaaaacttacacccttcagtattttgtttattgctcagttcattcaacttacatatctaatagaggaaccagtatttcttaaagatttaaatgctgatttcaagttaacttaaataactgggactgagactgcaagtttagaatgacaggtcacataccctaacagcaggtaacggtagttatcagcttgtctgcccttgcaaataagcccatgccaaagctatgctgttgaggctatagctttaatccattgttttgccattgtttctgcatctgaccccactgggctgagatctgttcttggctgaaatgaagcagcagctcagcagggtggctagagctcagcctcatgcccaggtaggctgggttgaaatcccagtgctgccacttgttagctacttgttcaagtttcttttcttttcttttcttctgcttttttttttttttttttttttttgacagagtcttgctctgttgcccaggttggagagcagtggtgtgatctcggttcactgcaacctccacctcctgggttcaagagagttcttccacctcagcttcccgattagctgggattaccagcgcccgccatcatgcccggctaatttttgtatttttggtagagatggggtttcaccatgttggccaggctggtctcaaactcctgacgtcaagggatccacctgcctcagcctcccaaagtgctgggattacaggcgtgagccaccatgcctggcctcatatttcttaactactgtctgcctcagtttccttgtttgtagaatggggaagtagcaacgtctgcctcatggttgttgtgacgattaaatgagttataaacatggggcgcttgggagggcatctggcacatggtcagtgcggcacaccatttggtcttcctattttgctgtgacctcactgtgcctaaaggaaacctaatgtcctctccgaccccagcactcagatcttcctcgttgcgcggtgactcttggtgagccttgggcctggctgcttctcccaagatggtttaaactcaagcccctgttctttagactaagttcccctttttaatactatttctcatagaacatttcagacagacacgaaagtagagagaatacggaaatgagtttcctcgcgccagtccctcagacgcaagcaccagtcgagtttcttgacttcctttttaagcattaaacttcactggtggtgaaaaagagctttttaagcccacgccttcctcatgggttttgtttggttttgcttttctatagcccagcatgccctgaggtgctgcacggtggaagctctgggcagctggcacttgcagcccactctagtcagcctggtcgggggcaccattaagacagggctgtgccttgctagttccaacctgtaattagtggagccgccccgagggttcatccctccagaggtggtggcccaagtctgggtagttcacgctcccctataaaggcagcgggcaaatggatcatgttggaggcctttgctgaatgctttcttttcttttctcttctcttctcttctcttctnnnnnnnnnnnnnnnnnnnntctctcctctcctctcctctcctctcctctcctctcctctcctctcctctcctctcctctcctctcttttctcttctcttttttttccttttctctttttgagacagggtcttgctctgttgttcaggctggagtgcaatggcaccatcccagctgacggcagcctcccattcctgagctcaagcaatcctcctgcctcagcctcctgagtagctgggactacagttgcatgccaccatgccaggctaatttttaaattttttgtagacaggtcttgctatgattcccaggctggtcttgaacccctgggctcaagtgatcctcctgccttggcctcccaaagtgctgggattacaggaatgagccactgtgcctggccctgaacactcttttgaccttgatactataggtgacctctcctgccaatccagctttcccatttttggaggaggcccaaccttttccagaactcttgggcttaacctcatctccccatactgatacttttgtgtttgttcaaataatattagaacacatcagatcctcatgtaagtctggcctatgcctgatggaggaagaaaaaaatccccacatgtgttcacaccctcctatatgttaaaaccaacgaatgctaaagatgtttagaaacagtcatccttctttttcttgagatggtcatccttcttttacattacaagtgtgtctttatgtactttatattcaccttcatttttatttatttaacaagcatttatatggtgcttctaaggaactaggtattgttttccaagcgctttacaaatgtgagctaatttaatgctcccagcaactccacaaggcagatattattatttgcccatcatacagaggaggaaactaaggtacaaagaagtttattagtttgcccagcatcacacaacctgtaggtgacagagccaggacccaagcctcaggccatgtgggggcatggtctgggccccacaccacctggcaatgccgtttgctcctttactgccattatgagtttgtggccattagcattaagccttttttttgttgttgttgttgttgagatggagtctcactttgttgcccaggctggagtgcagtggcacaatctcggctcactgcaacctccacctccaaggttcaagtgattcttctgcctcagcttcctgagtagctggtagctgggattacaggtgcctgccaccatgcccagctatttttttttttcagtagagacggagtttaaccttgttggccaggctggtctcgaactcctgacctcaagtcatctgcctgcctcagcctcccaaagtgctggtattacaggtgtgagtcactgtgcccggccagaatgaagcctctttttaaattaacctgataattcttttttgaggtactgactgttaggctgaggctgatggggtccttcctggtgttccatgcaggtagatatttgccgtttgttcctcagcctgtgagctgcgcttctctctccatctgtagccactgtggctcccctgtgggcagggtgtctggcgctgggagggttgggtgctgggttgatgcagagttgagggaagcattcacatccacacttttctttccttctcctcaaaatacttttgcctcctgagacagacggtactgaggacggatcattggctttgcaagtgggcagtggcccttctgggtggcctgaagacagcagaggaggaacggagcctggggcctggctgaattggccctctcctgagcctgtggagtcatgctctattgtagcagtaaagtctttggagataccctcttgccatgcttcctctttttgtacagatgaggaaactgaggcagaccacccagctcccaggctagcatttttccctaccataaccatttgtttcccagtgagctggactgagaagctacagcaagacttcagagggttttgagttgattgaagcacggagccagtgaaggctgtggagccaggaaggggccctgtgaaaataaaatgagcgtgcgccacctgggctggggtgcgagccagggagctggtgtggcaatgcgttctccaggtaattgacctcaggctatatgcctggctgaaccaagaaataggtggggtggctgcccggggataggcaggaaagctgtgtgggcgggggccaagcaacccaaggggaccctgtctgcttgtgtgtggaacaacctgggctgtgtgtgggatgtgatggccttggtctcagattggagaagcccattgcacctgccccatttgcattctgggcagtgacttggctgccgctgaggacagagctggctaaggccacagggagacgccaggcctgtgttttgagcaggggccagggctggatgctggaataggcagccggctcaggtccagtccacgttggccttggatcaatgaaagctgtcccaaggccagcgcgttgctgctgccgccgcctgggggctgctggactgggcggggccttctaaggccactgtccccgagtcactggctctgagaacattgccagcatgtcctgggcccactgggggtgggtcctagccctgccccatgccctccccactccatgattcatagtttcacttgtccctgcctggcatcgcagccaggatggttttatcgatgcacagagaaaatacagagcctgcagagaggaggaagagagggttagcggtgtccttttttgtctgctattttatgtgtcgttttccaggcaccatgccagctctgtaagggccttcagtaatgagggagaaatgtacggaccctgtcctcaacgagtttagccggctggggagcctgcaagccacaagtagttgtctcacagagcgccaaaggctgcaaggaggatgcagagtggggcccgcacagagcccggggctccagggatggcttctctgagactggaagaatgaattaggaggcagcgagaagcagcgagtaggggagcatcctgcacagagggtggtgatggggagggggagggggcggaattgaaggcatgggctgtgggggagggctagtgcagaagcgggtggagacaggcagggtcagttgtagggacggcatccctggtccctttacccagggcagttccagtctctcccaacctgggtatgaacagcactccctttgtctctctaaagtgtcctggttaaggcactagcattatatgggcagtccaggtataagtacctatgtttatctcacaaatagggaaaccaaggctcatggagagtttgttgtgcaaggacttggaacgaggatggaaccgagtggggccgggaactgtgcctgcttgactggagagctcaggctctcccatcgccccacaccatcctccttagtgaaattaaacatgttctctgagcatagactctgcccagcctcatgcccaggtggcaagggtgaggaggagcgagtgagcaggactcactcactggcttatgaggagaataagctcaccctggcttaagccaaaaggggagattttgtggtccacgtcattgaaaaatgtaggggaggtactagcttcaggcaccatttgatccaggggctcaaatgatgtcaggaccccttttgcatcccctcgtggctctgttttcctgggtattagcttttttcatagctagaatttctctgtgaggtggtaaagtgctctcagcagggtcaggctctcagctcacatctcaccaaagtcaacagagagaaagaagatgtcctggggttgcctctccttggcatagcttgggttgtgtgcccggccctgaccagtccccatggctggcgtggtgcgaagctcttactgggcaggcctgggtcatgtgccctccctggtggttacggggagaaatcagcctgcccacaccatgtgggtgagaggaatggaggggcagggtttccagataaaatataggacacacagttaaatttgaatttcagataaatagcacttcatttttttgtgttttaagtctatcccaaatactacatgggacatacttatgctacacagtgatctgttatctgatattcaaacttaactgaatgtcctatgtttttatttgtgaggtctagaaagccgccagggaaaatcaaagtgttcccagaagaaggaggaagggggcgctggagaccaggggcttctgaatttcagatgcccactgcaggagccagatgagggacaaagagcttcctacagcctcggcttcctcccaaacttacagtctgtgaagccagcctgaaacgcgctggctgaatgagagaggttcctggggcacaaggtgcttagaacaagcttcttgcacttgaattaggctctgaaagatggggagggggtttcctgaagtggggctggcatggggtggggtggggtgggaagaaaatgtccatttccatttttctgcctctcaggcctgagccctggcatcagggtccctggcctctcacgtagctggattggccacagtgtgaccattgcctttctgggctggactgatgttccacctgctttgtctgagaccaaccagcttgcaattcattggcctgcctactccctgtgaattcaccaagtgggtcaggattcctccaactacccgcgtagttcaggggagagccctgtgaggtcagggactgcagaaacagagcctgaggtgagggtcacgtgctagtgattcactcaggacactgtcccagggcagggcaggccagtgaggcagtggaggaagcaggacagacaagaggaagaagccaagcacaggtgccatttcaggcaaagtcttggcttcagtctgaccctctgggggagctctggggtataaattatgcttctgagtttgtcgtgacaggaggtatgggctttcattctcctgcaccaggctcagggccacctggggtggggacacggcagttctctgagtctgcagacatagccctagggcaggcctctgaagagggcccccaggtgtgagctgctggtggggagcacatagggaagggaggggggcacacagacccggggggatctgcacgtgcacacggtgccctggggaggtggactgctatcaaagggtctaaagaagtaaggagacccctgatctgtgagcacctcgtgggaggcctgctacaggtggtctggaaaggcttgagaagtccacgcagcattccccaaacgtcctgggcccccatgcctggacccactacgttttcctttgaaatgtttggttgcctgagacagtgcttgtggagaaaccgtccaaaggtgggcttgttggtctgggtgctccagcccttggcagtcagggtgtgtgggggctcttgtcctgtgcctctgctccccgagggaactcatcgctcgctggttctttgctaccagctgtgggtcctctatattcggatcctggctctgctcctctttggctttgtgaccctgggtaagtcctgtccctttttgagcccttagtttccccatctggactctcagaggttcctaaactaaaattcacaaaaggacttgtagtggggaggttcatgaaccccctgaaattcaatgtgcaattttctttgcatggcatttttctagggggacattctcagaggggctgggtccttcttgcaggtcagaacctctgaacaaaggctctggcctggcctgatgctggtggtcctggtggaaatgtggggctcagacagcagaggcctctcttccagatccaggaacacccaggggcatgtcctgagagccctggccttcctctcgggagtgctccgtttctcccagccttaccactctcttgcctcccctatgactctaagtctccccatctgtaaaaacagcaatagctcacacgtggacctcctggggttgttgggtgaggtacaagtgtgatgggtgaggtacaggtgtgatgggtggagtcactgccatgaagaccttcttatccccaggcccaagagtggcctcaaaccttccatgctgaccatacggactctcccagacctcactggcttcccaggtgaccaccctgtggtgacacgggcccctgatgtgggctgttgactggacctgcaggggcaggcagtggccttctagatccccatactttttgctttgagatctttggttgcctgagaatggcaacagcaaaatttggtgtgtgctggttgggatgggcaggagagagtgccaccctgctccccctgagcccccgatgacagcctggcttgcatgctcagctggtctcatgccatttctggaatcaaagcgctgtctgcattacacagcccctggcttcctatgcatgtacagtgagagcagtgagaagcaggcatgggtgtggctgtggcctctttgtggcctgggtgcactgtgtggctgtggaagggagcaatggggtctgggtggaccaaagtctggagtctccaccttccctcccagctggaatcaggaggccacccatttcaccagaatgctgtaggtcttgccactgctagggccaagacccttttagcagacttctgagtgtgagtctttctagaaccaacttgggtgcccatttttgtatgttttagcattttttttttccttcaaaacactttgctgtaatttctgattgtagaagtaatcatgtgtgttcatggaagaccattgggtgacctggaatccagcaccgggcaccatttctgggagcattttggtgcccgtctctgcagacgtgtgcctcctactacagcgcgtggaaacacgtgcagataatgttaggaaatgtaatcacattttctctgctgtttggcaactacttttttctttcaagaaaatgcagggcgtgtttttctgagtcagtaaatacagagctgcatttggtggttcaacacacgctggtcgagtgcctccgccgtcaggcgttgatacataatgtgtcagatggtgggaatgccccagagataaataagggattgtgggagagggggctgcagttttaaataaagagatttgggaagacctcacctaggtgacaaggtgataatgaacccaaacctgaaggaggggcaggagggaggggttatccagaggaagagtcttccgggtagagggaacagcgtgtgtgaagaccctgaatggggaatgagctgaacctgttggagaaacagcaaggacgcctgtgtggctgtgggcgagcgggtgaatggggaggaacagaaggggtgagggaggtgatagggcagacaaattgggtggggctttgatgggctttggtgggactttggggaattgggtaggggttggggtggcgacgagggcagagaatagaaaatggttgtcattattcaagaggactgtggcctggaatgcgtggcagaagtggaggaggtggcaatgattggtttcagggtgtgttttgagggagagccaacaggatgtgcggaagcctctggggtgtctggccagagtgaaggaagcagggagctgccctgtgtacacagggaaggcactggggaggacaggtttgggggccgccaggcgtccggtttggacacatgaagtttgaggtgcctgttgagcaacttggtgacatcaaacaggagggagagccacatcatttgttttaatggaaaaaccgctttggaaaaagttattattatttttttcagtataaaagggttgaatgttcttggtttaaaaagagagaatataaatataaaattcaaatcacccagaaaatcagacagctgaaggagacagcgccccagttcccatttctgaagtggagcgtggccttccagaaacattctggaaaacgcacctttttgtttatcaacagcacaggagcggactaggctgctcctcagcagcttcctatctgacagcactgtggaccctgggccctcattcccaaatggcccctctcaccttctcggcttttccacacccacctttggtgtgatcatcgtgcactgctgcgtggcaggcgggtgggattggtgccctcattttatagatgtggccactgaggctttcgatcacagccctggcagcatgcgaactgctgagtttcagaatgaaccgagtcctctggaagccgccagtgtgaccctcttgattatgtcctcatctggtggttggggatggtgggaagtcgaaatccacagtggctccggaggaggcaaaagacttcactggcagtagagggaggagggcgctccgggtgaaggggacaggatggtccagggctgggaggctccaagtgggcggtctggcctgtgagagggatggtgacaagtttcttagagctattttggggacaaggggacagaaggggccaggagatgagagtgggaggcccagggctgatgggatcagagtgggtaggagcatggcttctgcaagatggtttctccagggcactgcagggccgcatgggtggactctgtgtgtgtgtgtgtgtgtgtgtgtgtgtgtgtgtgcgcgcacacctgtgctcatggacactcttgtcctgtccgtaaaatgaggcctcagggtataggaatcaagaggctcttacttcatctgtttcgtttaggttcagaaaagcaagaagctcaagcccttcattcctgaggctgagcaagaaattccaggcttcttgggtccccaagccccttccctgggcaggagcacacatcctttccccacagtgaggtggcctatggctatggggcacccttccttggggccagatgacagtgctgcctgtcataagcagcctggctcagggccaccctgtcggcaggtcacacgtgctagaccctggcagcagaccgggggcctgtcccagggccaggaactgctggcagatgccgccccagctgcttggtgatcagaggcacgccacaggccctcgggcctctcctcttatcagcactcggctgtgtggcgtggcgggccagtggctgggctagtcagcagtgtggcaggtggtggcatggtggggccagtggtgtggtgggcagtggtgtggcaggatcagtggtgcgatgtgcagtggcatggtagagtcagtggtgcaatgttcagtggtgtggcgggcagtggtggggcaggatcagtggtgtggtggggtcagtggtgtggtgggcagtggtggggcaggatcagtggtgtggtggggtcagtggtgtggtgggcagtggcttagagaggtcagtggtgggtgggaaggccgtgtgtgtgtggtcagcagtgggtgggagggcagagactccgacaagcgctgagtgcactctctctgctctctgcagccggccagaagtggggtcgcctgaggccttctggggtgatgaggcagtgctgggctgggctttgatccgctgtggcatccctgacaaaaaccagggcagaagagagcatgtgagggaagagaatgaaagaccagggcccggagggagaaggaggtgacagctgtgacttgggacacgctatttgagccaggccactcaccaagcactgtacacatactctccattcctctcacaactgccctgccaggtgggggctgtcatttccactttcagctggggaaactgaggcatagtcaggtagactcatttgtacaaagtcacacagtataaaagcagaagaaccaaggctcaaacccagacctgactgacaactcgagtgagtcacttaacctctctaagcctcagtttcctcatggccaaagtgggggtcatcgcagagcccagcttctagggctgctgggagcacttggtcggtgatgcccctaacgtgcttcatggaacacttggcagatgtcgcacactgactaagactggttatcatcatcactgagtcctttatattcatgacctcagttacccccaggccccaacatgcccatcagatcccagtttccactgtagaaatgcctttgaacactgtctagtcggaaaattgtggtcagacaaacagcaaagtctccccaccccgtgccctgcctggctctgggcaattggccctacattggttcatctcttaagggctctgaaatgccagcagtttgagatcagggagcattctgggtgatgtcaagatttactcttttctgttgttggtgttggtgttttgggttttttttcccccattagtcattttttctccatgctcagaaatcacactgaagccatgagtcttcaaggagggtggccaggtgggaaggttggtggcatctcctggtgcccaccttgtctggtgtctctcccccacccaccgtcttcctacttattggaaccagcctgaccactgtgggggccagggggtaggttctttaaatcctgtctttccgaaagcatggttcaatggttgatgtcctattgaggggttggaggggcaagtggtgggtgtcttatattttaatgattctgaatttgttcaatatgaattgtccttaaaaaaacaaaacaaaacaaacaaacaaacaaacaacaaaaaacacctaacctggacaacatagcgagactgtgtctctacaaaaagttttaaaaaattagctgggtacggtggcctgtgtcggtgggagtcgcagatactcaggagagtcacttgagcccaggagttggaggctgcagtgagctgtgatcatgcgactgcactccatcctgggggacagagtgagacccccatctaagaaccaaaccaaaccaaaccaaggcccccaacacctgtgattttattgatcttattgctttatggcaagactaggttaaaaagagagagagagccaatttaaagagaagcatttaagtactcatggtagcccagagacatggctctggaggaaggcgcgaccatggcatgtggatgcctgcgacttgctggtgtgacagcccaggaagtggcctttgctggccctttggtgactgaggctggctgaggttcaggattgggcaacccgtctctagggattatgagtaccctgtcgggtctcaggcctgagggctggaggaagggagtatggtggtttcagagtcaggcccagggtctgaagtccttcctgccagccctgccgtcccactccttgctggctgtccaccttccctgtgcaaactctcaagcccaggaagcaggctcaggctggggtccccaggatgtggggagctgaaggccggggatctacagttaggagcatgtcgattgcatcttgggcagataaaaatagtccaggagaaatctgaggaattttaattgctgctcaatgtctttggcgtcttgaaggcctggtccttgcaggccaaatacaaaaggcctggtctgtgtgtgcagccccaggagcctgtcttccctctcgcctcagcctccgcagctctgagtggagtctgcgggtgaagctcctgcaggggcccgcgatacagcagggcagcaggagctcgctccactggctcccaagcttgcctgggaatcctggatttagctttgaggaggctgtggattgcttctgggagctgtgggagtcagagcttttagttgcaagtaacggaaacccaacctgaattgctggaagcagcaaaggccgtttagtggcttctgtgaccgtcccatcggtaggaagggcgggttagggtgggcctgccccagggttcaccgaacagacactttttcgagtgcctgcgtggtaccaggcgctgtttgagggcaaaacagacccagagtcctgcccacaggcagcctccttctggagaaggctgggcctgaggctggtcccagtactggcctctgtctctgtgtgagctgcctccttgagtgagctgtctctgagaagctgccgatgagatgagatgcagccttggcaccagagaagagctcgtccccgtcagctcccgagggaggggtcccaggagagggttccaattggcttggctgcatccaggggacaggcctggtgggcagagccaggagccaccaccaggtgacctgtggctgtggtgggctcaggggtcttcaggggagtggctgaggactctgccctatattttggctcctttggaaagagatgccatttatctttggaagcagcatgttgaggcctgggttctgatgacccaggcaaggaggggcgggtctgttttcctctcctggggaggaggatgcccccagcctctcccatccctgggtccaggcctccaggagccctctcaaaaggctgcctgccatgccctctttccatctctctgccctttgatgaggattatttttgtatcactggcctgcatgttgtatagtgttgggatgggctgggtaatttcctagcactttcagcctgccgagcttgtaggcagagtgggctctggaggcccaggaaagccctgggggcctgggaatgagagggaggctgtgtgggcagagataacaggtccgcaggggagaggtatatgtgagagacatagaacttgaggcccagaaaatggacagccccggtcttcctcttgtttcctgggtatagccctagagaagagatctgcccattgatgggatgcgggctggaaccccagaaggtctgtgctccagggaactgtgagcatcatcttgtctggcctccctattctagagacgagggggccgaggcctggagggggctacctgactctgttgctttccatgaaaccttggacttgttacttaatctcccagcttttgttttcttttgtaaagtgggttattatctgcagttttactaaattgggttttaattacccaagtaatatactcatcagttaaacatgagaacacttctgataaggctggggtttatgaccccccccacaccctctgcctctgtctgccctcccctctctggaagtcaccgtggctgtcgtcttccgcatgttcacccacacggggacaatctcatggcatacatgggtttggtgctctcctctgtgtacaggtagcagcacagtctgcgtgtcttcctgtgagggctcctttgcctgtcctgtggtctggccctctgcccgggagatctgcaggtctgtcttgttctgttggcgtccctctcgtgtggcactcctctgcagagatccagcccacatgcctttgagggcatccagggtgttcctgactgcaggttaacaggaagtgcattgccctaaacatcactggattcgaatgtgcctcctggacacacatgtgagcatcgtcccagggtggacattgaggcactggctcgccaggcattaggatggaatgtgagaatgttcccgagcctgtgttgggaagaggagagaaactgatgttagtgcttccagcttcgcatcagacaccatcctaggcatgttgtctatgttttctcattgactgctctttgacatcaaaatcctcattttacagaaggggaaaatggaggccggagaaattaagtaatgtgtctgctgccactcggctgctgagggtgggactgggcccggagcctgggcgtcccgactgccaggtcgatctggacgctgaggagtggagcatccctgtcctgcctcccgagaggggacaagaggaaggcaagagcttgctctcagcaaggccttgagagcgcctggccaggctgcagcctcagtgtgctgggaagagagaactcgccaggaatttcctggggcagctccagggtaggctgctcggatctaagggttacagggtggcctaggccctgcccccctcctctttccccggcacatcccaaccctgtacattcttggaatctgtaagttgtgccgtgttctgtgggcaccgggagtttgctttgaaacccgtggcaccaacatctgttagctcttagagaacagaaagattgacaaagcactgctggggcaggcagtgggggaagatgttacattcagaagtaggaagtctcaaagacagaggaaaaaccccaaccaaactccagctcgctccccaaggctgctttgatgtggttttcccatccccggaggccttataaggtatcgtgcctggattctgggctctggactggtgctggctgcacaccctgtgcccggaggagctggcctctcttcctggggcccagtgtagagcaggggaggggctcccagggccagctgatggggcaccactgggacttaggaaggtagcacatctgggcatgtggcctgaggggccaccaatccaggccattagacaggagcagcccagccccaggtcaggtggagcagaggccctggagacccaggaaggtctttgatcagaacttgcagcagaggctaaggcccactgtcctggaggccagaggggaggggcctgggatcacagagtgacaactaagtagacaaaataagtggaggagggtcaccactgcagccaagccccacatgtgggtttcccaggtgcagtggtgaagggtatggactcaggctctggcacttactagctgtgtgaccttgggcaagtcacttaacctctctgtgcctcactcatctcatctgtaaaacagggtaatcatggcagtcctttggaatacctgaaaggattgacacaagggtgaaatgcagtcctctgaaaacaagtgttctgggcaggatggggcatgtttccaggtgtctgtgagggcacctggggtctggcgagtctctcggcttgtcccagcagtgttctggtcaccatacaataacaatagcaggagtaataaacagtaactactgacctaatgaaccccactcatgctttcagctgccctgctaagcgcttcacatgcaatgacttcctcactcctcacagccccaccccctccagatatccttattgctgtcgcccctgtttacgaatggggagactgaggtgcactagagataaagttccttccccaaggtggtgcagcatgtgtgaagcagagctgggatttgaaccaaggtctgacccctccagttccatgccctctgcacaggggcttccagtggcgccgtcgaagttctgaatatgtctcctggcaacacctgccttcccgaaggatggtgccaagggcctggccctggccctgacatgtggggctgccagccagggctcagcttgagggcagggccaagtccccaagttgtggggaggagcaggggagctttgagtcctgctaggcagatgggaacccttgaccacttacccactagagctgccagctgggctatttttcttgcactcctttaggtgtgatccttggtccctggtaggtgccaggactcctgaccacctctgctcccatgcccacaggagccctggttgcatgagtaggagcccgggctgaggcatctgaaggagctggctcaagtccccgctccgccccttgctggcaggtgatccaaagggggtctcacagcctcttggagcctcctagccacttagatgcagggctgtggggaggccattctccagagtctcccgtgaagatcccattggtcagcacctcgtacactgtgagcacttggtagatgacgggtgactgtcattagaactgtttctggtctcatacagtacttcagggttgaggccactttctttgtagaaaataacagtaatgattatacctctcgctttacaatttgcaaatcattttaataagcatctatttcttgaaagatggaaagaccagggctgttgtgatgattcagggggctaataaatacacgcttacacagttggccctccttatccatgggctatgtatttgttgattcagccaaccatagatagaaaatatttggaaacaaaaaagcatccgtactgaacacatacagacttttcttgtccttattccctaagcaatacagtttaacaaccatctccatagcatttacactgtgttaggtattgtaagtaatctagaggtgatttaaagtatagggcaggatgtttgtagtttatatgcaaatactacaccatttatataagggacttgagcatctacagattttgatagcctcagggagttttggaaccagtcgcccacaggtactgaggaatgactataaagtgcctagcatcgtgcctgacacatggaaaatgcacagtaagtgtcagctgtttgattattattatggttgatgactgtgcccattttacaaataagtaggctgaggtccaaaggcgaggcaggcggtacagccagcatgtgattctgtgtttggctcaacatcccgcgtggcttctggcctagagactcaaagctctaggaacatgcacgctgcacgccacagaccctgggccgtgtggctcagtgggggagatgaatttttttttttttttttgagacagagtctcacactgtcacctgggctggagtgcagtggcgcaatctcagctcaccacagcctccacctcccagtttcaagcgattcttctgcctcagccccccaagtagttgggattacagtcacctgccactacgcctggctaattttttgtatttttagcagagatggggtttcattatgttggccaggttgcctgacctcgtgatccacctgcctcggcctcccgaagtgctaggattacaggcgtgagccactgcgcctggctggggagatgaatttttgcaaagttgagcattggcacagtacagtgcgtccatgaaccatggctccggggagctttccagtgttctccagagcagggtactgttgagtggtgagaggcctatgccagaacttgccagaactctgctttctgagtgtgtcagagagcttggttctccgagcagggagtgctgaagctgtcattaggtggtgactggggtgccttgagcacatgcggtcattgtcatagggtcccacacggctgccttgttggtggcgatgtctggagtctttaaactcttccaagtgtgccagtaaaaagacacgagtactcagacgtctcattgatgctgtcacccggctgcagtgcagtcagggtggcaggcgcagagccccgctctgcagaagacctcagcatgaagaggtgcgcagattctcttgaagactgttgcctgttccctcggggaagctctgcctaccagcctttcagggggcggtggcacccgtctctcttctgcatgaaagatgggcttcaattggctgctggggcgtcccagccatctaatgatgccacctgtgtgcatccctttcctgtcatcgtctcccagctcccctgtcaactcgggctctgttaacacaaacagccagtttacaagcccaggatatgttcgatgattataataattggtggaggaggagaggaagccatcctgactcgaggaataaagtagcctggttttgaagtaaatgggacaccggagtctgaatggccacattttaacagcttttaagaaagagtgtgtaatgccctagaaagatttgaaagaagaaagagaacagccacaaaatgttagctgtttgtctttaaaacaaaaaacaaaaaaaagcaagaggcttacctccagctgtgtccagttgatgagatcagcaatacaaagccgtgttttttcttttgttcatcaagaagaggactggtttttttttaagcatcatctgaggtgtagaattttttttcccctaaggagagggttgggttttgtttttgtttttgttttttttctcttttattttcacaaagagaagttggtgacagctgctgagtttgggcttttttattgcttgtcattttgtgttttgagaaccgctaccatagcatcatcatcccccaaacccttgtctgtcctcccataacaggagtatttcctaaagtgggtttcttgggacacgcgtatcatgtgatacttttgaaaaacgaagctccatggtctaaataagtttggagaatgcaaaatatgccagcacttggagattcagtgtttagaaccataggaaaagtcctgataagtcctgctgtaagagatcttgtttaactttgtttaaaagaatcttctttgatcatagaactcttctggcagaataccaataaatacagaagacagtttgacaaggtatggtctagcttcttccatatttggagttatcctgctagggtgggtcagacagatggggcctttgttgacatcctagaaatttcccagcctgtggaccagcaacactcccctcgctaacttgacatctcctggtcaggttggttgggatgagatcccagatatccttaactcactggtggggaacaggcagggtgtgtgcaaggaatcaggctggtttccggaaggcatgtgtgttggtgaaatgtgggaggcatgatggaagacccagtggagccatagcctgtggtggcctgaatgttgtgctgatgcgtgtgggtttatgttaagggcaggagggacccaccttggcacttaacttttcaggtgcaataggatctgcctcagttgacctgaattccaatcagaagaatcagcccagggtcctcatggcactgcttttaacgtcccagcactgggctcccccaacccctgctcaatgcctctgctctgtcttcttgtaggagctcgtgggcgacgtgttgagagacacgctcagcgaggaagaggaggacgactttcggctggaaggtattcggagtccattgctctcttcccagcagcagcgagtgggggaagcgggtgttcagctggccgtgtgccctgtgtactccagaaaatctgcagatggagggcacaacagggaccttgtgactctgggtgggggtggactagagggtgggatggaggagaggagtaagagacaggtgtggtacttcataggtccaagcccaggtgggggtccggtcacctaggtccatgtcctggccctgcaccggattagctgggggatctcggacaggttgttgaaactctgctgctcctctggggataataagagtagctgctcagagtgatgtgtgaagtgtgatcaggcagtgttgggcatggagtaagcattacacacagtgcctattctgtttcctccatcatgtcactctcttggtgcatgagtgtgcacacacacacacagccagcctttcacctctctcctctgttgtccttcttcctttcttaagatggggtcttgctctgtcacccaggctggagtgcagtaggtaattgtagctcactgcagcctcgacctgggctcaagtgatcctctcacctcagcctctcaagtagctaggactacagttgcatgccaccatgccaagctaatttttaaatttttctgtagagatggggtcttactatgttgtccagactggtcttgaacttctggcctcgagtgaccttcccaccttggcctcccaaagtgctggggttacaggcgtgagccactgcacctggccactgcttgctttcttcatggtgaagtgccgtgttgtagagagaatcaggacgcttaagcgtagagggtctgctggctgctggtgtgctggtttgactttgggcaggccaccctacctttctgagcctcagcttccacatctatagaatgggaacaagggcctttgccctgcttggctcccagagttggtgccaggaacggatgacagcgtgaagcagagtgtttcctgaatgggagattttaaattcagaaacagggaaagaaatcaccaaatggggggctgccttataagagtaaggaaggacctctctgctgagaccagggcagacagctggctggagagctggggggccatggtgcaagggtctgcggagggggatctagccctgcaggggtctgaagggccacaagaggagagcagacagttctgggaagttctcaaggggagcatcggccagacctgaggaccgtggccacatctggcctgagagctgttataaatatagaatctcagctccagcccaggcctgctgaatccgatctgcattttaacaagctccccaggtggcttgcatgaacactgcactcagagaagcactgtttgaagatactcactccgttgcctagaagttggaggcaggctggagagccaggtatctagcaaactttactcaaatgtaagcaggccccagatcaagggggaggagtcccatgaacagaaagctttgtgtgtgcatacagtctggtatcttttatgtgaaaaaaaggcaccagaccatcctcaggagtttcttagggtaccacatatgcatatgactgtgtggatagaggcctagacagatgataaccatagctctttccaaacatgggaggagacttaagtctgtgttatctgcatttcatggttaaacttttataagaacatagttgggcatggtggctcaaacctataatctcagcactttgggaagctgaggctggaggatcgcttgagctcatgagttcaagaccagcctgggcaacatagtgagaccctgtctctattatcaataattcaaaaactatattttttaaaaaatcaaaaaaccacaattatgtattccttatgaaattaaaaactaatgtcagtatttaaaggtgaaaaccgtaaataaggcagtaggagtggagctgctctggtttgagtcgggtgggcatctggacctgtccgtgtggcccttaagaccccatgagggaccctgggcccagtgaccatctgtggtcctctggcacccttggtcctgtggcccgaggcctcccaccccagggtgggggatatggtgtggatggtaggccaccgcgtggccaggtctggtgagagcaggtgctactgagttctggccacagaaaaccagctgcctgctctggacctgggactgaggggtccctctgtgctactgactaagggagaacaagccgagtcctgaatctcttctttgtcttcctgttggccaagttcattgcctcttggcgggctggagagctgtttaagagagaaaaaaggccatctgaggcgtgaagataaaaagaagtcttttagccatcccaggagaggatggctttagctcccgcgttgttatgtaaagccggccctaatccagcatcttaaccgccttaactggccagctgggagcgggagggatgggagattaaggctgggcttggtgggccagggctgcagagctccttttgaactggggaaagaacaaagtaaacatcaaaagtctcaagctctgagagctggctgggcgtggcagggctggtgaggtgaggctttcgtggggagaaggggagagggacccctcctcagctgacccagctgaggtctgaggaccagggaggggtgaccccatgctcaccttcagcgcacacccagcctccctgcccccacagctgggcaggactccaggtagtcgcagcctgcggcttgggccccacggggagaatgggtggccaggccacgttcccctgcatggcctccaggagtcactgtgtctgagggtgctgcagccactgcttcatccccctctcccatctccctctctccaggtcccccctgcctctcacctggtgaacgctgcccccgcccagcttcttggctatctctgtgtctcatctctgggcctttgctcgttgtctctccgcatcctcaagtgcctggtttctatttctccactctccggcatctttaggaaggctgctctgcagcttccctaaaggagatgctcagagccactgaagtcaggcagcccctcctcctcgggaccaggcccaggcctcccagcttccagggcaggccttgctttggccctgctgccctctccccactggcctggcgtgcgcatgtggcagcccgtggggtggtctctgcttcctcagcccaagggtggatgtgcctggagttggtggttctgcccagcagggagcagtgttaagactgaggcctggtgggggctgagcagcactcggggagctcggggcctgttcagctctgcaatggtccctaactttgccttcctcatctctcctcccttgattctgacttcctgtgaattcgcagctcagaccccattccagcctggcttacccacactcactgtgtgaccttgggtgagtcacttccctgtggctcaacttcctcactgggttccttgtagcacttctttgccagggttattgtgaagacaatgaggtgatggatgtaggtcgcaagggtggccctggtacagagtaagtgcccagcacacttgagctgccatgattcttgtttcctgggttcagttttcttgaagaggtgtcagcccgtgtttataatcatttacctagcccagatcaaagaggacctctttgcaaagcttctttaatcctgttagaatctccaaaggcctccccgtactcctggtgcctggagtagggtctggcatgctgtatgtgctcaataaataaacactcactgaagaaggaaagtcaataccctgtagtcactgaaagcaggtgacctctccctctgcctcactgaaagcaggtgacccctccctccggcctctcaggcaggacctgtgtacctgtgttggggcctgggccagtctgtccaggctcccaggggtcagatgttgggcaaaggaacttgggaggcctgtacttcctttcatctgtagttggaaaactgaagcccagagagggaagtgacctgtccagggtcacacagcagactgagaacagaatctggcccctcactcctcaccattcagtatgtgctgggcatttgctgcagctaggggctctgctgggccctgggttcacaggcacgagcaaggtaggcaggcccagcagtcacgacattcacaggagggaggcagggatgaatacataaatctgcgaaggagcatggaagtttctagtagtggttctctgctaagacgtaaaacccagggagaggtagagtgaggaggcttttctgagaaggtgatgtttcagctgagatgcagatgccaggaaggagccagccatggaagaatgtagggggagagcagctatgagtgagcagaaccccagagtggagggaacttggtgtttggggaagaacaaaaaggaggccgatgtggcatcaggaatgagagtggggtggtcggcaagtgtgggaccacgcccttaggttgcgtggttctgcccagatggttgggtgggtgactgctggattctgacctctgttttaagaagttaattctggcttctgggagggactgcccatgggcagggaggaagagggcaatgaaaccaggaggtgactgcagggtcgcaggcgagaggagatggtgctggcctagcctgggagcttggggctggggagaggtccatggggctggaggttggagctggtgagaagggggttgagggaacgagagagatcagggatgcatcttagacttttggtttcaggaactaaggatttggcggtgtcacttctgaggtggaggttttggcgggtgaccatcaagcctcccgtttttggaccagttgggttcaagatgcccatttaacatccaaggagaggtaccgaggaggccgtgggatacctggtgattggagcttggggttcaaggagcagttgggcaagaaacagagagagagagcgagtcaagacttctcaggaagtagccacggacattgcccgggactctcgggcaaggctcctcaatacacagggctggcggtggcttcccaggaaggctgggaggaagaggagttcatgggaaggcagcagggacccccagatggaggggcaggtgcccatgccccgccggctcctctccctcagttcagagcctgtcctgtcggggggtgtcagcggccctgactctccactcccctacagtccccccagaagctgagttgcagcggtgacagagaacaagcggactttgttaccttggcagtttctctcaagtctgctcctcataaaagctcagctggaacagtggaaattctgacttgtgtcagataccggagaggctttaatagtttcaagtagctcggggttagattgtaaaagccgaatttcatcacatgttttaacttgggtgggggcgggcgggggagagtggaagggacgtgatatttttagcccacagaaggctttttctcccctttccccttctctcccggggcttccccctccctccctgaacagatgtttcgtctcaatcctgttcagatgtcaaagccgagtggccaccagccttatgctctgatgaggaaaaaaaggccagaatgttatttgttgagaaggatttcctcccctacccgcttttcccccttttttgtttcccctcagttacaattggtccataagcaaaatctagtggcagtaaaatgcagctgggaggcaggatggtggagaagaagtccctggtggcatttctggtctcaggaaggggcagacacccacaggtgaaaaagctggaaatcaccctagagggactgccctgggtgagtgaattactgctgtggtgctggtgctggtggtttttcctaaaaagcaggatctcagagagacggatttgttaagtcaggattctttcggttcttttggaaactcacttaaacttttggctcatgaaattgaaaaatcctagggtagatcttgcctaaaaaggcctgtttggattctggagctaaaaccatgtcatggacacatgcacgcacacacacacactcacacacacacgtatactcacacattcacacacatgtctcgctcgctgcccctctctctccctctccatcatctctccctctgtcccctggtggcttctcccccacagggggcaagggtggcagttcccagctctgggcactcccatcctatgagcacagccctgtcaggtggaagaaagttcccaggtcacaggggttcttgcacatgttggactcactttattgaccactttactggtcacttgaccagggtagatctaggttttatgggacctgaagctttctggggccaaaccaaaataaatatctcaccaactcagtctctccttagctcatgtccagaaatgcctgtatttcccctagtatcacctcacacaggcaaaggatgtcagaatggttagatgacaatcttaatagattgaggataaaatgcctaatttggaaaatgttacaaatacaaacacatatgaccacataaacaccttgcaaagacccatcctgacttggaaagggcccgtgtaggtgagagggcccagaagcctagcttcattagcttcttcataaactcttctttcatactgacctaggaccagccacgtggccttcaggatgaaacaagctgggtcaggtaggggtactgagtgcagtgtgaccctggagtgggatcagtctccataaactagatagactgagagtgggggatgagtagctctggggaggaaagccagatgctatcatcagaaggaggagaaggattgctggacaggcaggaacaggtgtcagctattgtggtctgagagagtggacaggccagtggttgaggagttgggaaactgggatttagttctctttgttccacaacttctgggttcaaatcctggttctgctacttaccgttgtttcattttgatgatgctgctgatgatgcagcacctatagtgtgatagacactgcactatagacatatatatctcagggtatagatattgggctgatggaagattctgatgattaaatgagtgatataatgatggtgtaataaggctcactgagcagggaagcctaacctagccctgagggtgtgacagcatgctgctcagaggaagggaggcttaaactgaagacctgaaggatgagtgggaattgcagagctggaaagagtgttcttggcagggataacagcgtgagagcatggcaggctcagaaaagggaaagcagttccacagagagacgggactgagaggtggcagcagccgggtcgtggaagcctttggacccctccttaggggaaagggggccactggaggggtttaagcagggaaacggcataatcagttttggtttttaagctcagtttcctcttttgtacgatgccaacagtagcacaccctgcacagtgttaagaggacttaatggaataatgtgtggtactactaacttcaccagcctctccatgcagcccaccacagtatgtggctgtgtttacaaacagaggtgggatcgctaggaccctcattccctaaggagagcctgatacagatactgcaagaaaccatttggcctggaatgcacatatgatatctttctctttttactggcagcagatttacccgcctaattatatttggcagaggctaatattaaaattcatctgcattccctcgaacagctgctgtcagaaggttgtggactcaaacatcttggcaagcaaccctgagactaaaatatttgcagcagataatctgtacgtggacgattgagaaaggactgtggatatgtcagggcgagcatccagactctagcaaggaagttctggcttgtgttaaatcttacattgtattcactgagaagaacttgccaggtaactaggctaagagaggggtctgccatgcaattgaattgttagtaatttctggtctttagtggggctgatttagtcataactgtgtttcaaatttgtctcttctttccaagtttcatatgcaccaggcctttctggattgtgttaagataagctggcatttactggtatcatcccaggtttggatttttatgtaaatttcaactccccacctccccatggcacttcccagtctccatcaaggcagaaggtatggcatatttgttatgtagccaagcttccttatgcctacctgtagaatgtgctgtagttcagcaggcctggcggaatctctgccctgtgcacgtatgggaagtgctaggcattgggcaacccgggagcagaagcctagaaggcgccagatctcaagaaacttgctttctggctgtgcagatgtggaggctcctgtgaagcaatcagaaggtcccagataggactgtacagaataaagtgctagactgaatggcgggagacagcaccccactagctccggatgcattcatgcaaattagaaaaaagctgcccctcctcaagacacctttctgccatctgtccaaaggatgtcataagcaatacacatatctagggtattggtcatatgagtggcaccacctggggttgtacagtgcacagcctgcttcttggatccggtctcctagtgacctcaagtgaccccagaccaaggggaagagccccgaggagctcaccctgttgtactgttgaggaggacaggtctgttttatttcacaggccttcttctcttgctgtttgggtggcgccagctgtcagcagcttgggctgggtgggctgtgccatcctgctccctgggtcactgccatttgccagggtaaacagtcccgagtgactgtggctctcacagcatgcggtccccaaggagcctcccattgggcccatggggaggcgggaggggtgtctagacccacagtcaaagttgtcaccattcaggtatttcctcactcttcttctttcgctctctcttcctccccacccctcccttttttaaactgggggaggggagagggaagagactgtctttgatctcagcggaggaaaaaagtctgttcaggcttttggctaacacaacaaacagtgtttaaaatttaactttgcttaattaattagtaattctgtttaatgctgtctgatctccctccaaaaggtattttgaagcttgagaagggaacatcaaagggagccgggtgaagatggtcaagtaatgcctttaatctggcagttgctgagggtggagagctgccaggctgggagctaatggggagagaaccgtcatttggtaaacacagcaagctgactcctcgtggctgtggtgtgaggagggacagggagcagtttccaaagagagggaactccacaaaccattaccaaccccccagattcatatgggctgacaataggccttaagaaagcagagttgacattttctttcttccacagccactgtatggttgggcaggttgtgtactgcacaaggatttccagccaagcaggcaagtaataggtgaaactgtctgtgccctgctcatcaagcacatatcctggtggaagtagagggtggcacacatctaaagcagcaatcaatccacagactttttcatgaagggccggatagtatgtattttagactttgtgggctctgttgcaacagttcaactctgctgtcacagagtgaaagaagccatggacaatgcagatgagcatggctgtgtcccaataaaactttatttacaaaaacaggaggtgggccaggtttggctcagcaagtgtagtttgccacctcctgctctaagtcacccaaaagtgcttcttaggcaagtgaaaggccttttttccccacccggtctcctgctttccttttttcttccaaatgagcagtgtctcctatagttcctcagactttcaattgaagagtgatcagtatgatcagcaccccctgaaattaggcccccaaaagataatttctcaagcggaaaaatggctgggctaaacaggaatcagaggcagagaatggactcagactctggtgccaaagctgatctcaactatcatcattgcaatcccccttggtgtggcctgggtggcctgcagcgagcaccagtccgcctctcccgcctccagtgggcctgcactcactgatgggtggagggtggtttcttctgcacagggctggctgggggctgtggtggcttgacttagtttagtttcagagggctcatatgtggatgaggcctggcgcctgcccctggcattggggtctgcatggccagttctctgccacctcttctagctactggttaggggacaataagagggtgaacgaccttctttggtggggatagagagtgctgactgtccttgttcctgacccccacagccccagggcaggatggatcacaggccccatgctgggaggggcccctggcgggttcactgaccgtcggctgacctgtggatgtccgtgtggctttctgagctgggatgggatgagggagccactggtgaagagaggacaatccgggccacactggtctttggggaagacatatgaggggtcgagggggatgttttccagccccttcaggtgaggagaaaggaaggaaaggggaggtcctgagggaagacaggctgtccgtgcacggtggaggaagagtgctccagaggaggagagagcagggacagaggttccttttctttggattttatcaagtggaacatgaaaggcaacattgaacctgaaggtggttttctgataacttccctttgaacttgaagtttggtttcgacaagcctggccagcttgcatctccagccaggacctctgcagagagaggcagcagctttgaagatggagctgggctttgtttttctttcttctttttctttctcttctttccctctgcttgggaggggtgagtagaggatgctgcaggccgtgatattactctggtttctccggtggggcagtttggggtcaagcaggatcgttgggatctgggctgtcagctggcacacatccttggcaaagccagcatttgttgagcacttactgcgtgccggccactgtgctcagtaagcactttcctcattgccctttcccaacagccctgtgaaagtgaggccatcatattcccattttacagacaaggggactgaggtccagaggagtcaagggccttgtccaaagctgcccgcacaggctgtatgtatttaatataatgcttttgtgtccatttgcattcgtgaagcctcagttttgagaaaacttagctgctaactgagctgttcccaggagtcagtggggtggggccatcagtctcctgactgttactacttatggccagacctagtgcactgggggtcttagccccttatgatcagagtttgttggatccacataagaatcctctggggaaggggttggtagcttcctcattttacggttggggaaactgagacatctagagaaggtatgtgatccacccagggtcacacagtgccagagaacagaacccacgtggagatgaccactgccctggctggctggcctccatgagagagagagaggcaggctgagagaagcaccaagtctcccgaattgagccatgaaaggcatggaggggcagcctagtggactgactgtgagcattattcaggctacctgggttcaaatcccagttctgtcatttactagcgaggcacttatcctctccaagcctcagtttccccatctggaaaatggaggtaatcgtaataactgcctcacagggcttcatgaggatggacttggtaaacagcaagtgcttagtcattgctgcctcatctttatgtacagtggcgccaaggcgcaaggacaccaggggaagtgccttagttaattgcagaggagagagctcccagttcgcaggaccagagcagagcaggagagctggggcccaggcccactgggggcatctccactgtgcctggcccagggactgcccttgggtccttgcttgcaaagctggggtgtgtgagtgtggtgggagtgtgggatcggagagacacaaatcccccatctagtttcctggcccagcggcctcatttctccaggctgctgacttcccaagaaagtcctgccttgccttcctctctgactggggagtctcagctcctcacatgaccccctggccacccttgggtcagggtggaggggccagggtcccttcccggagtaggagccaggctgtttcttcacctttaaaacaggacaacaaatttactaccccagggcaacagaaggaatcagatgagaggagctgtgagtgtggcctggaaaagatgtctccggcaaaccccagcccctctatctgacagagacaaaatggcggaagggactaaaggaggcttatgggacattccaagaattgatggcactttgtagtcgggatcctaggtcaaggacaatgatgctacccggagctggcatcctcaggaaaatagtgtcagtaggtcctgggatttcacactcaccctcccacatttcctggcaggccacacacaggaccgtgacctttggcagagaggggaggacctggggtgagcagaggccaaatgcaaggttcaggatgagcgtgctccctgaagatgccttttgtgtatgtgtgagtgtgtgtgcatgtgtgagtgtgcatatgtgtgcaagcaggtgtgatgcatgagtgtacatatgtctgcatgtgcgtgtgtatgtgtgtccatgtgcgcttgtgcatacatgtatgtggacggtgcatgtgtgcacttctttgccaacccagttgaactctgtttctggcactcctcctggccatccaccaaggtgccgtaggctgtgctcaggtgggtggcacctttgaggaggccaaaatgtcaacacagaaggcagtgagactgcagaaaatggccatggtccctaagctccctcgctgggctccagaagcacccctccactctcatccatctgccctctggcctgacactgctctgggtggctgtgtgcctccatagggcagaagtcataggctggtgggggcctgagggggccccccacggtgcaagtgggtgcaccatgttgggggaaggtcttcccaggcagtaccaggtgccagagtagtgtgatgttgaccccagcaaatgggcagggcaggagcgggcccagccccctggcgagaatgtccaggccaggcatggaggacaaaggtgcagtgagcatggctgcccggcgtctggaccctgctcctaatgctccctcgcctgcctccccgacagtggccctgcctcctgagaagactgacgggctgggcagcggagatgagaagaagatggagagagtgagcgaaccctgcccaggctccaagaagcagctgaagtttgaagtaagtttccttttggtgctgggtcctgaggagatgagatgggttttctcagcttggggctttgggaggagggaagctgaggctcttccagacaggaaggcccctcccctgcatgaacagcaccctctgtgggaggttccttctgccacatctggggccgtcctggctcagggcagaccccagggactcaccgctgcccaccccctcagcccagccccagcccctccatgcgggctgtgcccagcagcttgggagagggcatgagagtagacgagggaggcaggactctggcccttctgttgctgtcacctctctgggcctcagtttcctcggtgaaaccttcccttccaactcttgaggctgttctgggggtgcctgtgggggatctcaggtgggatggatgaacaggaggtacgggcaggaccctgacgctctctgggcctgagtttccccatgtgggcaccaccaaggatgtgcctccgtgtggctctgtgcagtgcttagaggagggagtagcagctgtgggcagaggttggtgaggctctgagcgtaggggtaggagttgggagagggatgtacaagggagtctttgggaaaagaagggcctttggggtgagaaggggacagttgagtgccccagacccagtggctgcacagtctgttccccaccgcctgatagtgtagcacgctcctgtgcccccagcacagtggccagtgctgagagccaggcccaggcctgctgcatggagcttccccactgctctgccctccttgctccctccctccttccctctgtttgccttcctgagaccaccagggcatagctctagagtcagcaggcctgggttcaaatcctggctatacacttagtagctctgagactttggggcaagttccctaaagtctcagtggcctcacgtgcctcgcctgtaaggtggggataatggtgatgtctgtcgcattgggctgttgtcagcagcatgagttcgtgcgcctaaaggtctaaagtgcttaagagggtgcccctctttctcaccaatgctgattggcaccggctaattgccagggtacccagcttagactgggtgtggttcctgccgtcaaggagtgcacagtgtgaccaggggacagttgagcgccccaaacccagtggctgcacagtcagtgatgagatgagatctgggagcctggagtggggtcaggccgaggggtgtggggtaacggacacttggcatttccaggctctgtgcggtgcctggaggagggaacagcggctgtggatagagactggggaggtgggtgaggctctgagcataggggtaggagttgggagaggggtgcacaggggagcctttggggtgagaagggcctatcaggcagagggagctgcaggagcaaaggcctggaggctgaagtgccggcgtgctgtgtggagagagtgagtggcgtgatgtggcctgcggtttttttttccaaacgggacacacacatttttctcattgtgcggagactctgggtgagcctagggcccgacagcttctcccatgactgtttaaactcaatcctctgttctatatactaagtgtactttattaatactatatctcataaaacatgtcatacgcacactaatttttagagaataaagaaatgagtggtgttgggctatttctttacacccctatcgcgagggaaatagaaggaagtccttattagcctttaacataactggcggtcaaaaatgaacttatatgctcccgcctttatagtgagtcgagttagggtgacctttttttatgacttgtatgcacatgggagaagataggccgattcactaccggaaggggctctttcaaaccactcctgtataacttaaaaaggtaaccattcaaaaagtaagtgaacttaattgatctaaactgtgatttgaatgagaccgcttggtgatgaaaaccgaaaggggtggagacctaagtcatgttgatttaattctccatctatagtgtatgggatcggaatgaaattgagagctgatacccgaataaaatcggtttctgtaatcccagccgatatcttgaaatgtcnnnnnnnnnnnnnnnnnnnntagagtcagcaggcctgggttcaaatcctggctatacacttagtagctctgagactttggggcaagttccctaaagtctcagtggcctcacgtgcctcgcctgtaaggtggggataatggtgatgtctgtcgcattgggctgttgtcagcagcatgagttcgtgcgcctaaaggtctaaagtgcttaagagggtgcccctctttctcaccaatgctgattggcaccggctaattgccagggtacccagcttagactgggtgtggttcctgccgtcaaggagtgcacagtgtgaccaggggacagttgagcgccccaaacccagtggctgcacagtcagtgatgagatgagatctgggagcctggagtggggtcaggccgaggggtgtggggtaatgaccctttaagatctacggtcttgggccggtcctgaagtaaatggaaaaagtctggtgagaagggttagtagggcagcttagatggcggggtaaagattagtataggagcagggctccacaatgtagttgaggccacaccacacagcttgttctccccacacagcacaggagcactccagcctccaagaggcttgaaggctcgcctgaggaggataggtagtatctagtaggagttagggctgccagcttcttcctggagcccagccccgccctaagcccacctgggtccttgtagggtcttttggggagcttggcaaagcccagggctgaactcagtggcagaaggaagaccaggcccaggcatcctgcctccctggaagcccaagtgcgcttgcttctggaggggcagacttgggactgagctgtggtccatgggcaggactcaactgagctgagaagcccaggtggggtgtgggagaggcctaggagacccgcatgtgacaggtgggacaagtggccagttactcaactcatgtttctgaagctcagacccaagctgtcttggaaacaggtaagtgctgtgtgtgtgtgtgtgtgtgtgtgtgtgtgtgtgtgtgtacacaggtatgtgagcgtaggatgtgcacgtataggggtatacctgtgtaggtatgcgtgtgtgtaggtacgtgtgtaggggtatgcgtgtgtgtgtgtgtgtaggggtatgtatgtaggcacgtgtgtcatgccacatgaacagtgcctcagagagcaatgagggcccttggcagttatcaaacgggtgtggctgaagcaaggttggctttgaactcagcgtgggcgcccgagaattgctggagggaaatggcttagagctgcagcagccagggtcaggacgccgtgctggggctcactccactagcatttgtaggcaggtgcctttccctctctggggagctgagccttcctcctgccaggccagccaggtgccaccttcctgatggtggaaggagaggtggagtttggcatgccatggaacagaatggtcttgtttccatagaatcttatggatctgaaaggccatttgtggagccctttcctgctgaacagcatgcttcctagaactgtctatctgacactcagccagcctctgcacacagccctccggtgaccagctcaccacttcgcgtctcacattccctggggtcagacacttcaggttgctgaaaatgataataatgaaatgattgtttcattgattattgattgaaataattatttcaatgactgttaatcattacagcaaaaataacagctactaccattgattgagcttttccatgtgccagacagtgctccaagcatgggtgtaaaggacaccagcatttaccctccacttcctgtttccaattcccataagcagacctgaccacatggcactgggagcaggcagtgtgtaggggaggcgatcctggggcgcaggtgcgaggaaggaggaaagccagtgaaggctgggttcatctgtgggctctgcctgctggagagcctcctaggagccatgtagcatgcgctcagatttgtcccagggaggggtgaggaggcctggcgtttccactgcctcctgtccctcccttgttccgttgcctctgggcattccttcccaggctcttcagggctgccctgagacagaaaagtgtacatgaggtgggaggtcgggaactgtccccaccacagctgcagggaaacagctgggctgagggcatgtgggtggggcatttaatcttcccagcaacctcgtgggagagaggctgtcattttccataatgtatacaaagagaaactgaggcacagcagagggcagtgacatgcccagggtcacacagctgtggaggggcctgcaggggctggatcccggggctgaccgacacccgaacccctcatgctcatgctgtcctaccctggcatcctcctggggctcccaaattgccgctcctttgccttctagttgcttcttgcccttggtccaagttcagcttttctgaggccacagtgcctcttctcagaaccccctgtgtttcctttgtctttgaagacccacagaccaccaggcacccctgcaggcatccctccccaggccaaacctcccctgcccgggctctggctgccctcctgggccagttctgtcttggccaaagtgctccctgtccactcaaggtctggggagggcagaggacaggtggccgccccttggcctggcctctaggcccaggcttccactacccagtcagtgttgccacagataggggaccagccccgcccatctctctgcatccaggagctccagtgcgacgtgtccatggaggaggacagccggcaggagtggaccttcaccctgtatgactttgacaacaacggcaaggtcacccgagaggtgagtgcacctgcctggcctcttgccgtgtatcatacccgcaggcacagggcctgggcacagcaccctgccactgccacttctctcccctgcatcggtcctgcccctcagggaaggccgtaacagccagggagttgctgggagctcctgcgagatctggaggggcatcccagagctgctggcaagtgggaagagaagacagggagggaaggcagctcccctgctctcagcccaggcactgtccctcccgggaaagaagttgggggggagcaggtgcagagccctagggcctctctggagatggccccaaggccctaaccgagtcctgtcctgcttccctctctccacagtcccagagctctaggggtggggctggcaccaccacaggccacctcccttgctcagccatgctgcccaggagcttgggggtgggggcacaaagaggccacacagcgccttgttttgaggctacaggaatgagcacctccagtgctaagggccctgccagtggctctgcagtcacagctctggtcacagcctcgtcccaaacctcttcttccttatccctctgcaggccggtctctctcgctcagggccctcctcctgcagctctctccttcctgcctgtgtctttgcatattgagcaccaactgtatgcatctgttgggtgctaggtactaggcatgaggacacagcagggaacaaaacagacacgttcctcgccctggagctttgaccttctgacaagaggcagatccaaacaattgtaggataactgtgagcggtgatgtgttcagtgaaggaaataaacaggtgctgggacagagactggctggaaggtccaggggaggcctcctggagggtccaggggaggcctcctgaaggaggcggcaagggagctgagacatgcagcatgcacagccttgggggagtcctgggcaggcagacgccaggggctcagggtgtttaaggaactgaaggaggtggccgtggtggccaatcagcagaagagacacagatgtggctggggatccagcagggccagacttctggggccttggaggccctggcaggcaacctggatttgatttcaggtcctgagggcaccgctggagggttggtatccttccttacacttcctcattccttttcctcccctgtccctctctgatgacctgtccctccccgagaggaccccatcttcaggcacgagacctgttatagatctgaggttacatgcacctgcgcggcggtcgcaggttagcacgtctgggctccacttgcttcttgtccagcatgtgggggcctcatgttcccagagagacactaaagctttgctgactggtctcctcatcctgggtcaggacgagtgttttcttctctgtggatagggcaggagaagttcacctttatgctgccatatgtgaattctgggttaacaaggtcacctcctcctcaggctgtggttttcgggctgtttcaacaggttggaggaggaagttgtgacttttaagcacccaggactctgacatgtaagtgacagaatacatgctccaactgctgtattcgaaaaaaaaaagaaatagattggctcatgtaactgaaatttggtccggggtctgactttggggatggcttgacccagaggctcagtggcttcaggacaaggtgttcatcactgctctgtttcctcagtctatttcctctattcctcagctctatttcccttcttgtgaggcagactctccccttggcagtagcaagatgattgctgacagtttcaacctgcgttgtccttcactgctttgataatgagaggaagggagagagggtttccaaggaaggtggcccagcccggccctggagaaagtgttcactgggtcatgtcttcctcccaccgaggagccagggagtggttttgagtggagggaggactggtctggtgtttccctggtctatttttagccctgacgccacccctcaaatttggctgtaaatacagttcccttccacgccttctgagtgccagggcagatgggctcccacctcacggcatctgcagcccagagctggggtgtgggccagctttccaatcagaaagaagacctgctcccccttcaggcgttcgttcatgcaggaaatactgagcacaccgattcctacgtgtctgccctgtgtagtcagtgaggttgattttcaagctagaattgccaaagcacataggctctgagaccctcggtctgctgggaccacccccatcctgatcacacaccagggctccaggtcctctaaggtatcagaagtttgggggatgaagtgagcggccatcagctgcctcatctgtataatgaaacctccttcatgggctgcccaagatagagagagtgagcaaatggggccttatggagaagccagagggaagaaaaggaggcacaaggagagtcctctgcgggcctcgtcgaaagaagtgggatccctccccgagatgagcaaggcagctagggagtgcctggagcctgggtctcaaacttatggcccccacaatttcaatctggcccccagatgttctggtctggtcccgcaaagggttttgttaaaaatcagttgccaagatcagcaattttgaagatttaacagaagatcctggatttctggcttttctgtgtgaccccctcccacctgcattgtcaaaggacaagtcaactgagctgagcggccgtgcctcccaggacagggtcagcgcctctgtcggcccccattactctggaccactcacccacatgcctgcctggctggggctgcgctggggttgcctcagctgcttcagcctgtgggacttacaggcaggaggtgaaggattgctgggcaggtaactgaccatggatggggttgcttcatagagaaaaaatgtcttctccagaggtttccaatgccatttaaagcaggacattgccctgcaccccaacaccagacaagtgaccacagcagatacccagatagaaagggcctagtgaggagaatcggtgccctccagtcccaatcagaagggtttgagacacctggaagacattgtatggacacccctgttctggttgaggggtacctgaggctcggagaggagatgagatttggtcaagttctcacaaattagttttatcttttagggacagtctcagccagctcaagctgccgtaataaaatactacagactgggtggcttagcagaaatttattcctcacggttctggaggctggaagtccaagaccaaggggacacctgcttcagttcctggtgagggctcgcttcctggcttgcagacggccaccttctcactgtgccctcatgtggtggaaagacctcttctagtgtctcttcctttttttttttttttttattttaaacaagagatgggatcttgcactgttgcccaggctggagtgcagtggtgtgctcacggctcactgcagcctcaaactcctaggctcaaatgatcctcccacctcagccttccaagtagctgggactacaggtgtgcaccaccacacatggctattttttattttttatttttgtagagaatgttatgttgcccaggctggtcttgaacttctgggctgaagtgatcctcccactttggcctcccaaagtgctgggattccaggtgtgagccatatccctagctctcctcttcttctaagggccctgatcctatcatggtcccgccttcatgacctcgtttaaccttagttatctccttactccgaatacaatcacattgggggttagggcttcaacctgtggatttgcaagtgagtggggagccacagtttagcccatagcagggacacatctccctttccatttttcatttcgaacccgaagcagatgctgttgatgcccccactccattttccctgggtccacctcaaagttcacctgctgccatggtggatggtgcccactgtaagagctttctcaggtacaaggagttggcttggcccctgcagggaagcccaaaagcacaagggagggttgggcacagtggctcatggctcacatctgtaatcccaacacttagggaggctgaggctggaggatcgcttgggactgggagttcaagtctgcagtgagccatgatcacacccctgcactccagcctgggtgacagagtgagacccccatctcaaacaaacaaacaaaaatccaaagtacagggaatgtagtagtatccttggggagctctcaggcagtgaggaatgagagtccatttctaaaccctccctctatctagaagaggctgttccaaggtgggctccacacactccctccagggccccagtgcgactgagccccagttgtccctggatgtaacctgcccttttccttttctcttatgggattttcctgttctctctccctgctccctcatttctgcttcctaggatctcctcccaaacgaacctcagacatccaggtttctgccttagatctgctttggggcagccagaggggttcaggcctgcagcgtccaccaggccctctggtttgtattttcaaggccctgtgactgaaaccctgcatgggtctccgcttccctcccattcaggacatcaccagcttgctgcacaccatctatgaggtggtggactcctctgtcaaccactccccaacatccagcaagatgctgcgggtaaagctcaccgtggcccccgatggcagccagagcaagaggagcgtccttgtcaatcaggctggtgagggctgcagggctgagcctgggaaacaatgtcctcccatctcaggaaggaacagagccttcctgggagggccggaagggaacctgtgggctttctggggcagctgctttgtggacaggtggggttcaaatgggtccttgaaagggtaggaggaagggtgggaaggggagggaagggattctgggtgagaggcctcatataggcagagccatgcagctggagtgaaggctggtgttacgggcagcatggcgtctgcaagccttgaggccagctggaaggaggtgaggctggagggggagtctgggggaggaggtgaggctagatggggatgtgtccagggcaggtagccttgagacccctttatttagccccagctcagggaaccctcccacagtggccttgcaaagcagctgcacgccaggcagccctggggagggtgggagcaggcagctcacctggtgtctcctgtgcttctcgggccggactcagacctgcagagcgcaaggccccgagcagagaccaagcccactgaggacctgcggagctgggagaagaagcagcgagccccgctcaggtatgtgggcatggtgcacatgagcatatgttgagcaccagctgtgtacctgcttctgaaggattcagagcaggaagttttgctctggtctgtgttctcttcagggagccaacacttttgatgcacagactcataaatcaaatgaaaatcttaacaaataactacatgtagtccacatccttttatggaacacatcttgggcagacaggactggaggtcagcattttttgggctttggaaaggtgctctcagcagtgcatcaggctcggacgtgttgctgtttctgctgggagatgactgaatattcacactaagtgagataaagaccgtaaacaccttcccatccctttagggtgggcctggctgccacgtgggttatgaaaactcttagttttcaggctttttggacttcagaatggtggataaggaattatgaggctgtagttacctttcacctgttacttcttcagctgcaagggaggaagggaggaaaggaaagagagattgtttaaagaaagggattgagtaaacaacagtaacacggcaggcataaggctgtgttaacctctagtgtgcaaatggtaagggaatgatcggagctggattagtactcgctaggggaaagaaaaaacagttcaagcagggtcacagccaggtgtggggacagggctgagaatcagagggacccaggctggctagagatcctgggggaaggtggtactgtgttgtgtgggaaggaagccaggagggagcagatcgaagaggtccttggaggagagggctagggagccccgagccctgcaggggaaaaagaaagcctctggcagcatctctccccacccctccatgcacactgtgtaagtcacacatgcatgtgcacacacacactcacacactggtgaggcccatcctgggccgtagggcaggtcatggggtctgcctggcccaaccccaacagtttaaggggattctgctgcccacaccccctgaggaaccaggccaggggttaggccgcctacctgcagtgggcacatatggcttgaagcctggcactggggcattcctagaagttgaccaataacctctcacgtttgctttgaacctgttcagagcaaaaccccgtccactcctcccagaagctgcggggaggtcgggctgtgggctgtggtctatggtctgtctctccatcggcaaggagggaaatggaggcacagttcgtatagaggactgttcctccccaccctctccaaaggccaagaaggaaatgaatgaagggtccagagttcattctgggggcttcctagtagcctatgcgcttgcccccacctggtggttggtgttatcccactcacttgcctcccctgccgtaggttccagggtgacagccgcctggagcagtctggctgctaccaccattgcgtagatgagaacatcgagaggagaaaccactacttagatctcgccgggatagaaaactacacgtcccaatttgggcctggtaagggactcaagcaccctgcaatgggcgatgagggcagggcgtggctggacgggccaggcgggccgtgcgggtggtgttcactgctaccccaggcttcggtaagacaactattatgggacaggtcaaagacttcttggagaaagtgacgttaaaaatggtttcaaaattaaagtaatacatgcacgaaatcgaacaaaatccaatagtatctaaaggcttagcacccaatgacaaacaacagttctgtgccccatcccagcccacccaagccctgttcccggggcaaccactttgacctctcctggctgtttcttccagcaagaacctcggtttccctaagtacagcactactgtgtctttatcagccttgacatatgttgacctcttgctcaatttcactcccacaactcccttctcccctttctcttcatatgtttaattcctctatgagttacttctgtatgtttttagcaatatacttagagttctttcttgccccagtgaccttagatagttttcggggtctctgctgccatctgtctttctcggctccctctcggagagtatttttgaagacctaccaaagaaccagttcttcccacttagcagatgggaaagttccatttcagagagttttcctgcaaggcagtgaggggcagtcagggcattggggggtagctctggttttggagaactgggggcgggggtgatgtctggggtatagcgcaagccccagcacacagtaggtgctcattaaatgtctgttgaattggttcctaggctccccttccgtggcccagaagtcagaactgcccccccgcacctccaatcccactcgatctcgctcccatgagccggaagccatccacatcccacaccgaaagccccaaggcgtggacccggcctccttccacttccttgacaccccaatcgccaaggtctcagagctccagcaacggctccggggcacccaggacgggagcaagcactttgtgaggtcccccaaggcccagggcaagagtgtgggtgtgggccacgtggccagaggggcaagaaacaagccccctctgggacccgccatccctgcggtgtccccctccgcccacctggctgccagcccggccctcctcccctccctagcccccctcgggcacaagaagcacaagcaccgagccaaggagagccagcagggctgccggggcctgcaggcaccactggcctcaggtggccctgtcctggggcgggagcacctgcgggagctgcccgccttggtggtgtatgagagccaggccgggcagccggtccagagacatgagcaccaccaccaccatgaacatcaccaccattaccaccacttctaccagacatagagcccctccccagggccccaccctgccatatgaaggaccccacccccgacaccacaaggcattattattctattaattattgttattatgatgattattgttattaataattattgttactccactaatatttagctagcctacatgtagaagatctatggaaacacagaactaaacttttatttatatgttgtggggactgcataactagcccaggaaatgactctggttttgagtggcctgtaatgggcagaggctccctcggggctcgggatctgcagcatctatgtggatcagcccacacccttcccagagccagggagcccttagcctcaactctgccccaccccagcctcttccaggagagcacccttacttggcccggcttccagagaccctcgaaatctccgagaagataaacagctgctacctcttagtattattctgattttattttgcccttaactgattgttatatgctacaagggatttcagtggactgcagagtgcgaacgtcttgctgttgtgtttttatgtcccaacctagaaaccttagctgtcttttctggagttgtctttcatgcttttccagtgggatcaagcccttttccccaagagtcccatctcttctgccatgcacgacatgaaaatccacttctcttccttctccttcttctctctctactttacagtgatacacacacgtatttaaggactatccctgagaccatccctctcattttggaaactgctagggagggaaccaaccacttaaacaagcgtggttttccaagatccaggcaattgtgtgctgttggttgtggtggaggatgtggcacatatatacgtacctacacggttctctaacagagctttctgtatctatagatagatgccatctgtccatttctatgtatctttctataaatatacactctcaggtatcttttctggtgtgtataaatcagtggtttgcttccctggatgcttctggaacccagatgtgaccctgcttgtctccttttggggctggacggctctcagatgctttcatcagaggtccattctcgggttttggggtctgatggattttggagagaactgctggggtacagaaacttggtgggaaaaggggactgtggccagagttgggaccctggagcagcatcctctgcagagaaggattttgtctggccagagcctggagaaacctgaaaaagaaccagtcagctagccagggtctcagagaaaagcagattacacactcaaattgggtaatttgagcagagcttaataaaggcagtatttacaaagtgtgggctaagcctcccatgagagtgcagaaccctggggctagcagtgtggggcgctattcccacccctgggcctgagtggggaaggagttatctttagcagacagaggattgctggaggagtgagaggggcacctgaaggagctgtgacctttgcttaaaggatgcagccagtcatggggaccctccagggaaattaatatcctgacctgctttcctgccccccagccccctcaatccattggctgaggccgctggaagccaccgggccaagggagcttgttgatgtgggtcacacgggcatgttcccaggtcagagaggagagtggagagtgaatctagggagactcaagagggagaagtgactccagctaccttcctttctgccgttttgtctcccagctggcattctcttttccagagcctcgagtttgggtttaatgtagttagtaaggagttacttccaaaggtagtgggcttagttgtcaccgtattcttaattttattaatgactgatgtgcctgggattggattaatacattaatccttaggacagccccatgaggcagcttggtggcagctcaggaagcatgtctaaggctcagaagttcataactcccttgaggccgcacagagggcggagctggaattctggtctcccactcgatcccttcgccactggtgcagagcttaatcacggccatgggctgcccttgttttgggttgtgggtttctgttcagtgagaacgcaactcaatccaaagtgaatgaaaccaagttggaaggcagggagggaactggctttgagatgacagggtccaggatgtgaatgcagctgagactggttcttgtccctccctcttgtccctcggattgataacttgtactcaactacatgcttttgtcagggaaccctggctgctggccttctgggtcccctaaccataagaaaaaggaccttccgttagtgtaaagcccaaggcaggattctgcttggctgggcttcgatctggtacccatagctggaccaatcatgacatcccagatggggtcacgtggccaacctgccgcaagggggtggggtctgtaccggaagacaggaggggaggggtgcagatcggacaggaagtaatggcatcccaggccccgaattgctgcaaccctggaggccagcccggagttgagactactggttttagagcagttcctctgcctccctaagctccacacctgtcaggattctgttacttcttggtaactgggacttgcccaactttaaaaacattatttaaaaaaatagtaatgtgcacatgtaaaagattcaaatagtatatatacaaggtgtacagtaaaaagtaaacttccctccatcccaggcctgccagcatccctgatgccgactttctgggtgtggcctagggcccctcagtgtaatgtaggggttgtgagcacagactttggtgccagtttgctaggttcgaatcctgactccctctttgtagctctgtgcttcaattgaaatactgtgcctcagtttctcctttataaaggcagggatcatgagagtgcctgtcccttgtgagcactatgaaagtgttagctgttctttaccagaataaatgcatttctatatcttcccatatgcattttgttaatttttaaagtatttcaaacacaaagtttgaaacagaaaattgtgtaacattaactatgaacttaccacccagaatttacaaatgctgacattttgcaatatttatttcggatctatttttaagggggggaaccctgcagttactgcttaatcctcttcccaccccacccttttatttttacacaaggagcatagtgttcatacttatgctatttttttcagtaactgaatatatttggagatctccctccctaggtcatagagctctgcccccttctctctaacagctgctcagccttctgtgactagaggtgctgtcaccagcttgccccatcccttcttggtggtcataagggtcatctctcatcccaggctctggcgaacactgtgctgagagtccttgcatacagctctcccggtgcccacaggcaggaacacaggcgacagaaagtttccacgtggaactgcagagttcaagagcaagtgtgatttcaattttgatgagattgtacatgacctctaaaagaggttatactggccgggcacggtggctcacgcctgtaatctcaacactttgggagaccgaggtgggtggatcacctgaggtcaggagttcgagaccaacctgggcaacatggtgaaaccccgtttctactaaaaatacaaaaaattagctgggcatggtggtgcgtgcctgtaatctcagctactcgggaggccaaggcacgagaatcgcttgaacctgggaggcagagattgcagtgagctaagattgcaccactgtactccagcctgggcgacagagtgagactccatctcaaataaataaagaggttatactgaataatgaggaatcaaaggaagaagaagaaagagagaggaaggaaggttggaaggaaggaaggagggaaaattagaaggggaaaccatgattgctggtgaggttttgagcacattttcctgcaggctggtatgggtgagaggtttggtcttgtttgcaaatcttctgaaggccattccagaggagcagttgccactgccccatcccctgagctctgagcatgggggttcccctggggagactcctggtgagaggatgccgatttctgctgatctgtcactgggtaccgaggactgggtgtgtttaaggcagacagccaggtgaggatcccagctactggggcctgctgtcatctcctgggagtacccgggggtcaggagcctaggggactcttgcacttcacatccagccatgctaattacactttttggcaaaggaaacagctaggagcagtttctttcactcctacagccccgttttctcagtgtttagacctcgaattattactgggctagagggaaggcagcctctgaagtgtggcaggaggaggggaagtctgcctgcatcttggtgtgtctgtcagatgccagcactaataacctggcttctgtgaggcctgtcagtgctctcaggaatgaaaggggacccctgagaggtgctcagtaccagcaggctgtgaatgctctctacccaccaccctcacctcctcgttaaagatggtgctacctgccacacagcagacatctggtcgctgcacacccgaaagaccccaaggcagtctgccccttgtccagccacacgccagcacccaccctcctggcccctgcctcggcctccccagaccagctgcacccagcccccaacacgcaccccttctccagatgtgtgcagggcctcattttgcagagcaaagacagatgtttcagccacacgctttattaacttctaaaacctgtgctcaggacactcttcaacagtcatgaaaagtttgatcacttgccacagtcaggacctttgtgtggggctctgatctgatgttcggtctcatcatctcccaaaccagcagtcgtttgtaccccaaccctctgctcaggggctcatacccccaaatgattttcctgatttatgtatttccctacaaagggctttctatacctagcatctgcctccagcatgagaagggggaataggtgagacccatttgccagtagcagacggggaccctggggagaaaatggcagagcctgttggagactccctgtctccagctgaccagccaatgggattcctcttccctccactgtctcccacaaagtagaagaatcctggtacatttagcccatgagcctggcacagatccctatctagacatgaggccctttagacatgactttggcattgaccagcctgttggcaatgggtcggggaggcagaggggatgctcacaccagtaattctcatcccctgaatgcttgggatcacctggggagagttcacaaaatactggtgcaggggtcccacctctgatgatgctgagtggtgggtctggggtgtggcccaggcatcatgatgtttcaggcccccaggtgacttcttaggcagcccagctaagcccctagagccttgcaatttcccccaaatgacctcagagggcccgatttgagggaaatgcctaacttcaggggccgtaagaatcccccagggagcatgtgaaatgcagataccaggcccacccccagagatgagctgaggtgggtcaggggtgaagtgcagggatcagtgtttttcacaagctccatacctccaggaaatggtgttgtggttgggcccgtagaaaacattctgagagtcctgttgcctgtgccttggtgcacgtggggtggaatcccagtggccctgccttgaggaggatgtgcattaacgtggtaggggagacagagacagctccacctgccccctgtcccaccggggacctccaaaaacttcatggatgttagagcaagcagccatgctgcagcagaggatgaggctggcggatttagtaagagccctctgtgtttgggctgagttctttctctagttgccctgtcatctggcctctggataacccacctctcctccctcatcctaaaattacagatggcgaaagacggccacatttagtgagacccctaaggtcctccaactagggtgggtccacagtggcccctggtgcatggaccacacactctcttccctcctctggctcaggactacggtctgaaattagggagatatgaatgtctttcttgaaaacttctcttcccagtcttcccactttgcttgggggtccttggtcaaggccagctttggggactagggcttgttgcgactaccagctgtctcattttgctgtactgcaaactcaggcttggttccaagcttatgggggccctgtccttcccctagtagggtttgttttggggtcacatctggtcatacccttcagagagctcttccccagcctctacatcagggagagaggtaggtagggaggagcattcaaggattagaagaaggactaaagtacaacagccttggaggaactgccaggaactaagggcgagcactggagaaggcaacctgggaccccctgcgcttctgagcaggaagaccaagaccttcaggggccctaagcactgaaaacatcattcctcatccccaagccctggcatccccctgttcttctaaaataattcttttctaggtatttctgattgcaaaattctggatgggttcatccaagctgacctttgctgttttttcccttcccaacaaggcctcactttttggagccaccttagctggtgcctaggcagaggggcagtcagcagtggttatcaggatcctggctctatgggttgccttcctcctggtctgtaaagcccctgcaggcagggacttcttagatagctgcttccttagggcatggcatgtagtgggtggttaatgaatggaagagagggaatgagtgatcaagggagggaggagggagtggagtggagatttctcatcctttcctgttaatttatgacatcctcctgcctatgagtccttgactctggagttttacaaagcagtcacatttcaaataaaagtctgggaaagcaacacatcatcgccaacttttaattttgctaaataaggatattagaaaaagaatagaaaattgcagtcccttactgtttaaagaaaaaccaaaagaagttaaaaaaaaaacaacctcattatgttgtctttgtttttgttttgttttctttccttggaaatcagtgaaagtttggtcagccacacattgtagtagggctagaatttttcttcccattttagagacgggagacctgagactccaggtgggggtgtggagtccaaatggacagttcttcccaaagctgagcgcagaccggcttgcaggtcctttttccagtcatggcctcagctgtctgcaaaggacttgggggaggctgacagctctgatgtctggagagggggcttctgcaacctccaacactggtcagtaactccacagaggccattggcgggggtggtctgcttgtatcagcaggcctgtcatggccagttcaatggtcggggctgaactatgtctcttggtgcctggtagaggggttggagtgggcctgaggccaacttgctcagagccacactccccaggaagctgtggagtctggaactctgccctgccttcctgtcccctgcccactctaagcctccagaagtcaatcctctgctcaccgggaccgtacctagcctggcccatcgatgtgtcatgtttgacccatcaagggtttcaaaaatttttaattaatttccaaaatctgagggtttcacctaaaaacctggatgtttggcttttctcataaaaatcagaaagtgggtttaccccaggctcctgttcccacatggctgcaatccgcccgcctcttccaatggtgcacatgccttttttcctgcgcccggagcccctctcagcctgattttgaggcctggctttgatgcgattcagctcatgacccctgcgcagcctcaagcacctaagttttggaggtcagtgatgccacttaaaaacctgttcagggcagagcgttagacaggaggatggctaagggagcagcttcaggcatgggaggactttcatggggaagtctttggggcagtcctggagaccctcacaatgtggccccactcctcctttagatggggcaaggtgggctggaacccccagcaaagggtcccaggctgtgtgagaccccgcccagcactccttaaacagccaagacaggtggaaagccccaactcaaaagactggctggattgtacccggctcagtgacttcccctctttgagactcagtttgcttttctgtaaagtggacctaatgaggcccgcttggcttcagctccagggactttggagatttaagcaaagcaagaaatgggaaaggagtttgttacatatcaggcttcctggaggaatgccccccagctctcttggagggggaagcaaaaagactgctgatcaggcaggggacgggaactccccgagtggccacatgggcagtctcagtaggagtctcaggccaggctctgtctgtggattcccacttctctgggctgcatctcactgttcaggctagagtctggtccttgcccatctgcaggtccaggaagatgtggccccaaattctctggacctgatgtcctagatcctgtgcacttggcttcatggatagagtctgagaaggttgcaggatccagtagctggaccacagaatgcagcctgggggtttggctaagatgagcagactggcccatggttgagactttggacctgagctgagtcctggttctactacttcctagatgtgtgacctgggacaagtgactcacctctgtgccttggtgtttttctctaacatggggctaattggggtaactaccttactgagctgttatgagtaaatgatccagtgggcgtgaagcgttcagcgcagagcctggcacgtaataggccctcgataagtaaaacagcaacagtagctgcagttaggagaatgtgaccccagaaggctcatgggaaaggaggtgcagtcctgatggatgaagggtacctgtcctccaccccggctgcagagcccccagtgagacagctgctgtggcatgctgcctctgctacacactcaaaaaacacttgaggacatgacttttccctctcaagtttgatgggatcactctgttccttccagacccgacttgtggtgtgaacttggacaagcccctgctgtctctggccttcagtaccatatttgtattatgaaactgcccttggcttgaagctagactatgggggtggcagctctaagtcctacaaacagtaggggtagtggtggggatgggcagcctgaaagccatgacagcagtgccttccttggggaaagaggtggcctctggagcaatgcttcgctaccctacatctgggtctgtccttgcccaactcctaagctgcaggatcgctgaggagtccacattgccatatctgccacttacagagtgcctactgtgcacccagcccacattcactagtgtcctcaaaacagccttgagaggaaaccaacgaggaaacagagttacagttcagttaagcaacttacctaacttgtggctaatgcatggtaggattaaacataagcctgacatatgctagccacatgaccctccctttccaggagcctgctggcattgatacaggttgacaaagaccagtcctactccgttgtctgccattactccagccaagtccagggacacgtgaggcaaggggagctggggctgctggtgtggccgagacctcagcctcagcaagatggtgccccaagctctcagggtgccctgtggtccccttcattcataacattgatcatgtttgtaactgtagttgattctcactcatcgcagtagttacatcttataaagtcacctctgacactgagttagcgcatactgaactattgatcctaggggaaatacagggttaggttcctgccagcttctggtcacaacattttcattaccaatcagtgcataaccttgttttatgtgtgcttctgtttaaagatgcctaatttactatata

SEQ ID NO: 179 - DNA, 1448 bp, Homo sapiens
catggcttagggacgctcccggccgccgcatccccagcatggggaaacttcactccaagccggccgccgtgtgcaagcgcagggagagcccggaaggtgacagcttcgccgtgagcgctgcctgggctcggaagggcatcgaggagtggatcgggagacagcgctgcccgggcggtgtctcgggaccccgacagctgcggttggcgggcaccataggccgaagcacccgggagctcgtgggcgacgtgttgagagacacgctcagcgaggaagaggaggacgactttcggctggaagtggccctgcctcctgagaagactgacgggctgggcagcggagatgagaagaagatggagagagtgagcgaaccctgcccaggctccaagaagcagctgaagtttgaagagctccagtgcgacgtgtccatggaggaggacagccggcaggagtggaccttcaccctgtatgactttgacaacaacggcaaggtcacccgagaggacatcaccagcttgctgcacaccatctatgaggtggtggactcctctgtcaaccactccccaacatccagcaagatgctgcgggtaaagctcaccgtggcccccgatggcagccagagcaagaggagcgtccttgtcaatcaggctgacctgcagagcgcaaggccccgagcagagaccaagcccactgaggacctgcggagctgggagaagaagcagcgagccccgctcaggttccagggtgacagccgcctggagcagtctggctgctaccaccattgcgtagatgagaacatcgagaggagaaaccactacttagatctcgccgggatagaaaactacacgtcccaatttgggcctggctccccttccgtggcccagaagtcagaactgcccccccgcacctccaatcccactcgatctcgctcccatgagccggaagccatccacatcccacaccgaaagccccaaggcgtggacccggcctccttccacttccttgacaccccaatcgccaaggtctcagagctccagcaacggctccggggcacccaggacgggagcaagcactttgtgaggtcccccaaggcccagggcaagagtgtgggtgtgggccacgtggccagaggggcaagaaacaagccccctctgggacccgccatccctgcggtgtccccctccgcccacctggctgccagcccggccctcctcccctccctagcccccctcgggcacaagaagcacaagcaccgagccaaggagagccagcagggctgccggggcctgcaggcaccactggcctcaggtggccctgtcctggggcgggagcacctgcgggagctgcccgccttggtggtgtatgagagccaggccgggcagccggtccagagacatgagcaccaccaccaccatgaacatcaccaccattaccaccacttctaccagaca

SEQ ID NO: 180 - protein, 470 aa, Homo sapiens
MGKLHSKPAAVCKRRESPEGDSFAVSAAWARKGIEEWIGRQRCPGGVSGPRQLRLAGTIGRSTRELVGDVLRDTLSEEEEDDFRLEVALPPEKTDGLGSGDEKKMERVSEPCPGSKKQLKFEELQCDVSMEEDSRQEWTFTLYDFDNNGKVTREDITSLLHTIYEVVDSSVNHSPTSSKMLRVKLTVAPDGSQSKRSVLVNQADLQSARPRAETKPTEDLRSWEKKQRAPLRFQGDSRLEQSGCYHHCVDENIERRNHYLDLAGIENYTSQFGPGSPSVAQKSELPPRTSNPTRSRSHEPEAIHIPHRKPQGVDPASFHFLDTPIAKVSELQQRLRGTQDGSKHFVRSPKAQGKSVGVGHVARGARNKPPLGPAIPAVSPSAHLAASPALLPSLAPLGHKKHKHRAKESQQGCRGLQAPLASGGPVLGREHLRELPALVVYESQAGQPVQRHEHHHHHEHHHHYHHFYQT

SEQ ID NO: 181 - DNA, 42506 bp, Mus musculus
  misc_feature (1)...(42506): n = A,T,C or G
ccatatgttgagaatcactgatctagagtttgagctccaaggtacagtccttccagaaattgttcaggaatatactgtatttagtaagtggttaaatctttaatacagttttaaagagaattattcttaaagcatccatcctttaaaaaataattatctgtagaactactaaatttagtattgtaaaagcattttgatgttgatgatttttctggctaactcaaatgaatgagactgagactataagatttatttaatcaagctttatggcaactggcataactgggcagttaataatctaatcctctaaactaatctggctacctcccagccaaaatccccaagatacttgcattttagtattggtctggctctctgggcttcaggtgttcaggtcttttttccccacgatgtctctccagaccccttcctcttggtgaatcctctctctcatcctccccttgtctgtcttctggctggcagagaagtccagccctagtctctcttctgcccagccattggctgatcagcttttattgacaagtcagagaataagtgggaagcaatgtttattcaaacttcaagatagcagctgcttagaataagcattgcaatgccatgtcctgattgcaacaagacatggggacagaataatgcaagtataatctttacacagtacacaataccgttatgcctacacgtataaacatgcaatgtgtagaaaggttatagtgaccaattacactgcagattaaatgaggaattgtgtatggttcacttcagtattctgagaatactgtgtctagtgaacatgttgacagttgcagattaattttagataggtcagttaggaaaataatttttattagttaaatgtcaaaaggaaagggactctatttttgcagtttgagtttgaaagtgagtatctactgtgcattgaaaaggaactgagtgtgaggtggagcacacttatagccccagcactgtggggatgcagaagggttaggagtacaaggtcatccttggctgcacagtgagtttaaggctagcttgggacacctgaggtcctatcggtcctttattgtcagccaccatacaaaatctagtaagataaatcattgaatttaggaaaatgcacttctttgggtaaagaaaagttaactagactctgaggccttgttctgtggctctgaaataatgattgtgtagttgaaatgaaacagcaaataattagtaatgactgaaacttttattgtctctagaataccttaggccagcctggtctacagaatgagttccaggacagccagggccacacagagaaaacctatctcaaaaaacaaaaacaaactaacaaacaaacaaacaacaaaaaaaaggcattctaatctgctgtatagattttagaaaattgtcttttaaagctgaattcttttatcctgtgactgtccttgtcagtatgtgtgaatgaccctgctcaccttgtgtcaggttcctttgcaatagcaaaatccatttgtaaaacaaaaaaagattgagcttttcaaagggggagataaaatttaaaattgttaggaagactaagaagaatcaaaagaaacataccttagttttgctgtagacactttggatacataacaaaattactccaagactgtaaaaagaagagtccaggaactgagtgcaggaacaaaagagagtccagacagagatgtgctgcagaacagcatgagacctaagctgagcccttgctacactcaggattctaagttctgatcacactagctggagttagagcatgtattggagagtttgtccctgatgtgtgatgagttagtgtctcttcctctcatacaagactgaagttttacctcctaccaagacgtaattctcacaagtggttcctgtcagttgggattggaaattagattttggaaggaaaaaaattaaagcacccactacagcagaaaagctaaggaaatgcgagaaaagatacagtgcatgctgtatggcaggcactgcttcatatacctaggcaatgagatcagagatcagacctgttagctgtgatgtgtaaaggcttacatttgagtagtttttagcatgttcactaggtattacaatcatcagttgggagcattttcctcactcagggctcactagcaagtcattccttctggcctcaatacttggcatattctttctgattcactttctgtccttttatcaacttttgggatttcacaaaaaatagaagcataaaatttgactctagctgcatatgtatcaaaagatggcctaggcggccatcactggaaagagaggcccattggacacgcaaactttatatgccccagtacagggaacgccagggccaaaaaaggggagtgggtgggtaggggagtgggggtgggtggctatgggggacttttggtatagcattggaaatgtaaatgagctaaatacctaataaaaaatggaaaaaaaaaccaaaaaaacaaacaaaaaaaaaacaaaaaaacaaacaaacaaaaaatttgtagccttttgtgattggctttcatgggggaagtatttactgccgtgatctgtaatgttggacaagtattgccttatggattgggaattttggaagagattattccaggaatggatagaggcatgtgggtaaaatattaacgcctaggtcttaacagcatgtaaggaggtgtacggaagacaagtcatttggggagggaaattcactgatccttggaaagtgaagtgctgtctattgttacttacaattttatgagagccttgtgaacttacataaaaagattagaagtctatttctgtgatcttacagtctatcattattgatgtgtataggatcaggatctaaacttcaaatggtagaagcatcttccttccttccttccatccatccatccatccatccatccatccatccatccattcattcatttggtggttgtccttgctagggtaatataggttagcctgagactagttctgatcatcaacttggcctcaaattcaagaaccttctgctccaacctccccatactaagcttctggagtgggccattgttcgtgtctctcctgtgtccttttgatcctaagttcctcccagattccaagaattgaacttgaaggaactagaatagtggtgtctctgttgactgagggttcagattttctctcagtattctaccaggctttttgtgtaagcttgatcatttacttgcaggtagagagaaaaagcttggagttgtagattagaaagcttgctaagcagtgatttgtttttccagctaatatttgcttcaagctctcctgtaaattagctatggcattcttactctaaagttcttaattgtggactctactttttgagtttggttatagaataaagagaaaacagtggaaactgagctttttatttaacaggaggttgtactgggattaatctgtagacatctttgacttccagctggattgtaaaattgtatacaatataccatgctatgtaaggatagaagcaggtttttcataggctttcagctgctaagaaattttagaaaatgggtttcacagatgcagtggggtgaatgaatacattccattctaaggtgctatgaccttgtgtttgttgtgttgtgcagtctgggaaatgctgaaagaaaactagtgtcatcctagtctcttcctaactccctctgtaatactggggattgaaccccaaggtctggttcatatgtataaatctactaccactgaggctcattctcagccttcacaagtttatctggagacaagtggagctggggtcacaggcccataccaccaccacttatgctctgccctttctgaatcatctgctgtgttcagaatattaatatgttgattgttctttggcttttatcacagctcattttaatccattccattttaaagtatgatccatattcctttaggtggtttcacgtttataatctattggtattttctgtattgtttttttattttgttttgtttttcgagacagggtttctctgtatagctctggctgtcctggaactcattctgtagaccaggctggcctcgaactcagaaacccacctgcctctgcctcccgagtgctgggattaaaggcatgcgccaccaccacccagcactggtattttcaagtatgttttttgttatgagatgcttttgaaatcaaaaaggcacaaactactatattaagtaaaattgctagtgagcccagagtgaggaaaatgcccccaactgactggtgattgtattacctagtaaacatgctaaaacgtggctaactgggctctagtctttctctttttctgactccctgcttgcagaatgcattcagatttcctgattctttatcacggtcactgtgctgtttgttttttcagtggtcttttttatatgtaggatacttttctttttttttttttttttatttaaacctaaccagttttaacatgttcttggaattttcatgtttctcgtgattcttccttgttataagatacaagaatattctttatttcatagaagcaaggctagtagtcagtctttctctgaaggctcacagctttgggattgtctttcatatgaggaatttacacaggaccgaatgtacagctggttatatactctgctcagctcaaggagtgagcggatccaatccagttttcaaaatatttatttatttatttatttatttatttagtgtgttatgggcattttgtctgtgtgtatgtctatacaccacatgtgagcctggtgccctccaaggcccaaagagagttggatcatctggtataagagttagggatgcttgtaagttgctctataggtgctgagaagcaaacccaggtcactggaagaacaacctgtgctcttaactgttgactcatctcttcagccccctcttttttgttttaatttggtggggactttattaactcttacaattgagtaatcttagagaaattgaaggaaattcatattcttatcttgtaggcagtagattatcattttaagattttgggttaggcagcgatttgtagagattattctcatctgccttgtaggaatcccagacttgaaagcaggacatctgtttgagggttttgggctcatacagtttgaggttatcttgtattagacaagtcctccgtgtcatatgatgtactccattccatttccccagcagaggagaagtataccattggtccacttctttagtgcagtgctcctcaacctgtggtgctgaccctcacaggatcgcagatcagatatcctacacgacagatattcgttacgattcataacagtagcaaaattacatttatgaatatcagcaacaataattttatggttggggtcagcccaacatgagaaactgtatcaaaggatcacaacattaggaaggttgagaaccattgcatagacagcttactaataacctggactctcaatgtaatgttcaaatttaatgttgtaatcttttttgttgttgttgtttgtttgttttttttgagacagggtttctctgtatagctctggctgtcctggaactcactttgtagaccaggctggcctcgaactcagaaatctgcctgcctctgcctcccgagtgctgggattaaaggcgtgagccaccatgcccggctaatgttgtaattttatttctgatgggatccccatgggaggaccatgtccatcaatttgtggtggtttttatgtatgtgagcacttctgattactgtctgcagacctgtggacagttcagaaatgttcacttccagctatttgggagttctgttgtaccccaggctcccccacccacgatgcatacacacatagagatttgactttagtaatacattttggattggaagaataaaatactactttgttgtaaaagggtatcaaatataaactgcaatataagagtctcaataggcttataaaatggtaagtttgtcataattgtatacatttaaaacttaaggcatgtatgtgatttaagatattgtaaggagtagacaggatgaagagaatgtgtggaatgtagaattagcatagctacttgtgtgtactatgtcagatactgtggtaaataaatactttaccatgctatttgatttatcccttatgagagcccagttaacttttttacagtcagaaattattaaaaatatagaggcagttggttgtctggagaagttgtgaaagtttgagccagaggcagttgatacataacctgaattttgcaagatgagtagcggttgtgttgagggctgagggcagtcatcacatgtggtcagagtagggataatagaggctagtggcacgagatgagcccagctcttcagcagctgtcagcagttctatggttccagaggctaacactatcagagcactgagagggcttcttaggcatcctgttaaaggaacagtattgtttgagagttttgctttttttaaaaaaaaaaaaaaaggcataggcagtgggaaatatttaaaggtttaggtgacaaagcaaaatcatattttggacagtctgtgtttctcctaatatctattggttgagtgtatttggcatactcagttttttaaacttagttttgggactgactatcccaaaagaaatgcttttttttttttcatgcttgaaaagttttctgcagctattattagagtttagtgatgtcacagcaaattacctacttctatttagtaagtttgcatatggaataatacaaacggttgtgactggctctctcaagcttacttgtagctaacagtgtgcacagctatcttataatagctcttagcatgttgtcaacactccattgtgatttctaatcattagaattttgtagttttcatttttaataatgaatatactgaatcaaaacattaaaaagtcactttaatagtataacactcaagtgatgtgaaatgacatataattaaaaaaatcatttcacttttgtgtcttacttgctttgctcccatagatgcaaccaaaattcctatgtcgtacattttagaaataatttgtgtccaggttatcaaatgtatttcatatgttcttattcttctcccttgtgtttatttcacttttatgtaggtatagcacactttgcttgttgttctatacacttgctttgttcagctactccagtatatctgaaagtgttccaatcagtatgtaaaaggggcatactagtcacagtgtaaactgagtgtagtttgctaatttccctttggacatttccagtctcttaccattacaaacaaatttatagagaaggttttcttgcatgttgcttcacacatgtagtaatagtcctgtattattagttgatggaagtggtagtggttaatgggatagctcagtgagtgcagatgtttgctgccaaacctgattgcctgtagacttctatcgctgaatccatttggtgaaagagagagaacttatctctgaaggttattctctgacctccacattcatgcagtggcttgtgtacacacagtaaatgagtaaacttacaaaggcagagtgtgtgagtaaaggctcctgctgtcaagcatcgtgatctacatttagtctttgggaccttcatgatggacaagacacccaactcttgaaagttatcccctgacttccatacctgcattatggtgcacgcctgtgcatatatacatgcattcatacatacataatatacttttttttttaaagttgtgggcatttgagtttgtagcttagtaatagagcacttgcctagcttgtgcaaagccccatgatttggtccacaaatacagcagaaagaaacagaactgtagatatatgtgattttgatagtttctcagtgttacagctctcaccttccttcaactcgctctgtagtcaggcggcctcaaactcacagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggcagtacaggattcacagctaagctaagggttggtagcaaaggactgcaattcttattacttgggaagctaagggaggcaggttccaagtttaagactggctggataacttagtgagttatgtctcaaaagtaaaaaatttaaaaaggctaggtagatagcttggtggaagtatatacctgatatgtgtaaaaccctagtaacacacatgcagccacataattggaatcaaaatttaatagttgttggaaatggagctgaaataatcccatagtaatacatttggggggttgatacttgaggcctgatccctgagatgaagctgaggtatgggtgtctagaaggcattttgtctatggcttttgttcattagttgagagttttaagtattctggatcatgcttatttgttgtttttagtaacattttacaattgaagaaggcaagttaaaagttgtttcatttgaagagataaaatttttaagatgtctaattactttacttcaaaggtattgccattaaagagtctgcaaaagtgggtgaccaagcccagaggagggtgatgaaaggcgtggatgacctagacttcttcattggtgatgaagcaatagaaaagcccacatatgcaacaaaggtatgtttctaagagggctccaatcagccggtggccggtttcactctgttgtgggcttgttgctctctcacattgagttttctggtttaaaattttcgagacaggaactcacctggaactggctgtgtagaccaggctgctcttgagttcatagatttgcctgcttctgcctttttgagtgctaggattaaaggtgcttaaagccagtttaaaaccatatctcgctctgctctcatcttcctaactgtagaaatgtctcctttcccttcagctttaacacagtgaagtgggtggatttacttttctgtgccctagcctctcagggccctcggtagggaatgagtgttctttcgtctccgcattactacatctagagagatttccttcttggatcagatactcatttcttctaagccatgagggaatcttgttcttcctctttccttccctgccttttctgtctcttgattgacatagaacttacacagcaaagcaagtagtcttcattatgcagcttggagagtttatgtggctgattgtaccaggtaagagcgaatcttgtaacacaggtcttcctgtgtctttgttcacagccacttctacagccttcttggaaggtaaacacttcccaagcattcatttcctcctgcgtgcttttctctctttgtaattttaaatgaataactaccctaccatatgtaaaaataaatcgttacagttttttgctttgtgctgaaaagaaagtagcaagaaacaacttctctcccagggatattatgaagcgagtaaaaggaaaggaaagcaggatagggcgttgtaggcatgaaccacagaagttgttagtctagttggggatttagcagtccttgagggataaattcttgagctgagtctggagttaggcaagatgtacagacagccattaggcagaagctagtacaaaagagggcttattaggaagacagggagcagcatagcttatgtgcctgaaatccaggggcttcatgagagccagttccacccacaggtaacattcatggatatacttgatcaactgtgttcctaagttctgtttggatttgaattttggctgtgcttctttttagctttgtggtattattctatggcttatctttctgtaatttagttatttgtggatgcaatggagctattagtacttcagggttagtgtagaccttgtttagaggatggctataaagaaattgttgtagtactcaaatagtgaagtgtaattatttgagggaggcatgtgtatttctgaagtaatgatgtatggcaagggatgtttgtgacttgggccaaggcagaagttttcaaccttaatgctaagaccctttaatatagtagttcctcatgttgtgatgattcccaaccatatattttgttgctacagttatgaattataatgtacatacctgatatgcaggatagctgataatcaaccccccaagggttcataattcacaggctgagaactgctggactaaggtaaatgctagtagggataaagagtttaaaggggtatgtgtgtgtgttcattcacatgtgtacattaaaatgttacagaaaaattcaaagctaaaagtagagtaaagggctgtttgtggtgcacacctttaatcccagcccttgggagccagaggcagaggcagaggcagaggcgcagaagcagagagagaggcagagaggcagaggagaggcagagaggcagaggagaggcagagaggcagaggagaggcagagaggcagaggagaggcagagaggcagagagagaggcagagagagaggcagagaggcagaggcgcagagaggcagaggcagaggcagagaggcagaggcagaggcagaggcagaggtaggatctttgaaggtttgaggccattctaattgtgtatagcagttaccaggccagtcagagctgcatagtgagactttgtctcaaaacaacagtaaagtaaatcaataaaaatagaagaaaaatatattgaccccacacttccctgtcactcagctttggcaattacaatcttgtaactaaccttactttgttatttcattccccaattattttctagtcatttaaaagtacttgcctgttaacagcaactcatggttttagttagagtttaatacatttctctgagtaatttctaattggtaaatgtttgggtcatggttaaaataagaactttccactggattttgtagttaagtctcatgagtcttctgccctatacttccttctttttgtgtatgtattttgtccttatttcttggttatttacttagagggaaaaatcagctgtctattaaatttcctgtattctcatcttttgattgcatttttagtgtacatttgccatgatccactatttcttgcttattttttattgttggcatagaaatgtaaaaatctacatcagaagtatgctaacgtttatttttttgagaatacatagtatatttgaagtacttatgaggcagctcatctgttgccagacagtcagtgtgcaggctttggagttcagaaacaagatggataaggaagagataaggaagggatcagttactttgggcagtgaatgttgtcacctaggggagtctacagcaggagagaagcctgggaggcgcactaattaggcttgagtggagaggaacagaggtgctctgcatggaacatcctataagatgtctgctgaggcactgttttagaagtcgggtggagctggatgaatgtagctttgtgaatggtagatcaagaaagagtaacaaatgggatactatatcttgacttagggagggagagatgaaaggataagaggcagaagatggaagagacatttactgcttaattctgcttagaaaactgaaaggggtacataacaccgtcttggagaaagctggaggagtgtattctagatgacagattggatgaggtgggagctagagaaatgggcccatggctatgaatgctcacagttctttcatagggccttctgctcataactgtctggcaatccagccctgggggataagacactttatttctgaactctcaggctcctgcattcacatgtacataacacacagagagacaaccatgtatacataaatacagggaatattactaacattatagtagaagtttacagatttggtgaagtagattcaattcctctcttgagtttcctttatctgtaaaagataatagacattacctgctgctcaagggaagggtgcctagggaacgctgagattggtgtggtcagaagaatcaacactatggagtgtcacaggagcagagtggttagtgtagatggactagagaaggtgaagttcttttgcaaaacacaataacatgctgtcttaggttgggtttctattgctataaagagactccatgaccaaagcaactcttaaaaagacaaacatttaactggtgtacagtttcagaggttcagtccattatcatcattgtgggaagcatggcatcgtgcaggtagacatggtactggaggagccaagagttctacatcttgatctgaagggaaccaggaggagactgttccacaggtagctaggaggcagcactgattccaaactgtgtggagcttgagcactaggagccctcaaagctcttcaacatgtgtcactctgtaacgcacatcctccaacaaggccacaccttttcaggcatattgaaaccatcacacatgccttctgaagtattgcagccaagggtgctcaggacagcactgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttcctggatttgggagtatgtgtgcagtatttggtttttatatagcaacagctggcaacccaatttttcgaagaaacagtgtcatgaagtagtgtagcacactctgatgttgaaaaccagatgtaggctaggctagcacatggtgtggtgtgtatcctgtgtatccttatgaattctaagcctcacagatgtacttgtggattgactaataacctagaattccttgattcaacacaaacctatttagctttctaaagtaaatcctaaatccttaattattattctagtattaaatattatatatttaacaatgtttttatttactgatttgcactattattattttgaggtgacatttcactgttgcccagagtactctcaaagttgtgagcagtcctcgtgtttcaacctccttagtagccaacacagtaagtgtgtgttaccatatcagataccaagtgtgtactatgttagatatacaacagataccagttaacaagctaataattaaagattaagaaaattaggataaagtttaacatttttgacaacattcatcttacgtttcaaccacctggatatatattgtaaaaataatttcatttctctaagtatgtacatttctacttaagcatgtatagcctcaggatgaccttgtgttataaagaaatacatctttttctagtatctactaatgagctaatagtctctgcttcaaatttttaacattaataagacttaatttctgaattttattttaatagtggccaattcgccatggtatagttgaagactgggacttaatggaaaggtttatggagcaagtgatttttaaatatttaagggcagaacctgaagatcattactttcttttggtaagtacatattctgatttattggagactccccctttttctacatgggatttataagctcaggatggctttaaactcagtatcatctctcttaccttcccaaatgctgggttatcaggcctgtgccttgatgcctagcctactaggaaaatttttaaggaacattttaatgtttctggtgtaattagcaagcatacttaatcatttaagttgtcttgtctgaaagactttgttacataaaactaggtcattcttaaaaccgactggctgcaggtagagtaacaatgtggccaagcactaaagtgtaatcttgtaaatgcttttggtagttaatatgtaatcattacgctatcacccgaaaatacttgtttattccgtcactgacagaatcatgggagggaagaaagtttgctttcagctcagtttctgaggctaacctccacagttgtttggctctattgcttctgagcctgtgcctagtgagatagagcatctctgggaagcagcttctcttacttggtttttaaacgatttgatagggacttctaacttcctagtagaataagtgaacatggccttttttccccttttatcatctcacaacataaaatgactgtcatattttatgtctttttttttttatttgagtatgagttttgctaatctagtgtttagtgtttcattgtggtgctttgtgaatactatttgtagctggactttatttgtagtgaaaagaacataactgtagacacctatatgcctacaacctaagtgcaataattaacatttcagtataattacatttagcataattgttttgacatgtattggtttatccatctgttaatctgttttgtttttgaatcacatcaaaatgagcaatatacagatgagaatcaattcatgcttaaacatttagtatgtccatcatcaaacagttcattatttgtttatattctttttcattttttttttttttcaattcaacatgtcctcttgttgggctttatttagcatgccaaaggggtcagtcagcaagaattgtctactaaatgacaatcttttttttttttcctttttttttaattaggtattttcctcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctggttagttctaatgttgttcccctatagggttgcagatccctttagctccttgggtactttctctagctcctccattgggggctctgtgatccatctaatagcagactgtgagcatccacttatattctttttcatataaagtttactataaaaaaaatcacaaagctaaatcattctatagattttgaccaggtgtggcaaaagaaaaagggccagatagtggtaggtatgtagtaggtaggtaggtaggtagatagatgtgatagatagtttagatagctacctaggtaggcagacagacagacggatggatactaaagaaaccaaatgagagcgtagcaggttttgttacagctatccagctctactgtagagtggaaatagccatagaccatacttaatgtagtcagtaagtataaatgtgtttctgtaaagtagtttttcagaattaggtgattggtccacctttagttttaacagctgtagttgtgtaaataacacattatcaataccttttctagttaatttatgctccttattccctagaggtaaccagtgaatcattctattttaattttattttacaagtgagattaatcttgcctgtagttggtttttacactgatgaattcgtataagatgtgctatagtaaaatttacatcatgcagttatgtatgacagtctggctctttgaacattcttgtccttatagacacttaatctcatctcttttgtggatttgctctgctgcagggcagacacttaactggtatagaactctggcctagggtgactcttcatccaacattgtaatcgaattgctcctgcattttagcctgttaatctcttttaattttagtcattatgattgttgatttggtcttagtttgcgttttcctggtggtgacttgtaatgatattgaacaattcagttttttaattgaaaataaaattttcaattatactaaaaattataataaatgtgttctgattatagttcctttcccccagttcctcgaagatctttctaactttcccccgaatccataccctttcgtttctatctcattagaataacaaacaagcatctaaaaacataaaccagccagcatgggcaaaacaaacggggaacaacaagagcaaaagcggaaggaacacacagacactgagaatatgttatttttgtatatgtgtaggtctgttttactctctatggtcttcctgtagtctttgtgtctaacctataaatttagtgcctttcaaattattttataaattagttcccctttagaaattgcctataaagtttaaagtgatctgatactgtctatttaaaataccattcaattcaatagactgaacctccactgaatactccagaaaacagggaatatactgctgaaataatgtttgaatccttcaatgttccaggcttgtacattgctgtgcaggtaagtggcttatgcttatttaagcttgccttttacattttatccaggcttaattttctcctaaaccatgcatatctcttttcctagaaagctttagcataatttgaatcataccatnnnnnnnnnnnnnnnnnnnnttggtatattaatatatacatattctagtttgggttcttttaatattatgtgaaactcttccattgttaaacctttaaaaatattgtgtgctggtaagcagtcattgtattattgaaatgattttgttgttgttgttgggtgatgagccatggctgcaatctcaggagtctgaagccacatgattgttgggaggttttttggtttttgggcttttttattttgtttttaaaggagggtagtagactaaatacctcttggttcctttttttgttacattgtaagcaggcaaagttagttttatcatctgtttttagtaactactcatatattttgattttaagaaattaccttttttaaaaaactgatactcagtttacaaaagttacccccatccccttccccaccctgggaagagttgttttgtatcagccatcatgagattcttggtaggaaagtggtattgtgtgctactggttttctagttaactcatggtgtctggaagtgtgtatggccttttcagttaaggtacttgtatactgcagcttgcacttaggaacttctgagttctgagtttttaagagtagtgcttgctagctcatggtgatgacaggatatactggtagtttgtggtagtctgatatttaagcttgggcaaggtcgtgctgtgcatattacatacatgtttgtgtcactcttgcttgtggctctaggaagagagcgttccttttaaactctgaactttctaagtatcctgatgcagtaagaggcccatgaactgtagacagtatgtagtctcattacagcttacttctgtagactttcacccctagtaactctttaacaggttattttttgtctgtcttaaccttttaggctgttcttgccttagctgcatcctggacctcaagacaagtaggagagcggacgctgacgggtacagtaatagacagtggagacggagtcactcatgtcattcctgtggtaagtacagaaaattgctaaagaggatgtgaaatagtatacccagaggcaaatggtaggaaagatggacctttacaagactggaagctcttcctgggctaccaccatcactgactgcatgaggatctcgaagatcttaagagcatcaacagtgctaaaaggccaatgtcaactccttatcatactattcccccaaatcatagctatgtttgtgaccggtaaaggtcacagagctgagaagagtgttgtggacctcacacagtacataaggcgtgatcagccccagatttgatttcacttaaagccctaggaaaggggcagaataatctgtggtgacagtctcacctggcatcatgggtcatgtaggaggaaaagaagggcacacaagaggaaaagttcttagtgagctcaagtagcaaatgacagcttccaaatatggtgtacatgatatctgtcagccacaggctttctgtgtgaatagtttgcttgtctagtaacttcatagaagaggaattatatactctggtctttatgacaggctgtgttgtgttcacttatgtttttgaaattgtccatgttatagtacatatgcttctttatattgccaagtctcagtttactgtgtggatatatccccttttgtttagccttcaggtgtcttttaatatcatattaggatgtacctagcatttaatagcttgtataatttacttgatagctctttttttcccctttgtggtatctaaaataatttttgtgggctgataaagacttggtgggtgagagagtttgttctcttctgtatgaagacctgtgttcagatctcaagtacctacatgaaaagcaggtcatagttgtacatacctaatcacagtagtgggaaacagagacatggtgtagtttcaaggacccagtggcctagctaaaaacagcaagtttctggttcagtcagaggcactgtctggaggcaatagtagatgaagacaccttgaatcctgccacagccttgtagatgctgggactttaggtatcttgtcacaactggctaagaaatggatcttaatttttctaatctatttttagaaatacaatttttaaaaattattatacagaaatgaggtgagactactcgtgctgcctgggcatgtgagtgggattggatttctccctgcaccattatgtagtttatagggattaaactctagttttcaggacctggagcaagcactttccccactaagcagcttactctcttgggaacactaaagtaaatttgacacttttttctccttgtatgtaggctgaaggatatgttatcggcagctgtattaaacacattccaatcgcaggaagagatataacatattttattcagcaactgctgcgagaccgagaagtaggaatccctcctgagcagtccttggaaactgcgaaagcagtgaaggtaagctacacacactgggtcagctggagacgagtccctgcttaactgggatggcagaactgcaccttacctaacatgctctcgtcaaagcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtaattggcttgttgagctctgcagtatagatacaggaccattaatcagtgatgtggaacatgacaaaaactgtgaatgggtatgtgaggtatttgattaggttttgacaatgtatgctctttcttatatcatttgtgtcatacatgcagaaaaactatttacttattctttttgtatagcttttggaatttgttgtttatcaacaaagctaaaaattttctgtatttctcatgctttgaatatgtaaatctgcctttgcaaaaataagtctcatttatttgcatctcgttgtacgacctttgtggagatgtctttgttctttcaagcttagccatgaagatgtcttgactacttcctgtatagtaaagagactactaaatggtttctgaactttatgtcaagttgataacctaaaaactaaacatacgaagccaggctcacacctttaatcctagcacttaggaacagagacaggcagagctctaaatttgaggacagcttactttacatatcaagatctaggttagcaatgctatagagagatcctggatctcataaaaacaacaacaaaatccctccatactactaaatgcataaaaatttaatcaacactattattttttaatttctttggcaaatctatgacattaaaacaaagcaagcaagcaagcaaaaggatactgagaatttagatttattccaaggaagactgctcatgctgaagatctttgaaaaaaacttctctaataaaatttccatctccaagatttggagatagatgtgtgtgatgggttgtatatgcttggcccaggcagtggcactattagaaggtgtggccttgttggagtaagtgagtcactgttactgtgggctttaagacccttgtcctagctgcctgtaagacagtcttctgctagcagccttcagatgaagatgtagaactctcaactcctcctgcaccatgcctgcctggatcctgccatgctcctgctttgataataatggactgaacctctgaacctgtaagccagccccaataaaatgttgtccttataagatttccttggtcatggtgtctgttcacagcagtaaagccctaactaagacagtgtgtaagataatgagattgttctttttttcatacaagtcttcccttttgcagggggattgaaacagggtctcactatatagtgctggctggcctcccacttacagaagatcctcctccctctgcctccccagtgcgctagattaaaggtgtgaaaccccacaatgccacatcatgacagctttgtgtattttgttgttgttgttgttatctgtgataataattgtcgctgcttggaaaatgtccttggtattcagaattacaggatattgtgcatatttctcaacagttgatggagggatagatagaagcagtgggatacagtcaggtaatcatggatgttaattcagtctttcaggcaagagcagagttgcttacatttctatatttcttctttactcattaccttgatcagaattagttttattctaaataggcataaaggatctgtgttaatttgtgttggtataggtattctttttctatttgtgctttttggtttttgtccattatagaacattctattttgttactgagatagtagatgttgaagtcttttgtgcatgattttataaagtaacattaaaattgttaggaccaagtttagtctttcagattttagttgtgttgatagatggggtaagaaattatgtatggatgaaccattcatttgtaccacacaatatgatattctagtattaaaagttcacctctcaaaattacttaattatatctttttcatttgattgtttaactgatatactataacttgacctaaaacaagagaaaaaaaaacttttatttatttggttttcaggaacgctacagttatgtctgcccagatttagtaaaagagtttaacaagtatgacaccgatgggtcaaagtggatcaaacagtacaccggagtcaacgccatctcaaagaaagagttttctattgatgttggctatgagcgattcctgggacccgagatctttttccatccagaggtaatgcttggtagttggtgtgttttgttttgttttgctttgttttaaacagatcactttgaaatatgcagcagaaagtcagaagaaattgagagagaatcattctcagaaacttttagtgtcggaaagcaccatagtgaatgatttctcccctacacccaacccctgcctactccccccacccccacctgagaagagtctcctgttaaagccttcttatctgtacataccctgcctctttaatctttatgtgctggggagagctaaggtagaaggtagaagagcaaggcagaaggtagccgttcatgtttgtaacagcttaatccctgggaaagattccctgcccctactgcaaaaggactgtgtggaatctaatgaacacaaagtcttccataaaataataaaatagatgctcttggtaatctttaataataaattcttcaggtaacttgatattaagaatttaactttactagaattttggtattcagtgcctgctgtgcttattcagcatcaagaactgttattttcgataattgctttttttttttttttttaaacacagtactggctgtgactttcatggtctcagattaagtgttgactattgaaagctgaaagactatttaatcgtattcttttgaggttagagaataagaaaagtagttaaatgagagtagttgctttaacagatggacatagctgttgagtttgtagaaatagcacaggtctgctcgcaagaaccaggaaacttctcagagggattaacatgaagtcagcccaacagttggctgggtaactatcttacatgtttgagaattcatagtgtgtggaaatataacatggagatgtgtaggagatacacacacacacacacacacataaaggtggttttgtatcagaacaatgatttgaattgggttggaagcagatgagtttgttgtagattttcaggtgaataaatgtcagtcatggagaaaggagaaacaaaatgagggctttatgatttagtaaatacttagctgtgagagggataaggatatgaagaatctgtaccttgagtaacttagattttgtcaagggaaatgtagggtggcagtcagaataactagagagcagagcagatgagtctctggaaacttggactcagctgctcgtggtgctgcagctctgtaggtaaccttgtcactctggaagctaaggcacaggatctagagtttgaggccatcttaggctccaccaaaccaaaccaaacagcagagctggagttgtagagatttacatttttgatccattgccccaccccctgtgccctcccacagacacacaccgagttgtaggcatttttgaattgactttgagctatggaagataactgcctcttctcttctgctcttgtccctgtgtgttccctttgaacacacagttctttagcatgtgagttaaagtcagtcagtgcttctgtctgcttgagctacttacctactctgtgacagttcatttaggggacttctgacaccctctgtgtactttgattacttttagagaggataaaaatagctcagaaagctgttttcggaagaatagtctgttcttaagaatacattaaatagaagtcttgaggagagaacatttgatgggctcctacagagaattggggctgactatgggactgtatgcctttgtctcccctgcctcaatttctaagcctccagatgtagttagttctttgagcgaaaggtccattatagaacaacgtcattcttgtttgacgtcactggtgactgaagtgtaagggtcggcacattctcaacagctgtacctttgcattgtctgttttagactttttttcaattaaaaactctctttaccaatggttttaatttggtgagagaaaattagatgagtgtatttagtttgttcactgtagtttcccagaatagaacttgcttgtgtgtgtgtgttttatagaaagtgtgctacttcccaagtgaatatttaagattccttctgtgttctagtttccctgttaattgaagtattcattcatttttctaatttggactagatgaatgatagaatatttaacctatctaagatttgaatactgatgataaaatatatggaagatgagaagattgacttttggtttttattagggatgtttttacaatatattttgatcataattctttcccctcccctaacttcccagctcctttcctcagctttgtaccagctcaacttcatggtgaagctctgtctctctgtctctgtctgtgtttcttttctctttctcaataaaaacgaagaccagtaaggcaaagtagacaataatatatgaagtctaaatcactcagttttgtgttggcttcctgggcatggaccttgccctatacccaggaacctcgctgattttcctagtagatatcagttactgcagagtttctcattaaggggtgggaatttgtgtgcccctctcagtgctgcagtttgtctggtttgagcttgtgaacatcttgtgtgtgctgcacactctctaggttttgtgtgtgcatcattcctatcatgtctggaagacactgcttccttggagtcagcacctctggctcctattctttcagcctcctattattcccatagctccctgagccttgaggatggactgtgatgcagacatcctgttgaaaaaaaaatttttttttgaatagctaagttcaccacagatattagaaagattttagaaggagtgtatttggaactttaaattttttttttaaagaaaaatttagccgggcatggtggcacacgcctttaatcccagcactcaggaggcagaggcaggcggatttctgagttcaaggccagcctggtctacagagtgagttccaggacacagccaggactacacagggaaacccggtctggaaaacaaaaaacaaaaaacaaacaaaaaaaaaattaaagctattttatactttaaatttatgaatatatttctaactatgacacagacatggggtattgtatttatttgatatgttcagtctacctgaataatcctcctttaatagcctcttagaacattctcagcagcttgtgctgctgagacctgaccagggaacagttagactagtacttaaaaggaagctgaaggaaggaagggccaagaattagtttgggggaaccactgttgagtttattaaatttttgaggaaattttaatttttctttaacccgtttatattaacctgaccttctttttccttaattagattattatttatgtatgtggatgttttgtctgcatgtacatctatgcaccattgccctgctttgtgcccatggaaaacagaagagggcattcattgatcacccagacctggagtcatagatggttgtgagctgtcacacttgtgggtcctggggttccccctggaagaacagccagtactcttaactgctgagctatctctctagctctaaatatttaaaattttaaaatttatatttatatttatgggtgtatgtgggtacacttgaatgcaggtacctgccaaggccagaattggatcttctagagggtcaatcttcctggagctacttaaaggcaattgtgagcttcccccacataggggctgggaactgaactcaggtcctctgcaagggtagcacacacctttaaccacttgccaccattctgattttcatttgggatattctgcattgtagtggataggccctatattccaacagataggcccaagttaaacttcatttctttctgtatcagaatttccatggtggatacagagtataggaacatagagagttttgtaaagttttacttttgtgcattcctggttaaagactaaaaactggaagttgtgtccacacctgtaatcccaacactcagtaggttaaggtaggaggattaccgaaaattctgggccagcctaagcttcttagaaaaattgtgggtcagtaaaatcagacatgaggagatggagtgccgtgcaaaggatgcagacacagctgtgatgtgcacagccagccctgctctctcgccttctgttcacagtatagcagataagatgagcaagattatgggaaaggttaacaatatatcataggagaagtgtgtgtgtgtgtgtgtgtgtgtgtgtgtgtgtgtgcgtgtgtgtgtggctgtggctgttttaggtaaatattagtgatgacaaagggcaatgaagagactttactagttatgcttaacagtggaagggttttgtagaaatcagtgtaataaaaaagatttttctgtcaaattgttactttctagatttggggaaattaagtgtttgtttgttaaacaaacaaaataaaaccagtgccaggttctgaagttaaagtattaccatgggcttattattaccacagtgctttgagaactaagggctcttcactgtttgcagtctaaagccaacaaagattgtatgtagtcacaaatgccatcttggacagtagtctcaagttctgttttggtttcttttacagtcagcctgcctctgactgcatgtgagcttgtctttaaatgacttgtctagagctagccaagctgagctctgttttctatttccttataatgcagagttgggatctactttacatgtagcggtctacaaacatgtggcatgttggtttgcttttgagcatcacatattagatagagatggctttattttggctatgatgaataatactaaatacatcactgactctttgtcttcatctgttgataaagtccttgagaatattataaagtactgcatactgaactattgctcctaaggaaagaaaaagatagttttctgtcccttgtcaagttttctccatcctatctgcatacctctggtcttgtgttcatctgaaataattgttgacatccattctgctatctatgtcttaaagatgctgcgtaacccgcactttgttggtaagacacaccccagacttcttcctagacacaggtctacacgtcagcatgtgctgtggatggggtctaatcatcggggtcacatcaggatcatagcaggggaatactaaccctaaactgtaccacgctgttcagcgtcaaccaggaacgtacaagtacgcacttggattgaaagtgctgctgccctgtgtatgtggaaatgagtgtaacctgttcatatgagggtagcaagtcagtttgcagatgcagaatctaatgactaggtgtacaacatcttacttactggtggaccattggtggttattttcacctttttatagattttattttatgtgtgtgttttgtaagcatgtatgtctgtgtactacatatgtgcctattgcttgtagaggtcaaaagagggcattggatcccctagaactggaattaaaggagggagccagcgtgtatgttttggaaacagacccaggtccctctgcaagaacaacaaatgttttacattgttgagccatttctctagcaccttttcactgtggtgaagttttacataaagtatatagatcagagttccctttgggaatgtttgaagaagagccaatggtgtgtggctccttggatctttgacagctgttgccagattgttttcctcttcaggtattctcttagctgtgtacagaagttcctattgtatatctactgtctcatagtacgggcatggcttgttaattgaatcttgcctgacttctatcctcagtagctgtagtatgttggtcaccagggtcctttcactcctgagctggattgttattaacttgaacattacactaacacaatgttaacataacaattctatacactcatgtataaaatgtacttaattttcagtttgctaatccagattttacacaacctatctcagaagttgtagatgaagtcattcagaattgccccattgatgtccggcgtcctctctacaaggttagtgtttacagcaaaaactggagttttaagttttcttttcataatatttaatagcatattttaaagcctttattttgttcattgttgaatattagagaattgtgtcttagaaaagacacaattgaattcttgtatatttgtctctagattgcttctcttttaaaataaagatcataatttttgttttttttgtttttgttttctaccaacacagaacattgtcctctctggtggttcaaccatgttcagggactttggacgtcgtttgcaaagagatttgaagagaactgtagatgccaggctgaagttaagcgaggagctgagtggtggtagattgaaggttggttttctcaaccattgacagagaatgtggaagacccccttgttactgcattctggacaggaatgtttgccagctctcacttaggagcattaagacaatcatgccaggcgtcctgctggaaggtagccactatccctagaatcatgggtgcagtttgttgcttggtactttgctctggtttgagctctgttgagaaatgacaaaacgtcacagctcaggcagactgcttgtgcaaaaaaggtttttatgtttgctttcctcctcaaccaaccaattcttctgacactcacataactccactgtgtgaaaggctgacttgtgtttcacagatatagttttaaatctgtgtagcagggcctggtgagatgtttgttgtacacacccagtgacctgacctgagtttgatccctagaatccatagaaaggtgaaaggaaagaagcaactctcagtgttatcctctgccctcctcaagcataccatgacacacacataaaagtttaaattctgacttaggggaattcatacattgattataaacacaaggtatggctgttgacctgagacatatttcaccagttgatttaagaatgatctgtcaagccaaaggaaaacagaataaaattaaaaacagaagaaaacaaaaacaatgttatattatttagtcaaggaacatacattcctcttttctctctctctctctctctctctctctctctctctctctnnnnnnnnnnnnnnnnnnnnnnnnnnnnnnnnnnnnnnnnnnnnnnnnnnnnnnnnnnnnnnnncatccctccttccctccctccctcccttcctcccttccttccttccataatttggggtggtgtgtgtgtacacgcatgcacctgtgtgcttgcattcacacatgttgagatcaaaggataacttgaatgagttggtttgatccttttaccatgtgggtgggtcctgtgggcaaactcagattgataacaaatgccttttaacactgagccatcttgctggcctattctccagttaaggagctctaggaagcttcactttgctcactgtttcctagcctggacatatttgaagagttcaggctgtgtattttctgaactttgtcttggtatgggtctgtttggtgttccttctgggtgggtgtagtttgtgctttgacagtcacatcacagaagcgttttcatgtcagttttactgcgttttgtcagagaatgcattgactttaactgcttggtagaggcttcctgccagttttcttctgtgtatagcctgttacctttgcattcccatgtgtagaaacttaagaggaggctgtcaggccatgtagctgttctgtgcttcatgagacttttcaaccagcagttttaacattcattcttgttttcctgaaatagttgtggctgaggtagttgccaaaagtacagttaacttgttcctgtttgtggctgaagtagttgccaaaaatagagttagtttctgtctgccctggttttgccccatgcatgtctccttatatgtatttgatttatatgtttagtatttaattatacatgatttatggagtacagtgtgataatttgatacatgtatgcaagttgtaagatcaaagcaaggtaatagcatttcagtttctttaaacatgcatcattgtgtttggagcctctcaactccggtgtggtagggcaaatactggtgctatgctgtgtgtactgacaagtgtggtcatcttcatctgctgttccatcacaccctctctagataatctcaggtcctgagttctgtcccttggactttatcattattatttttgtgtatgcgcatttaaacttaattgattgagaaattggtatttgaatttactgttactttgttactttttagcccaagcctattgatgtacaagttattacacaccatatgcagcggtatgcagtctggtttggagggtcaatgctggcttccacggttcgtaaatttatctgtaaacttttatattttataaaaataagaaagtcaaaattgtgtgtgtcagttgtgtgtgtgtgtgtgtgtgtgtgtgtataacacacatagtatttatatttggaagtcatttcactttattgttgttctttttaccttgtccttactagatattatatacttcagagtgagcttattatactttattttaacatttattatagggaaaattcttttaaatgtgtagaaacagtattcaccagaaggttattggtatttctgtttaaatatctaaaaatattaaaacgttaggtttcattgcaatgtttgaaacagaataaagagaattattccagaatcctctttccagaacaaaacatgctcccttagaacatgttctaatataattagtatagtaaatatttctgcagttgtattagggcatgggctattaagatacagaatcttttatgtaagttactagatttgcagcgttggatataaaccatttaaaacaagcaaagattggtttctctcttaatttagtcctctgcagttgggctgcattgttgggtgcgtgtgtgatttgccctttagaatgcagtcatgcaccaggtgaaaagggagggcacaggcatgctgatagtgtaggctcttgtccttcagattcctgtcccaatttaaatctagatttcccaagtggaaaagcccagcagaacagactacatgtcagaaccccgcagagacaggtgttgagtgaacggtgggttgtgaattaatggccctggagttccggcagatttgtctatcctagattttaatcttggtttttagagttctgagctttgtccaaaagccatgaatcgactgataaatattgtttatttaacacgagtttaaaagtatttcttttatagactgttggaaaataggagaatttgacctctcaaatgcattgttctgttttttttttttcttccagcctgagttctaccaagtatgccacaccaaaaaggattatgaagaaattggacctagcatttgtcgtcacaatccagtgtttggagtcatgtcctaaagttgacttcttgttgattgggttagggagatggaaatgagataatctttctgatgacctgtttttgtctgaatggatggttctgaggtttttaaccaaacatgatcatacaggaatatttaatgagtgtgtcaacatgcagatgtagaagagagctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgttggaccagtattgcaattctgtagagtcgtttcttattaaaacaataatgtgattaccaaaattggcatatttaaggcctaatgccattctaataaaggcaaaaaatttctttttactacttgtttcaggctctttgatctctttataagttaactaatacgtctattttcttcagattctgcagtagctctttaaaagcacagcggttggatagcaagctgacttttttatgtgctctgtacaaataattgtgaacttttaatatgttgagtgctttcattttgataactggatctccatttgatatttcatttgcagtctgaattttttttagtgccagtccctgacatatcatgaaaagttggttttctttgcattttcaaatatctggatcatgaagaaaaagtgatgacaataaattaaaattgaattacccttcctgatggtttttcttcgtgcagtggagttcaactggctgtctacatgcttgataggatttttgtttctggagaaatgatggcatgtgtttaagtctctggcatgtgtgtggtagagaatttcttgtgaacataagattttccagtttgtagaacagcaaatgggatatgttttataataacacttaaatcagcactgtcagtaataacaatgtaatgtacaaaacacagtagaattaggaatgcctccattacatgtccttaaagagcttttttgctctgttgcagtaaatctacacagacaaacttgggaactgaaccttagttcttatgtaaagtctatcaggatatttgtaattttattattttacctgagaatgacagggtgtaagaagttgaatcatatgtttcatgagcatgttccataagtcagagtgggtttcttcctcgcccttgctctctggtggaaacatctctggcccaattatatgtagtcaaggacatttgtcttcttgcagaagccactccttcagttcccagcacccacgctgggtggccaacagccagttctagggaacgtggcaccctcttttgacctttgcggggaatgggcagaacacatgcaggagtatgcttacatacttccaggcaaactagtcacatatataaaaagattaaaaaaaaactttacaattacatatactctttttggtggtggtggtagtggtggtggttgtagggtaatctagaatgacaagtttaaaaaatcatgtcctctgactctatgaggaaactggtcagaaactttacgcctaggcttgttggagggcacaggaagaagacctgggctctgtttcccagtatgcattttggtctgtgtctggaggagtaagctataccttgcctgatnnnnnnnnnnnnnnnnnnnncctgtgcaatggtctgtgtgtgtcatcatggtaggtcagaggacaactacaaatgttagtcctcattcttcaccttgtttgagacttctatgctttgccactctgggctagtttaagagctttttccaggggctcttctgtttctgtttcccacctctcccaagtgagtgttaatagtactgatattactgcatctggcgggctctagggattcaaacttgtcctcacgtttgatggcaagcacccttacccactgcattgtctccatggcttggattctgttatacaatggggtagctacttgtcttcaacccatttcataagaaattactttttacacagtgtatgccaggaggtaggagtggcagctatagctgctgagcttagtcaccccgttctgccagctactgaggttagtctctcctgccagctgctgagcttagtcccctcccctgcctttgccagctgctgggcttagtccctcctgccagctgctgagggtagtctctcctgccagctgctgaacttagtcaccccgttctgccagctgctgaggttagtcatccccttctgccagctgctgaggttagtcatccccttctgccagctgctgagcttagtcattcccttctgccagctgctgagcttagtcattcccttctgccagctgctgagcttagtcaccccgttctgccagatgctgaggttagtctctcctgccagatgctgagcttagtcccctcccctgcctttgccagctgctgggcttagtccctcctgccagctgctgagggtagtctctcctgccagctgctgaacttagtcaccccgttctgccagctgctgaggttagtcatccccttctgccagctgctgagggtagtcatccccttctgccagctgctgaggttagtcatccccttctgccagctgctgagcttagtcattcccttctgccagctgctgaggttagtcatccccttctaccagctactgagcttagtcacccccttctgccagctgctgaacttagtcacccccttctgccagctgctgaggttagtcatccccttctaccagctactgagcttagtcacccccttctgccagctgctgagcttagtcacccccttctgccagctgctgagcttagtcaccccctcctgccagctgctgagcttagtcacccccttctgccagctgctgaacttagtcacccccttctgccagctgctgagcttagtcatccccttctgccagctactgagcttagtcctctcatctgcctgccactgctgttctctgtgctgcaaaccaaaagtaagtaaacttagttacccgaatattgtctcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaattcacctttgtataaggaatgactctgctgcgtgaattcctagtgtaagcctggtaaaatgttaattccacttggggaagcacccggccttcatctagcatagggagtggcagctctctaaccttgagtttcctgggtgtcatgtactggctttgatgccattgaaacattgttacttgtaattaggttcagcctctcaccccactgaaagagctggaggaactcgtcattgctgagttatctctccagtcccttaactaaacctgcagaaacacttgaagtcattcgagttactagccactattttttaaaagtatttgataattgcacatgtaagatcaatgaacaagtgtttcgtttttttttttttttcctattttggcaattctgaatttagcattaaatacactggttcttacccgcgttctcgcgaccggccaggaagaacgcaacaaaccggaatcttctgcggcaaaactttattgcttacatcttcaggagccagagagcaagaaagcaagaaaaagaacaagaaagcaagagaaagaaaaagaacaagaacaagaaagcaagagaaagaacaagaaagcaagagagagaaaaagaacaagaacaagaaagcaagagagagaaaaaacaagaacaagagagagaaaaagcaagaacaagaaagcaagagagagaaaaagcaagaacaagaaaaagaaaaagaatggcaaaaccccgtcccttttaaggagaattatcctccgcctaggacgtattactccctgattggctgcagcccatcggctcagttgtcatcatgagaaaggcagaacacatggcgggaaaactgcccctgcacgtgtgcagattatgtttaccacttagaacacagctgtcagcgccatcttataatggcaaatgtgagggcggctcccaacaactggtgtgtatatttgtagcataacacacatgcacacacccatttgctttccctatcctattttccactttgacaggttttgtgtgtagacacttttctcctgcaaaagactacctgccacttaatttttatctaggtcttggccagcgttgggcatagggcagacaggggttgaatcaatacttcctacattggccccaagaagcatttgtttcagttatgtccctggaactgtctccaagcttggatggtaacagatggtgtgtggtacccttttcatcgaaatcccacctctggtaaaacacacattacccttaggcaatgaggccctgtacaatccaagctcgctatagctccgccatctgcagtcacctgaatgtcgtcaatggatagatgtgttcattctgatatgtgctaagtgcttatgagtctccatgggtagcatcctcatagatgaactacagggggttgtaagccatcagattacaccccaaggagacacagcggggcatctgcagttgaaaatgttcagaagtgaatgtgccatcattcaccctgacttaatttgtctttcagacttccacatgtttacatttggttttcagtgcgaaggaaaccatcagttaccaattagcaatgtttccgatgctggctcagtagggaaagtgtattctgagtatgaaggccccactttgctcttcagcacagccgttaaagctgggcactgcaatgcatgcttgtaaccccagtttgggggagacatagacaggatgaccccaaaggtctgctggtcagccagtgcagccagggaacttcagattcaacgagagatcttgtttaacaaacaaagaaacaaacaaacaagatgttttaccactttagtgatgtctcagcaggtaaagtcccatgctgagcaaacttgaggacttagggtcagtctttaaacccacaaaaagttgggggaagctaactgtcttgcaggctgccctctgacctccacatgtgcactgtggcgcacatgccccgaccctagcaggttaccaggctttggggcaaatgccgttacccactgagggaaacctttaagatgttctgttgcaccacagttggagagacaggtggatcagggcaggctctgcagatgaatcagaaataaggcttgacttagtcaccagcatcctgcagagaactgtgagagaaacagccacccactgctgcctgggtgagggactgtgcagagttgtacacaaaattagtggtgaaaaaaaccaaaccaaatcaaaacagaaacatcacacaaatccagcagcagcagagaggctgcctggggcaaaggtgagcacaagcaggcaggccttccgtacctcatcactagagcctggggcagagagagatcaacatacaaaaagcccaatatacaaacacaagagacaagtgttaactggttggcagtcagtgtctgactgggggattccattagaaagtagattccagggccagtgagatggctcagcctgtaaaggtacttaccactaaacctgatgaccaaggctggcacccagaattcagtccctgggatccacagggtagaaggcaaatactgctgcaagctgtcctctgatctccacaaatgcacccctccccaagttagcaaagtaaatgtaataataatgacaatagtagctattgatacttataattggttatgtagatatacataaatgataatattattataaagtagagccccatgctgaaacccccttcagcaggaaggacatacatactttgtacttgtttgaatgacctaagactggctactaagtccatccccaacttgcagagatggctaaaaaagacacccaagggagaaatactgcagcctaacttggaagaaatactgctgaggttgtaccttttaaaagttttgtgcatggtgttgtatgtgtgtgtgtgtgtgtgtgtgtgtgtgtgtgtgtgtgtgtgtgtgtgtatttacctgtgcttgaatgtggaggtcaagagccaatttcaagtgactctgctctccaccgtaaatcatttttaaagccagggtctccctttgaaacctatgtagctggctggaaacttgttatgttgaccaggctggcctcctacttctgcctcttgagtgctgtgattaaagacttgcatcccagtgcttagcaaaaatgtaccccaggctggcctcaaacttgtgatctccctgtctccacctcttcagcgaaccctaccaacaccaccacaagtgagtccaccacaatttttgaggcagaggctctcgttgaaccagggctcaccattttggctagagtacttggcaggccccgtccccagcctccttctcagtcctcaggccaatgctggtattaacaggcacatgaatttttatgtgttcatctgtgcatgagcttgccttgtgagtacctgtgcccgtggaagccagaagaaatcatcagatccctcttgatcatgggctttcaaccttcctgatactgtaaccctttaaggcagttcctcatattatggtgacctacaaaccataaaattatttttattgctgcttcaaaactgtaattttgctacttgtatggattgtgatataagtattttttagaaatagtgggttgtcataggggttgtgacccacaggttgagaaccacagctctagagctagtgtcatatgtagttttatggggctattattatatgtatatattattatcattcataatacaatacaaatatattatattatattgtatttattatatatggttctatgtgatatgtagttgtgagctgcctaacatgggtggttgctgggaaccaaacttaggtcctctgaagcagcaagtgcttttaagacctgagccatctccttagccccaaacttcactttttacaagcagcctttgagccttcctgaggacacaggttaagcacccgggtgtcctctactgtgagataatgccagcactgccaccacgtcatcaagtctgtttctgtagtcagcttcccttcccaagtgatagttggaacatgatctcacatgaagatgcctcaccaagaggactgatgcaaaataagaactaagctggaggaagcatccactccagacccaagaggcattaagagcctcaagtagacaccaccggagaagagctacgtgtcttcaggacacatcatggttgagatcgctaaaatagaaagcaaagattttagtaagggggtatgccaactcacctgtcaagataaactcattatgggctggtggcattgctcagcaagtaaaggcactgactgaccatgcaaacctaaggggagaaccaactcttgaaagttgtcctctgatctccacatgcatggcattgggcatgcacatatactacatcacatacatgcatacacacaccatgaaagtttccatgcacaagtaaaaaaaaataattaaagcacatcagaatagcattggattccttattagaaccctgaaggacaagaaagcacggagagatacactacaaataaaaaggtaaataatcccactggagatgaaactgctacatgatccagctatgtgacctgatgatacagccaaagaaatctaagcttctacccagatgcctacaagtccaagtttaattcagcaccagtcacaatagtgagatcatagaaccagcttaaatgcacacgaacagatgagtggataaagatgtggttatatgcactcacaaagaagagcagggtgacttcattgtaggagaattaatgacactggaggtgatcacgttaagcaataaaagccaggctcagaacgaccaatgtatgcccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 182 - DNA, 1321 bp, Mus musculus
tcaaaggtattgccattaaagagtctgcaaaagtgggtgaccaagcccagaggagggtgatgaaaggcgtggatgacctagacttcttcattggtgatgaagcaatagaaaagcccacatatgcaacaaagtggccaattcgccatggtatagttgaagactgggacttaatggaaaggtttatggagcaagtgatttttaaatatttaagggcagaacctgaagatcattactttcttttgactgaacctccactgaatactccagaaaacagggaatatactgctgaaataatgtttgaatccttcaatgttccaggcttgtacattgctgtgcaggctgttcttgccttagctgcatcctggacctcaagacaagtaggagagcggacgctgacgggtacagtaatagacagtggagacggagtcactcatgtcattcctgtggctgaaggatatgttatcggcagctgtattaaacacattccaatcgcaggaagagatataacatattttattcagcaactgctgcgagaccgagaagtaggaatccctcctgagcagtccttggaaactgcgaaagcagtgaaggaacgctacagttatgtctgcccagatttagtaaaagagtttaacaagtatgacaccgatgggtcaaagtggatcaaacagtacaccggagtcaacgccatctcaaagaaagagttttctattgatgttggctatgagcgattcctgggacccgagatctttttccatccagagtttgctaatccagattttacacaacctatctcagaagttgtagatgaagtcattcagaattgccccattgatgtccggcgtcctctctacaagaacattgtcctctctggtggttcaaccatgttcagggactttggacgtcgtttgcaaagagatttgaagagaactgtagatgccaggctgaagttaagcgaggagctgagtggtggtagattgaagcccaagcctattgatgtacaagttattacacaccatatgcagcggtatgcagtctggtttggagggtcaatgctggcttccacgcctgagttctaccaagtatgccacaccaaaaaggattatgaagaaattggacctagcatttgtcgtcacaatccagtgtttggagtcatgtcctaaagttgacttcttgttgattgggttagggagatggaaatgagataatctttctgatgacctgtttttgtctgaatggatggttctgaggtttttaaccaaacatgatcatacaggaatatttaatgagtgtgtcaacatgcagatgtagaagagagcta

SEQ ID NO: 183 - protein, 386 aa, Mus musculus
KGIAIKESAKVGDQAQRRVMKGVDDLDFFIGDEAIEKPTYATKWPIRHGIVEDWDLMERFMEQVIFKYLRAEPEDHYFLLTEPPLNTPENREYTAEIMFESFNVPGLYIAVQAVLALAASWTSRQVGERTLTGTVIDSGDGVTHVIPVAEGYVIGSCIKHIPIAGRDITYFIQQLLRDREVGIPPEQSLETAKAVKERYSYVCPDLVKEFNKYDTDGSKWIKQYTGVNAISKKEFSIDVGYERFLGPEIFFHPEFANPDFTQPISEVVDEVIQNCPIDVRRPLYKNIVLSGGSTMFRDFGRRLQRDLKRTVDARLKLSEELSGGRLKPKPIDVQVITHHMQRYAVWFGGSMLASTPEFYQVCHTKKDYEEIGPSICRHNPVFGVMS

SEQ ID NO: 184 - DNA, 94917 bp, Mus musculus
  misc_feature (1)...(94917): n = A,T,C or G
acacacagtggttctcaaacttggatgtactccagaattacataggaaattcttcatttttttagacgaggtcttgctatgtttctcaggttggtctcaaactcttgacctcgtgtgatcctccggccgcagtctcccaagtagctgagattataggcgtgccactgagcccagctggaaatttttttaaaacacagattcctctgaatcaaaatttctagaagtgaggtctgagcaatctgtatttttaacaagttatccagatggctctttactgtcagtctggttccagctgagggagttttagaattacaaggcaaagtccaaacttagcacacaaagtcattcacatcaactcttcccctgtacacaccctatgtcatagccagagttgtaacccatttcttaaacacccagggttcttttaagtctctgtgtcattgtatgttattttctctagaattgcctttaacctcctttccaccctggaaagcattccctaagccatctttgaagctttctttgatctctaacttagagtcctcctctccttctaaagccctgtgttaatcacttgtcatggtgtactttaatttttacttgcctgtttctctttacggtactttgacttcaaagggtggggctgcaaattagtcatctccttagagtccagccttgttcctagttcctaactggcacttaatataaacgaatgaatgaatggacaaatgaagagaatgctagttatgataaagaattggccgtgtatgagactacttctctttatgaactaaataattatatgcctttcaataaaatactagtacacgtagctagcacaagctcatcagcatttgagatgatatggaaaccaaaataaacaaatgctaccacaaaaacataatgactgctttccccagtgcaggactgatggaatcatcaaacattgagattaatgtaatgtttggcagatgtccagtgtttttatttttcatttgcctttgtgttcatttatggactaacaatataataaacacacacatactcacagtacatcttttttttttttttttttgcaaagcccagttttcttcatcgcatatctttgttttcttcaagtatccccttacttaatgttggtagtattttttttaatgaaatataaatccctaaccaccaagcaagaaatgagactcttaattgcatcagtttacagtgcaatgtgagtgtaaatagtgtaaattgaatttttaatggacttttttttttcccgtttttgcttgccttacattcattatccctccctgggtaataaacatttatttttccctttgtaaccactcctccccttctgtccatgtggttctttttagtggagctggtggtagggatgtggcatgagattcaagcttggccacctggagtcactgtgttgtgctccagaaggacacctgatccaagtcagccagtaagagtgagccccaggatttttgcttggaccactgaggaaaagtgtactctgccctgtggctgatcaaccattaggatataagccattgttgtagctgtgtgagtcaagctacctgagaatgaggacaacacagtggcaagcaacaccaagagagaaaaagaggcagattctgatgacatttttgagcctttgcatccagctatgcctgaatccaatttatcccctggaatttacacttacttgagctccacccacttgaaagaaaacatttctttttattcttagcctgatttgaatttggcctctctcatttactacccaaagtgtcttgaccactagaatattatgccagactttacagcatcattgaatttgccactttccagaagagttgtgtgaattttcaatgtagcttttaccttctatgagtatctagagatatatttaagtagaagtactccactagtttgttgtgagatcttaagtcacttaatttctctgtaccctagttccctcatttgctagacctagggagctataatgttccttctgcaaaattcttattttgtgaaatattctagaatgtctaactgatacactgctagaacaactgactgctatttaagaagagttgactgctatttaaggatcataattctctaggcataagtgctgtgacggcacagcgtgtgcatcggggctgaggggtggggtggagcagaaagtaggaggagaaagtttgataaacttccttttggataaattgaaaacagtcaaataatttataatttcttatattatcattattagcttcttctataattaggagacttgttccaaaatgtgagaattgtcacaagttgtcaaattcatcaaaggaagaaaatggatgtctcacaaaaaagtatgctcagtccaatttcttctcgtcacactggaacaaactgaacagttttacacagagatgagaagcctggacatttttcaaatatgttttgaagagaatggcaatgcctgagacagaagtaggaaaaagcaatgaatatttaaaaatctgagctggtgtaaaactagaaatagttttagtaagaacaatgtgatgtgctacactaagtgaaatgtatacattgggccacattataatcaaaaataagaatgtacttttattcatcttttatttaaacaataatcaaggtggcgggcgcggtggctcatgcctgtaatcccagcactttgggaggccaaggtgggtggatcatgaggtcaggagttcaagaccagcctggacaacgtggtgaaaccccgtctctactaaaaatacaaaaattagctgggtggggtggcatatgcctgtaataccagctgctcggggggctgaggcaggagaatcgcttgaacttgggaagtggaggttgcagtcagccaagattgtgccattgcgctccagcttgggtgacagagcaagagactctgtctcaaaaggaaaaaagaaaaaaaaaaaatcaaggtaccatttgtaccatttcctggaatttctccaaagtggcaaggtcacatgtttatacattagactcccagtttaacacacagcagacaataactttttttttttttttttgagatggagtctcgctctgtcacccaggctggagtgcagtggcacaatcttggctgactgcaacctccgcttcccgagttcaagcgattctcctgcctcagcctcccgagtagctgggattacaggcatatgccaccatgcccagctaatttttgtatttttagtggagatggggtttcaccacattgtccaggctggtctcaaactcctgacctcataatccagccacctcagcctcccgaagtgctggtccacccttccttcttttctcccttccatccttctcccttttattccatttttctaaatattagaccatagtacaaatcaaaagtcacaaactgataggctgcaatgtagatacagctgggaaaatgttttgtttgcagaacactggggaaatttaacatgaaaaactggaagatctcaatccacatggccacatggtaatattattaatgttgcaggggctttccaattcaacatgtcctctgcatccctactatttatactgccactcatccacctttctgtattactggcctatcacctatacacgtttgagtttatattcttctggctttacttagcaacttaccttttatatttaacattacaacatggtattatcaattagtattcgattcagttgcatataaccaaaaatgccaaattatactggcttaaacactaaggatttatttttctgtcatataaaacaagtctggaggtgggtagtccagggctaatatgacactccagtgtcacaaggtacctgggctccttctatttatcttttttttttttttttttgagacggagtcttgctctgtagcccaggctggagtgcagtggtgcgatctgggctcactgcaagcttcgcctcccgggttcacaccattctcctgcctcagcctccggagtagctgggactacaggcgcccgccaccacgcccggctaatttttttgttatttttaatagagacgaggtttacaccgtgttagccaggatggtctcgatctcctgacctcgtgatccactcatctcggcctcccaaagtgctgggattagaggcgtgagccaccgcgcctggccctatttatcttttataggacatggcttccagtctcaagttcagtttgtcacccataatggccaaagagcagtagtcaccttacctgtttcaggcaggaagggcagagggcaagaaacaaaatggtgctcctcctgattgagtcagcgttctttaaagatgttttccagatgttccacccagccgcgtttttttttttttgagagacagggtcttgctcttgtcacccaggctggagtacagtggcatgatcatggctcactgaggcctcaatctcccaggctcaagcgatccttccattttagcctcccaagtagctggaagtagctgggaccacaggcacatgccaccataccctgctaactttttcattttgtgtagagacaaggtgtcactgtgttctccaggctggtctgcagtttccaactcctgagtgcaagtgatcctcctgctttggcctcccaaagggctgggattacaggtgtgagccactgtgtctggccaagctacttctacttatatctcattggtcataacttgatcacacagccacatccagctacaatggagattgagaaatgtagtcttttggctgggtacacagcatctgaataaaatccaggcattgttactaaggaagaaggagtaagtgtcaatctctgctccataactctctaggttaatacacacagatggaggagattgctagttgcccctcaagatccagccttgccttctgggctaagaaagcccctgagatttacctggccatagtggcactgggaacaaacaatgtatttctaaatcttctgattttaaaatctttcagaatcacgatttctccgacatcagtatttttatgtctttagaattcaacaaaatgaaattcctaagtctaatatatgtgaatattaagttttagcagatactgctacataactttccagaagggtgtggcaattcacatctccaccagtgatcagcatgttcattttccatacagctctggatattttgtctattttaaaatatcttcttctaatctataatttaaaaatgtaacttagtaggaatttaattgttcatgtaaccaaatcttcccattaatggctatgggtttcttcttttacttcagaaagtcctccccaccttcagagtatataaacatttttttctaaattcccttctaatttcttataatttatagttttatttttgttatttgattcatttattctctcaacagatatttattgagcacttattatacgtcaggctctcttcaaactctggtgagagtattttctaactgggagagacaaccctagttgataagaaacaaacaaaccaataagtaaataagacatttcccccagataattaatacttggtgacgggggaagacagtgagacaggctactttacactggcaggtcaggaaaggcttctctgaggaggcaagtgattcaggattaattgatgactggtggagaagtccggggagtggacacaggtgggaacagcctggtgggtgtgaacagcaacaagaaggttaatgtggcttcatggaacagggtgaaaatgagacaagctgaacactgaggtgggcaccagaacatggagggctttgtaggtcccaataaggagtatggattttattgtatactggagatttgtcatccatctagaatctgtttttatatataagaaaaggtgtatatgtttgcgcaagtgtgtgtgtgtgtgtttgggggggcggggtgggggcagacagggcgtaacttttctttaaattagagtcaaaatttaattaaactattcattctttacaggcagtgaggggattaggatcttatcccacagaatctcacctcatttcaaatgttgtacagatattatctgagatatattttcaggccgggtgcggtggctcacgcctgtaatctcagcactttgggaagccgaggcgggtggatcatttgaggtcaggagttcaagaccatcctggccaacatggtgaaaccccatctctactaaaaatacaaaaattagccgggtgtggtggtacacgtctataatcccagctacttgagaggctgaggcaggagaatcgcttgaatccaggaggtggagcttgcagtgagccgagaaaacgccactgcactccagcctgggcgacagggcaagactctgtctcaaaaaaaaaaaagaaaaaagaaatatattttcaatgaaatcaagcatataatgactatttttatcccagcatcttggcttcttcaggctgctataacaaagcatccctagtggagcatccctaatctgaaaatccaaaatccaaaacgttccaaaatctgaaaccttctgaacactgacatgacaccacaaatggaaaattctacatgtaaatacacgtaaatacaaactttgtttcatgcacaaattaaaaatattgtataaaattaccttcaggctatgcatataaggcatatatgaaatataaatgaattttgtgtttacccatgggtctcatccccaagatgtttcattttgtatatgtgcatactcccaaatctgaaaaaatccaaaatcttaaatatctgtagtcctaagcattttagataagggatattcaatcccttatccataaacaatttatttataaacaacacaaatttaggctttgtaaaaaatagaaatttggccgggtgtggtggctcacgcttgtaatcccagcactttgggaggccgaggcaggcacatcacttgagctcaggagtttgagaccagcctggtcaacatggtgaaaccttgtctctaccaaaaatacaaaaattagcagggcttcgtggcatgcgcctgttgtcccagctactcgggaggctgaggcaggagaattgcttgaacccggaaggcagaggttgcagtgagccaagattgagccactgcactccagcctgggggacaagtgagactccacctcaaaaaacaaacaatcaaacacaatataaatttatttctcatagttctgcaagctgagaagtccaagatcaagatgtgagcagatccacctttggtgaagggctgctttccatttgatagatggctgtcttcttgtgtcctcacatggtggaaagggtgaggcagttttttgaggtctcttttaaaagagaactaatcccattcatgtgggggtctgccctcatgacctaatcactttccaaaggccccacttcctaataccatcaccctgggggttaaattttcaacacacaaattggttggagagtgagcgaacatagacattcagtctatagcccccagggatgtagccactgaataaaataatctagaacttcatctagaggcagtttataagtcacataagaaaaccagttttacttatagtcacataaaacttttgataaaaaacaaccctagttgataagccatttgtttactggacttggctctgaagaaatgacttttggctaatcctcaaaatgaaatctactcacagagggcaagatctgccaccagtgaagatgtttaaaacaatgtgctgtaggctttgaaggcaagtctaaagaagagcttctaaaaatattttgcacaatggtagcattaaaagagtaggcacatgggccccaagataacatctgtgaagaggaggaccagtgtgtgtttccttttgtatgtttaagtactaagtcagtgattactttataattaaaccatattcctcttgatctgtccataataaggtcactctgtaatttataataggcttcttaccaaattcaagctttacaacaaccctataggttaaatattcctgtgaattttatagatgaagaaacagagtaagtgaaagagttcatactcaattcaagtctcttgagtctaaaatcagtgctctctctacataagaagttagttgctaagatcacacaacttgagaagagagaagacagttttcacagtccctcccctctgaccactaggctgcttggggtacttttacaacttacctgctctgaattaaggctctctgtgaatctgattcatctgccaatttgcaaacagtcagccctgtagtacgtacctaagttgatttttaaaatactatttctcatcttaaaataatggaaattgagtgacataaatttcctggacactttttaagatccaaagacaatttgctaatttgtcgttacaattaaagagccccccaaaaggcgtaagaactggattttgacttggacttctgttccttagtttctttaacatattgggggccgggagtggtggctcacacctgtaatcccagcactttgggaggccgaggcgggcagatcacgaggtcaggagattgagaccatcctggctaacacagtgaaaccccgtctctacaaaaaatacaaaaaaaaaaaaaaaaaattagccgggtatggtggcgggcgcctgtagtcccagctactcaggaggctgaggtaggagaatggcatgaacccaggaggcagagcttgcagtgagccgagatcgcactacactgcactccagcctgggcgacagagcaagattccatctcaaaaaaaaaaagaaaaagatattgggaaaactcacttaaactctatgggcttctgtaccactaaggcttctcaaatttgatgcaagtaatgggaacttgctgtggctaacttgagccacaggagaaggatactgcaagactcacaaatgcttgaaagtttcggaacaggtttggaaatgggtaagaaccaaggaccgggttgacctgaactgaaaggaaattgaggtgctattagggacaaatatgaaatgaaggatgaactgtctctgacatcctttgcttctgtgtttggagatgagtaagcagggagtgggtgcatatgcaaacagggtggtcagaaatgctttggccggatgtgtgactgaaggctatgtgcagctgaggaaggctgggccaccacagtagcagagaggctgaccaatttggcatgcagcaagcaggaagtagaagggatcttaagcaagcaaagtgtttgggtagacaagattatgaggaatgagcaccaatgacatttccaacaagcactgaaagcttccaaatgcttctaacagttactgcctgtacaaacacaggacagtcttgactatgtgagactgtgacagtttcctcatgcctatgaaatgagagacagtacttagcactgacatgagcttcatatttgaaggcagcaaactactgaaccacatgtagcttccgaaatcaaaagatgcaaactggcagaccacaggtcagatatgacatgcagaaaaaaattagttactatcttagcctagtttgtgctgcttacagaatatcagagactgggtactttatagagaacacaaattatttttcatagttttagaggctgggaagtccaagatcaaagggccatcatctcgtgaaggcgtccctgctgtgtcaaaacatggtggaaggcatcacatgggcaaaagagagagagggaagcgggggcaaactcctttttatcaggcacccagtcctgtgattcattcatgaagacagtgtcctcctggcctaatcacctcttaaagctcccacctctcagcactgttgcactggaaattatatttctcacacatgaactttggggaacacattcaaaccattacagttaccaaagataaaaatgcagatttcagatttctcttggggaagaaaaaaggctctggcaataccagggctgtatttccacatggcaacagttgtctgttgccttctgttgggttgtgggctctcacattgccataccctcctcatggcccccttcactcataacagtacctgcctagacctcgaagcactagtttccaaccctgcttgagttaactacttccatgacaactgtgcaaggccagagtgtgggcagctaccttgagggccaccggcatgggctgcccaagtgaccgagggcactaacctctgctctcgaaacttctttggtaggatctcttcactcctgacttactacttgtaactgctggaaacaaccatttattctacccctactaaaccacatctgtcttttctgtcagagccaatcttcaagcatatgcttcctcaaaagactttaattaccaggtagtagaagcggcagcaaagagtccccatctagcatcttctaaaatgtagtggagaaaccaacgacaacgaatctgagacaaccagttgtttgacttctctgaaaacaacctctaaaaaaagccttctctcgtgaatagctgcagacatgctgggcactaattgatgatgatgccctttagtgagtctcctctgcacatacctgattccatttggatgctggccctcacatacttctatctgcgaactccggaacacagaatatcatacaatgtatgattcaatctggactctgctggagccattctctacaaagcagacacaactttttcttgcctaaatcctttcaagttgctttatttttatttttaaactaattaccataaatctaatttatcaagctgcttttaagataaactttaaaatgcttagagcagtctacaaattcttgcactgtttcactcttccttatctctcagtcttcatctcccattgcatcttctctgactctttcatatggatcttctttcaatttgtggaagaagccaagcttgttcctgcctcaggtccttgacacttgctgttcactctcctgggagactcttccccccatcttagcttttaaataccagctggtcagactccttacctgccttccaccttcctctcattctcccactcctcgccttcatttctcagagtcctccgctctcttctttctattgctcttaacacaatttgtctgttttccgctaatctgtaaactctacaagagcacttaactattttgcatcccaccgaatattcggagtcagcacagaccccgtcataatagagtaggtaagcaatgcttacctgtcaaatgaatgaatgaaacacccgattcatcccccaagccagcttaatacattagatgatcttatggactgaataagacatccctccttttaaagaatatttttgttttagcttcacatcagcaaaccccgaacggttcatcctaagataagcctggtagagaggaaagatactaaccttctagggtcctaaagtggaactaggaacttattagatatgcacattctcaggcattatttccgatagcccagtcagagaattctgggggtatggcccagcaatctgttttaacaaacctttcaggtaattctgatacacactaaagtttgaaaggtttctttaaggctttccagttttcttttcttttttggagggatgggggggggtctccccatgttgcccaggctggtctcgaactcctagcctcaagctatcctatcctcccacctcggccttccaaagcattgaaattacaggcatgacccactgcggctcgcctccgtttctaacttaaaaaaattttctttggaggggagccttaatcctttctattatcctgctagtagaatcttactactcctgagggtaatctttgtcataatccaaaagccttgaataaaggcctatttgtatagttatgcagaatatattcctgggaggtttgccttcctaggagcacaggtcggccctgggaggtgggggttggggggcagggctgcattctaaagtcctgtaacaacgcacaagtacaactgaatagaactcggaacaaaggcatcagggccacggtgcaagtctttgttcatccgttccccgactgctcaccctgtctgataccgctcttttccacccagaaaagcagccactcaagttttaagaatggatgtatgccgcggacgttttcgattaggccgttttctctcaggcactggaggatattcgtggctgcaggaggcgcttccaccctttcctcaacctagcaaagaagtaactgaaactaacccaagggttacaaccgaaaagccccttccagcttcagaagcagaactggaagctcggatagacttctccgcctctacactcctggaaaacccgcagtggatttcaccaacttcaggatcggagcccaggcaggcgaacgtaccttattgcgcatgctcgctagcccctcccgctcggagcggaagggggagcgctgggggcctgggcctggcctggccggggcgtcggcaccggcggccatcttggcttcccggggaaaggcggcgtgaggggaagaagttgtagggtgggggcaggagtgaggaggagggaagagagagggggaggaggccgcggcggggcagggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtaagggggcttacgggcgggggtggggaaactgaggcggaggaaggaagatggcgggggagggaggaggccgggaaatgaatggtgcggcgaggtgccgccgccggctgtcagtcctagacccgccggccagcgaggggtggggcccgcagccagggcctcgcgggtcccctcgtttctccctcctgggactggggcgggggcgcgggccccgagattcaacccccaaccctcccagcggctttctccgcgcgacccctcccggcccttcccccactacggtgggcagcgccgcccaaagggcgctggggacggtcgtcttgggggtggtccccgggcccgacccatccggctttcctttccctccgcgcccgtttttgccagtcggtttggggacccaggggccgagctcggggactggcctggcaggggagctagaaaagagaagcgctcctggtaggtttgacaagatcgctgtgacaacattctgcccagggtgtgggtggggaaagggaagaatcggactctgaaaatgggaacctacagtggggctttcatttgaccacccaccttctcctttcgactcctggtcatttccatctccctctgcgttttaaccggtgaaccaagtcacattttaattcgagggagaaagatgtcatgtgttacttctgtagcctcaaaaaagtcccccagtgagcaagcgcgctgcaacttccttagttttgtcaaagccgcttcctgctttcagtcttttatacccttataaggtagtttttagtttccaacctgagcacatcttactagaacttttaagcaggttttaaagagactgaattaccggtgcttggtgtccatttatatgacttaaaaaaatgtacttatgtttcatggagtgggggaaaggaagcaccctggaaaataaactaatttaagttgtattcgttcattctgtgatggtatcttgaaggaagcaggaaggtatagaggtatataggagggtgtttaagttgcaaatagttactcgtagatatgtagggtagtttgcgaaaatgtagagtggctttaaagtgtggtcgttcattttgtattaatagacgttttagagagttgtaccacactcataactgcatagagaatagactacccttatttttatgtagaatcactgcttcaggatgacatataggaaagtggtttttttttctgtgctgatgacatctctccaattcccagaacactcccagttttttttttttgagggggaagtcagtaagaggtggactgtcaggcttttttttttattattaattataattattgatttcattattgttacttaaaagattgtgtgtccttcactctttatgtgaaatttctttaatcttcattctcataactagctagtgtggcagtttctaaaatcccagttaggtagagagaaaccaccaacttcttaatattctcctaggaaaacactagccttggaacttctatgtatttttttgatgaacactttatttaaaagtttttccttaattcagtctcatttctctgaaccaataattttttttatttctcccttcttagtctaattggtgagtatttttatgtctaggttcagttttaaaattagatttggcctgagtcagtaggataggacttttcaaatgtgttttgttaaagtgacgaatattgctacataattaatgctttagaaattactgcgttttcaaaaaaatagtgtaaataattgtggccctgagaaataatatggtaacatctcaagtagtatgttacttttctaatctccattttcccccttttgaaatagtttcgaattagtatacaagatgtttcattgagataaactgtccttaagtgacctcctttcctaaagggcaaccttgaatttaaaacatgctgaatgaccagtaggatcgggaagaggggttcaatttaacctaggctatttctgttttaaaattacgattatcacaatagtgtatttttaagttattacattggtttctccaataaggagaggttattaactgcacattgatgatttgaatggaactgattaggagtccccttgccacctcactctcttttaccatttgtcacaatctgaaattccccctttagagtttcagttattttggttctcaaaagcctttttggtcttacaagtttccagtggtgcctcctgggaagttacaccttcagctttatttgcacatggaggataagtccttgaggttgaggaccctgagataaacatctctaagtatggccttaacagggagcttttacatttcaaaattctgtggtccccgaatgcaaattgtgcacctgtaatttgtctaattttttttatgctttagagaatgcattcagctctgaggtctctaaattacaattactcacttagtttaagtaaaaagttataacctgaatcaggttgctcatttcattcattatataaattaggggaaaggtggctgaaaaaaagtggccatctgtaaaacttgatcgtcttagataggaaagctgttaagagttaggaaacttgaaacttaagcccaaaacttttagggatcgtccagcaaaactcaacatatgaatcacctagattcaggtcataaaagagaatacttattttgaaaagaatttgaaaagaaatgcttcattcacattgatacccttatctacacacttttttggtctgtattggaaagcattgtaaaatacagttggggcacatagattcccattggtggcttgaaaactaaataacagaactcaaacctgctattagtggtgagaaaagcattttctttaaaaggcattcacaaacattttttaaaaaaacattgtaacacttgtatgatcatcctaaggtttttttttttctgggcggtggaagggatcgttttttaaatgtgttttttgctttttgtttttttgtttgtttgtttgtttgttttgagatggagtcttgccctgtcgctgggctggagtgcagtggcacgatctcggctcactgcaacctccacctcccaggttcaagctattctcctgcctcagcctcccgagtagctgggactacaggcacatgccaccacacccagttaatttttctctttttagtagagatggggtttcaccatgttgaccaggatggtctccatctcctgacctcgtgatccacccgcctcaacctcccaaagtgctgggattacaggtgtgagccaccgcgcccagccttaaaggttttttttaaatgcatgtttttactcaagtttctccatcattcaagccaaatgagggcgctccttattaactccttgttatatcgtagcttggttacagagctgcattgtgaatttccttttcccttttatgtctttttttttcccctggtaaataaaatattggtaaattagttccactgattatgatagcagaggttaatatagccctatggtcaaagtcttggatatattcatatctggagcagattaaggaattttgctaactgacttcaacttcttagcaatcttaaaatgtaagcttaaatatcttgtaggtgtcagtgaaagaggagtatgttcatcttgtggccacaattcagcaattagtgcagataagaatgatcttgtttgaagagcagtggggaaaagctgggtaaatgaaggaaggtatatgtgggaagttcatgtttcttccatgaattctgtgcgtattgtttaataataatgctgtttctttttttttttttgagatggagttttgctctcatcgcccaggctggagtgcagtggcatgatcttggctcactgcaacctccttctgcctcctgggttcaggtgattttctgcctcagcctcccaagtagctgggattataggcgcccactaccacgcccagctaaattttgtatttttagtagagacagagtttcaccatgttggccaggctgttgttgaactcctgacctcaggtgatccacccacctcatcctcccagagtgctgggattacagacatgagccactgcaccggcttaataatgctatttctttagccatctccaaaggcagaaatattcacaatagcttcttaaccaaaaagcactcattgaaattcttattccttgatgagtcatgctttgcatgctgtttgaagtaagtacaacagacatgctcctagtgagaagtcagactcttacttagacttagcgaaagactctccctcctttcctgcctgccaattttgtgttgaaatattgactttggattgcaaatactatattgcggtgaacgaactttcaggcttattgtaaaacacagttcagaattttaggcacagaacggaaaggtcctgtggaggacctgctggccatgctttctgtgacagctattttttaacctaattttataagtgaaaaaacagaatgagagaatttaaattacctttttgatgccgtctacctggcaggtggttcgatctgctatttggacctgagttctgtatttaagtcctgtgttctttctgttaacactccggggactcctgactgccttttcagaactttatgtgttgcttcattgttgttagtaaagttaactgtatttctgtttaaagaactcttacaaaaaaaaatctcagccttatgaatttgattcacctaattagagaaaaccctctgtgtaatctttacttggtttaggttccccccccccacccccctgccgatatgtgaatgcctagactatttccttgttactttgcttaaatttaatctctagaaaaaaattactctctaggttgtgtttctcaggaaataataatagctagcatttatcgagaattgtatgtcagcccctgtgctaaatgctttatattatctcattaactttcacaacaacctggaaagtattatctttgttttataggctagaaaatttagtcttaagagaggttaagctacttacccaagatactgtagcaagtaagtatggcagagccactacactagatcttccttccgtagaagatgaacgtttgacatggcttggtgcatagtaggaattcaaatctttgttgtatgaatgaatgaacaagaattaggagtatggtttttaaaaaaactgtgcatcagaaacaccccatacccagtgactcagaatctcaagggttggactatgaatattcatttacataggcttcctagatgattcttcagcagcccattcaagggctaactttgcagaaattctgaaacctggtattggcggtggagttggagcagaagagataagttaggaaaagattggttttttcctttctttttacgtttcttctggcagttatatttcgtgttattttatttacgggtagcaaaggctttgtagttatctgttgttgagttcaagctctatcacttaatagctatatgactttatacacttcaacctctgcaggtcttatttcttcccatctgtaatttggagatgatagtgtataccttataggttttttttgtttgtttttgagactgggtctctgttgcccaaactggagttcaatggcaagatcatggctcactgcatcctcaaactcctatgttcaagctgtcttcctgcctcagtcccccgagtagctgggactacaggcacatgccaccatgtgtggctacttttaaaaattttttgtagagatggggtctcactgtgttgcctcaggctggtctcaaacttctagcacaagtaatcctcttgccctgacctcttaaagtgttgagattacaggagtgagccaccatgcccagttttgttttgttttgttctgttttttgataatgtgtgaaaatggttcagcacagtgcctggcacacagtaagggcacaatatattttaaatataataattggttggctttcttttttttttgagtttcagttcttaaagaaaggaatacagtgtgttatgcttattttcttatctcctgcaggccttggcctgcctaccacacacagttctctgcacagtcaaaatgtttttgctgatttgagagattgaaggaggtatagctaggacttggcagttgattccagtggattgtaaataggcatcaatgaatagttcaagattgtaagcctgagtgattgggacaataagggagttagttttaagaaactgagtaaaattggaatttgttgttgaatttggaatgatgatttataattggaaacattctagaggaaattaaaaatacaggacctttgggaatgaaggtggatatttgggaatcataatttgttaactgaagctaataagatgagagcattcagagagaaaagaacggaaagattgaatatcagtttcccttctttaaaaaaattgtggatatgtgatctagcttcttgagcatcacagtgactgattggctcgtggtaattgatcgctatgctgacaatcttatctccacctatgtcattcaattttctaagaggcaaaatccttaatcaggaggagagtttagctctagctaaatttcccttgtccagcatgctcctgctcccccaacttgtggaaacagctaaaggattggactaggagcagaagtttggaatggttaaaatgtagcaacatgtgtttcctgaaacaaaattccactataataaaaaaagcatttgaatgctcccttgtaattctgttggagcttgttgccttttttatgacacaaccataatcagtgatagacagtagcataaagaagcaagagcaaagcaattaagtaataatagcactacaaaaatgtgtgctgtagcttaccaaacacgacatttatgaattattagataggagataaggtgatgttattggattgttttaaatttagttctttgaaataggatagtgactaatattagtttgtgtgctgattttataactttatatgggcctttatatcaggaaacaacgtaacctacataattgactaataccagagcaaaaaaaagaaaaaaaattctagtttttttaaaggacgattttgcagaattttaataataattttgtttcagaattttcaaaattctttccaaactgtcgatttaaactcaagccattcttacatactccttggaaccaggaaaggaatagcttgaatttgtgtggccagatgttatttttttttttttttttttttttttgaggcagagtgttgctctgtcacccaggctagagtgcagtggcgtgatcttggcttgctgaaacctccgtctccagggttcaagctattcttctgcctcagcctcccgagtagctggaattataggcacccgccacgatgcctggctaatttttgtgtttttagtagagaccgggtttcaccatattggccaggctgatattgaactcctgaactcaagtgatccacccgtctcggccagatgtattctttcagctttccttctgctccccaaccctaatacatacctgagaagaatattcatctgttcggatactcaacatgccatgttttcctcctgccgaaggacattacctaaacgttttatttttaaacattttgtccttgctttaagactttgtgtcatttgtgaaaatgcaatgctcttgggaagggtttctgtgcttttcagtatttagtgtaaaggagaggttacaatgaggaggataaaagtcctagagagagaattagggtgcagaagaccttgtagtttagggttggcttaatctactgtaaacatgtaaaccatgtttttagtattagtgtatgacaggacacaagtgtttgcctagttatagagattattttagttaaatctagtgtgcttctgctataagcatttttaaaattcagttactcaagggtacaaatatagcatttaatgtgtatttgtgaaacttgctttagtaaattaagggaaatgcctaatgactcacacagaattatagagctgaaaagggattttgagagataatttaatccagtcttcatttacaaatgaaacagaggctcagagttgagaaatgtcttttgggagtgttcctaattattaattgatagtattgttgagttctcttaaattttcttgtgagttcacatttatgagttaatagttgaaattaagtaattggaataacataatgtattttatttatagttaaagtagttttagttgaagcctacatcagaattcttcagtgtttcgttgtaatgcagaggcatactgtatggcacacatgagaaactaattttatgtttcccaataataatgttttaaaccaagtttagagatattttaaaagttgtgctctgtaggtgccaggacagatgactttcataaaatgaatgctctctttaaaaaaatttttctttatggtttcagagatttatatctttggattttaattattaaagatgtattaaatgggatgtgtaccaatcagccatttcaaggccctttgcacgttttgttttggatgttattaccttttcagaagccctgtgaggtagttactgttataaataatcccatttcaaagataagtagtagatttagaattttagtcctggggtagtctcattccagagctcactgctctactgttccctaattgagatacatccaaggagagtggtcaaattattagtccagtttttaagagtgtccattttatacatacttaaacccaaagctactaatttttagtacaaatatgaaacatatagggaggtcttagtgaccagttcactgatttgattaacctataacacattaaagtgaaatatggatttgcttactgcttatttgagtattgcaaggactgataattgctgataaattcagggcagctcaaggaaatgatgctaattacatatatcttcaaaaggaaggcatacatatttctgaagctgcaatttgaaaatgaataatctccactgatgcattacttactgtaattattttactcactatgtattatgtgctcattaatgactgcacaaaacacatatgaaagtaaaaaaatagaagaacttaaagtaatcaagtatttatttcagtctcagttctgtgctgaacactatggtatatacaagaaaactaaggcatgattttatacttgaggtttacagtttagtttcaaagatgaaactaatatgtgtgaaataattatggatggcttactagcatttaattgtttgggcagattaataagggctgtagtatttggaggatgatttatgaagaagctgaacttgatcagatccttggaaaagcataaataggatgtgatagatatatgggaagaaggacttcaaatctaggatgtgagctaaattgaaagctccatagtggcagggattatttcttttttgtgcattctctattcaagtgatagcgtcctgcatgatatttaataatgcccagcaaatattttactgataaagggaagtcatgaaggagtttcaaagtatttgggggatgggtcagttaggaaattgccctgcctggaattcagatatttctgttgggagctgtgggacagcaagtagtttatttactcatcttgccttatttcagaaggattttaaatggggcagaatggtttgcgatttatttgatagacagtagtggattgtgtagatcattaagcaaaagagtgataaaaggtaaatttatgcactattagtctgggtctagtattttactttatacagctttattgagttataattcacatactgtaaagtttactcttttaaagtgtgtaattgagtagtttttagtatagtcacaaggttgtgcaactatttccagtcaatttcatttttttttaatgcctggatgccacttattggaatccaatcaattttagaacattttcatgaccccaaaaaaccctacacccagtagcagtcactctccgttacctctaccctcaacccttagcaaacactaatttactttctgtctttatggatttgcctattttggccatttcatgtaaatggaatcatacaatttgtggctttttgtgactgatttctttcatggggcaagtgctgactgctgtagtcgttgtcttcagtggtgatggacgtatagcaaagggactgggaaaacgttgagaatctttgaaagcaaaattaaaggaatgggtagagggataaaggaaggcctatggataaaggaaaatcatcttgggaaggaaatgtttaccaaatacttagtgagttttattcactgttaggtcctttaatccttatgacaacctcatgaatttagttttattcccgatgcattagggatagtctatgatcacaggatcacaggctagtaaatggtggaacaagcattcagtcatgtcttctttatttcaaggttcatgttctccccactagtgaaaaggagttaagattttaaggtttaggcttgaagggaccaggagaatgtttctgttgacacacagagtaggcgtccaggttcttcactcaacagtccatcagtatttttgtgtcaggttaaacattgacttgcatgtcatgagaaaaatgttggagggaattggaaaagttttttaaaccattgctgtttatctttatagctaatattgtcttactctacttgacaaatttccctgtgaatcagccactgcattcttgttttaaaagtttctggctgggcacggtggctcatgcctgtaatcccagcactttgggaggccgaggccgcagatcacctgaggtcgggagtttgagaccagcctgaccaacacggagaaaccccatctctactaaaaacacaaaattagctgggcgtggtggcgtgtgcctgtaatcccagctacttgggaggctgaggcaggagaattgcttgaatccagctactcgggaggctgagtcaggagaatcgcttgaacctgggaggcagaggttgtggtgggccaagatcgcgctgtcgcacttcagcctgggcaataagagcgaaactctgtttcagcaacaacaaagtttctaacaccaaattacctttttgggctttggtattgtatgacgaaaactgggtaagctgagaattaagatattatgggagtaggcattgggatcaattagtaaactctgttttcatttgggatttatttggtaatcatatcttacataaaattatataagatgtactttatttttatgatatggtaagagtataagcaagtcattcatattaagatagaattatttgaactttagtggttgtcagtgttaaggttttggaaagagttgtgctagatcattaaagtctcttctatccttaagctctggggtcttatatttattttgttatatcatttcatttgttgaactattgaaagttaaaacttgttccgtatgtagaggcacaggcagagtagatttagcatcattcttaagggccctataattttcagaattgtaatggaacattggcttcaaagtcaccactatattagcccctagcaagagagtgtaattgtacatgttttaatgtacaagcatttgcaatttgtaaaattaaaaataatatccaaggcaaaggatgttaatgcttttacaatgcaggcataagttgttttactactgaaaaagattctattaatggatttcttttaggtaggtacaatcaataatataacagatacctgcatttgttagaattatgacccgtgaacatttaattatacttactttatctttcttgttttaaggaacaaaagagcattattgatgactgtccccaaatccacttcccctttcctcagaggcagttactgttgtgacagactcgccttttttttggtataaaactcatctttcttttgctgttgatttctgccagtccagcctcctctctcacctagccttcttatatttctactattattcttctagtcaccaaggctttgatagcttcaaaagtgcttttgaattcttttctctatattcctttctctaagcaagttgtttttctttttttttttatgtaaaatgatgtattatatattttatacaagcaaattgagtacagctaaacctcagctacaggattttagagtacaatagcaagttgttttttaagtcccttaccatctccctttcgcagccaaaatcagcattgtagatttttttcattactgccatagtaagagcttttctatatatttaacttgtttctctagatcacaaagagacatttttggtttagtttttttttttctttttggagacagagtctcgctctgtcactcaggctggagtgcagtgacgtgatcttggctccctgcaacctctttctcccgggttcaagtgattctcctgcctcagcctcctgagtagctgaaattacaggtgcccgtcaccacgcctggctagtttttgtatttttagtagagatggggtttcgccgtgttggccagggtggcctcaaactcctgacctcaggtgatcgcccgcctgggcctcccaaagtgctgggattacagggatgagccactgcttctggccacaacatggtgttttgatataagtaaaccttgtgtcatgagtcttacaatcaagctaattaatgtatttgttacctgacatagttaccttttttgtgtgatgacacttaagatcgcctttaggcaaatttcaactgtaaaatactgtatgttattaactgtggttactatgctatagcttagatcactagtacttattcatcttataactggaaacttgtatacattgatcaacagctctccaattcctccatttcccaatacctggcaactgccgtgctacttatttatcaggttctattttagatccccatatatgagtacattgttttccttatctttgattttcagtggtttgtgcctaagtgtggttttctttatatttattctgcttgggtgttcttgagcctcttaaatctctaaatttctgtctttcactaaattgggaaaatttttagctactattcctttttatttgtttgtttctgagactgagtcttgctctgttgcccaggctggagtgcagtggcgcagccttggcccactgcaacctctgtctcccaggttcagcaattcttgtgcctcagcttcctgagtagctgggattacaggcttacaccaccatgctctgctaattgtctttttttttttttttttgagacggagtctcgctccgttgctgggctagagtgcagtagcgcgatctcggctcactgaaacctctgcctcctgggttaaagcaattctcctgcctcagcctcccataatttatttttagtagagatggagtctcgccgtgtgggccatgctggtcttgaactcctggcctcaagtgatctacccacttcggcctccctaagtgctgggattacaggcgtgagccaccccgtctggcctgtcactatttctttttaaaaatatttttactacactctcttctccttctgggacctaagtgtgtcactttttttttttttgagacagagtcttactctgttgccaaggctggagtgcagtggtttgatctcagctcactgcaagttctgcctcctgggttcatgccattctcccgcctcagcctcctgagtagctgggaccacaggtgcctggcactgcgcccggctaattttattattgtgtttttagtagagacggggtttctccttgttagccaggatggtctcgatctcctgacctcgtgatccgcccacctcggcctcccagagtgctgggattacaggtgtgagccactgcacctggccacgtgtatcacctttttgatattgtccttgatgagtccctgaagctctttcctttttccttgttttctttccccccaatttcagaatgaataatttctactgcttggcctttattttcatttatctggtgatatttcctttattatcaattacaggtctatgttaatactcattgttgattggaagtctttatcttataattccagcatttgggtcatgttagaattgccttctgttgagtgtcttctcccaggagaatgggttatgttttcctggttcttcctatgtgaagtaattttggtttgtatgaatataacactcttgtttattcgttctcttgttaaacatttgtttttcttccagttttgggtctttatgaactattctgttgtgaacatacatgtacacaattgtgtggacaactgtttttatttttcttgtttctagtagattctaactagaggtagaattcctgggtcagatggtaagtgatagttaaattgttttcgtaagtggctgcatcattttgcattctaactagtaatgttttttattttgttgttgttgttatacaaccctccctccaactagtaatgtttgaaagcacctcagtgcacttttaatttgcattttaaaaatcccatggagttgagtctcttttcatttaataaccatttctgttgttctgggaatggttagtgtctttttgcctttccttcttttgtttcctcccttcctgtccttccctcccttgtcattaacatctaggtaccctttatatgttaaagagattatatctgtctagataatttgtgtagataatttttctctgttactcatttttcttttggctactttgggtgtgtttttgtaaagaagtttttaatttttacatagttgaaataaccttttatagtgtatgggttttaagttatagttagaaagtctcctgcactccagggttataaactatatcacattttcttttaaactttatatttgatacatttagatttatcctgctttaacatgtgcggtaggtatccagtattattttcttggtggtaactgctgaggctggcaggtcacgaggtcaggagttcaaggccagcctggccaacatggtgaaaccctgtctctactaaaaatacaaaaattagctgggcatggtggtggatgcctgtagtcttagctacttgggaggctgaggcaggagaatcgcttgaacccaggaggcagaggttgcagtgagccgagatggcgccacgggactccagcctaggcgacagaacaagactccgtctcaaaaaaaaaaaaaaattttttttttgtggtataatactcataaagtttactgtttaactatttctaagtgtgcagtttagtggcataaagtacattcacattattgtctaaccatcaccatcctccatgatccataacttttttatcttcccaaactgaaactctgcgcattaagcagtaacttcccgttctctcctcacatgcgaagtcccaggcaaataccattccactttctgtctttatgaatttgacttttctaggtaccttctataagtggaattgtacaatagttgtccttttgtgattggtttattttacttataatgtattcaaggttcatccatgttgtaagcatgtatcatgtgtttcctttttgaggctgaataatattccattggaagtatatatcatattttgtttatccattcacatgttgatggatgcttgggttgcttccaccttttagctattgcagatattgctgctatgaacatgcatgtataagtacctgttcaagttcctgctttcagttcttttgggtatatacccagaagtggaattgttgggtcgtgtaattactgtatttaatttttggaggaactattttatagttttccacagcattgcaccattttaaactctcaccagcattgcacaagggtttcagtttctttacatcttccccaacatttgttattttcttgataatagccatcctaatgggtgtaatggggtatttcattctggttttgatttgcattttctttattattagtaaggttgaacatcttttcttgtgtttattggccatttgtatattttctttggagaaatgtcattacaggttgattgctgatttttcagttgggctttttttgattgttgtgttgttctttattctggatattaatcccttacagatagtgatttgcaaatattttctcccattctgtggattgcctttccactgttgatagtgtcctttgatacacaagtttttaattttgatgaagtttttctctttttttcttttgttacttgtgcttttggtgtcatagccaagagatcatagccaaatttagtatcatgaagcttttcaccttatgttttttttctaagagttctatagttttagctcttgtgtttaggtctgtgatcaactttgagttaacttttgtgtatggtgtaaggtaaaggtacaacttcattcttttgcatgtggatatccagttttccagcaccatttgttcaaaagactgtcctttcttcatcttagtagttatggcatccttgttaaaaatcatttaattatatatgtgagagtttatttctgggctcctgattctgttagttcttatgccagtaccatactgttttggtcactatagctttgtagtaacttttaaaatgaggaagtgtgagatctccaactttgttctttttcaggattattttggctattcaggatcctttgagatccatatgaatgttaggatggatttttctatttctgcaaaaatgttattaggattttgatgggaaatgcttgaatctgtggatcgatttgggtaaatagctttcagatatgaaagtttgtcccaagtctgaattctgtactaaatgcaattatccagatggcaaatttaagaaaaaatgaagccatttaaacttatttttaaagcttattaggagggaatgagatcaggttgtttactagctgtccaaaagagagtttttgctaaatgtaacttagagcaggggagaaggtgcttttatgaattacttttttgtttattttttattgtaattttataataattttttaaagacggggtcttgctctgttgcccaactgaagtgcagtggggcagtcatagctcctccatggctcaagtcatcctccctgcctcccaagtagctaggactacaggtgtgagctgctatgtccagctgatttttaaattttttgtagagatttggatcttgatttgttgcccaggctggtgttcacctcttgtcctcaagtgaccttcctgctttggcctcccaaagtgctgggactacaggcgtgagccgtcacacccagctcatgaatgacctttttgaatatccaggaaatctttacagaaaattgcaagggctgtagaaaaataaattatactgataggatttataaattcaaagcaaaaatttattttggaaaagtaaggttaaaagtgggttgttggccacgcacggtggctcacagctgtaatcccagcactttgagaggctgaggctggctgatcacctgagatcaggagttggagaccagcctgaccaacatggagaaaccctgtctctactgaaaatacaaaattggccaggcatggtggcgcatgcctgtaatcccagctacttgggaggctaaggcaggaaaatcgcttcaacccaggaggtgcagaggttgtggtgagccgagatctcgccattgcactccagcctgggcaacaagagcaaaactctgtccccaaaaaaaaaaaaaaaaaaaaaaaaaagtgggttgctgtgatacacttggtcaggatcctgaagaacatcattattctttagagagcaacaaacatgtatatatgcttagagaaatgcttaataggaaagtcatttgaaacctatttgtattattacaaaaatatttgaactttgtgtcactgaaaaacaagagccttgaatttaaagatagtgattacatccttaaattacaatttaaaaagttcatatgtcaaatgccaattagctgttagcagtttttttttttttttgtcaaagaaaaagcgagagaaacttctaccatctacttgtacaaaatttcttctttatggtgactatcgaatttttagagttcataaaaatatcttaaggataatatgtagttatttcatgtgtaaaactcaatagaattggtaggttaatggaggctagtttacatttgaaaagcttttattttggagttttaaataaatttaatatttaatatactttctaatttttttctttttctaataacaattttcaaacctcttcctctccttaaatgtttctcatctcacatataagcattaaagtatttttatatgagcattaaaaagtatttttttagtctgagatttctacggttctgttcttatttttaaaattattgcaatgtattttctgtacgcttattctctgaactttgacttgttttttttaattttcaaatcttaatttttaaagtttgctagtagtataaagcgagtggttttaaagagtgattttttttgtcattcagcactttactccctgcgggagaaaatgtgactttttgaaggttgagccttcaaaaccttttttaaagtttagtagataactttacttttttagattgtgtcctgtaccacattttttttgagacaggaaccaaattagcttttagagtctaagcaacttatgaagttaagtaaactgtgatatttcccctcatattttttaagaattggtgaaaatattgttgtctatgattattatcaaatgctgtaatttagcagtctgcctaactaatgtagacagactttacatgatttagttcttttgggatatttaaaatttaaatctaaggtagtagaacattagttactgctccccaaaatgtagtagattattttgctgtggcatttaaaatacattagaagtgattaaataaattatggtatatccatacaattggatactgtatgcatttattcttgtgttttgagaagagcatttttgttttgattacatattgactgttttgtattaggttcatttgatccttttggtgtttattttgaaagtaattcattgatgaatatactcagcctaggaaatttgattttggccaagaatggggtcttgatcagtctggtaagctggttaaatgaatgtttcttaagggaatttctactgtaatgtggtctgtacttcaaatattactgtaatatttaggagacgatatttacacacataaaaatatgtgtggcttatggttgaaatgaagattagtcaaaagaaaggatgcctgatagttaaaatgatcaggaaagacttcctggagaagttttaagttgtgataaaagtttttttgttgttgttgttgtttttttttttttgggagggtgcagtgtgagcgtagataatatgtgaggggggaatagggaatagacaagatataagggaaaaaagagtagcaggtgtagtatgcttagagctgggtttatgtaagcaagtgatagcagatgcttataaaaattggaaatgattatggagaactttaatattcagctgaaggaatcagagaatgatataattgttcatgtggatgggcctttaggaacaattttacaatgaacaattttacagaaatggaaacaagcttgtacttaatcttgtagccagtagagcatcatttgaagatttttgagttaggccgtttgaaattgggaaatatgtatttggtcttcaactccatattcggacatacaactcctataattcttagaaactccaaagtgacgtctgtttgagtgctaatgggatgactgttggctggcagcccctaggtaacttcaagatggggctggtcacttgaaagaccaaggcatgattagtgagttgggacttccagccccaccctccaaccactggggctgaaggttaagttgatcaccagtggccaatggtttaatcaatcctgtctatgcactgaagcctctataaaaacccaaaggacagagtttggagagctttcagatagctgaacacgtggaggttctgggagggtggtacgctcgagagggtgtggaacgtctacgtctcttcctacacacctcaccctgtgtgtgtctttatctgtatgctttgcagtattatttataataaaccagctaatgtgtttctctgagttttgtgagccactttagcaaattaattgaactcaaggagggagtatgggaaactcatcttcaagcaggtgagtcagaagttccagagtctggggcttgtgactggtgtctgaagaaggggggcagtcttggggactgagccttcaacctgtggattctgatgttatctccaggtagatagtattggaattgaattacagaacacccagctagtgtccactgcagaattgattgcttttttgttgttgggagaaaccctccacacatttggtcccagaagtcttctgtgttgattgctgtggtggtggtgtgtaagcagaggaaaaaacaattagagcattgtttttaggtatattattctcttgtcctttgtaggagttctagaattggaaatactgttttgtcctgttttagggtattgttgggtatagcagcttgaattgtggtggtgacaaataagaataaaagtagagagattaatatgtgggatcagaccaaggaatagttaggtattaataattcactattggttagatagtagtaggcttttaggtagagtgttttggttcaacagtttcagactgctttgtattaaacaagtttttattttggtatagtagactagtcatttccatttgtccactggtaaggtattaaactatactggatgggaaggagagcatctaatgtagtaggagcagtgttaatagtggcttggtggcatgaaatgagttggagtgttgagaaattgtcagctgtttttatggttagggagtttaatgtggtgtcagggcagctgggagaggtcagaggccaaataataaagggacttttttgtatacattacaaggaaattttttgtttttcgttttttttttttaaaacgtgaacagtggggaactgttgaagaggttagtcagtagaccaatatcacttttttcaacagtttatggtttccccttatttttaatgatttactcttatttggcacacttttttttttttttttttgagacgaagtcttgctttatcacccaggctggaatacagtggcatgatattgcctcactgcaacctctgtctcacaggttcaggcaattctcctgcctcactctcctgagtagctgggattacaggcgcccaccaccacaccctgctaatttttgtattttaatagagatggggtttcaccatgttggtcaggctggtctcgaattcctcacctcaagtgatcctctctcctcggccttggcacactcagttcttgaacttaatttggaggctaaaacattccccaaagatattgtttatttatttgtttattttttgagacagagtctcactctgtctcccaggctggagtgcagtggtgtgatctcggctcactgcaacctccgcctcctaagttcaagcgattctcttgcctcagcctcccaagtagctggtattacaggtgcccaccaccatgcctggctaattttgtatttttagtagagttgggggtttcaccatgttggttaggctggtctcgaactcctgtcctggtcccgtaatccacctgcctcagcctcccaaagtgctgggattataggcatgagccactgctcccagcctaatttctatagttttagtagcgagggtgtttcaccgtgttggtcaggctggtcttgaactcctgacctcaggtgatccacccacctcagcttcccaaagtgctagtgttacaggtgtgagccaccacgtcaggcccccagcagatttttttttttcattttatcttagaaaaaagattcttcagatattagagtccaagaatgtcacagcaattacctgtctgctatttatcagtgagtttgaatatggaataatataaaatgttacattctctttaaagcctgcttatagttaatagcttttcccacatagctaaaaaatgccccactatctcctaagtagcccccacatactgcttgtcagagctcagcttttataatttctaatccttatttatgttgttattttgttagaagaatgtaggccaagtctactgtgacaaaacattaaatcttatatttatttttgaatagtaattaatttgaatggtatgaaacaatgtacaatgaaaacaaatctccttctcatttctgttcatcatgccccagttcccttttttggagacaaccaaaattattcttgtgtagtcttccagagatacgttgtgcctatacaaaatatttcatatgtttttactcctccccattagttttatacagatataccatacttgatacattgttctgtatctttgttcaataagtaatatattttgggaattgtttcctatcactatactaagagcttcctcattctattttttgtagctgcataatattccatagtataaacttagcatatttcaatagtttccagtttgattgatatttaggttatttccagtcttttgctgttagaagcaagattgtagctaatgaccttgattgtgtattatttcacatatattcctgaaggatcaatttcttgaagtggaatttcttttcagaagctctgtgcatttataattttgatagaattgtgaaagtaggggttaaatgaagtgaaactatggaatttggtatattatttacctacgatggaatctcacttcataacaaatgaaattctaagaaagaaatgtataattgctaaaatattagtgaaatctttataaattattttgttttgcaggtatacaaaactaggatatgctggaaatacagaaccacagtttatcatcccttcctgtaagtatttcttttaagccacaaatgagctgatttaaaagatccccttccctaataatttaagtaaaagaagtaatcagttctgaaatcctaaaagatttagtccttttaaaaacatgatttgccaggttctaagtgtggcctcatttttgtatgtctgactattcatttcagctttatgtttagctccccatttgccatgtctactaaatacctctttttaaagaaaaaaagaaattagctgataatgaaacagtaccccaatttttagggtgatattgcagttaacagtatgggggtataactaattatcaagtagtccattccccatcatatacctatgaagactgtcctttggtttgtggatatgactactgtttgtagggcccgtatctgttgacgtcctcactaagtgcccatgtttcaaaatatggatggaaggacaatatctcactatctcacctttagagatgttgacctcagctgttttctaatatcccataaccatactgttgtatgtctttagagtatttttgttttatcctatttttgttaatcttgcttaagctgaccattaactttcagtagtttttaaaaaatattctgacattggtttgttagtgctcgtttgttagcataggtctgttccttgattaacgtacttttacacttttgacttgcaaacagttcacgttttttgtacataatatagtaacacttctgatctatttgtcttacagccaaattaaaacttttgcataccaagtgacaaaccttttgagccgttgcttagtggttctcctagacattttaattttgagagtgtcactgatttttcacaatcttatttatgtgactgaattttttgtatttcattgttattcatttatgaaaataagaaaatggaaaaatgaatatgtagagagtaatgaaagcagtgtatgtttcagaatcaatgaagttgagaataagatgttaggctttgccaaaaactggatctttagtatcacttgagcactcattggacacaagaggtcaactgttttgtcatttgtgtagtaagaacaaaattaagtgtgtggcattaaagaaataacactgtctggccgggatcggtggctcacgcctgtaatcccagcactttgggaggccgaggcgggcagatcacgaggtcaggagttcgagaccagcctgaccaacatgatgaaaccctgtctctactaaaaatacaaaaattagccaggcatggtggtgcacacctgtagtcccagctgctcaggaggctgaggcaggagaatcgctcgaacccgggaggtggaggttgcagtgagctgagatggcgccactgcattccaggcctggggggtgacagagcaagactcagtctcaaaaaaaaaaaaaaaaaaagaaagaaaaagaaaagaaatacactttcaaaattgcacctaaaaggggaaatggttttagggtttttatctactcctcactttctagaaacaaacttatttgacttgtgtgtttctcctattttgatacacttttctaggaatcaattatgtaagaacttaggctactgcctaaatctaatacttctttaaaacccagaatggattttagttgatattgatgaaacagctcattcgtgtgtctagtggcctttattattaccttttaaatattttattcatgcatgtttgttatctactgaacatgaagaataggtttgcttttctttgtagtttttctcacatttatatgtcaatacgttgattgttttttgtctgttattaagaattcggtgatacatgttggctttattgctgactaatgtagaggtacttctttgggctagtacttgactttagtcgtatttcagtttagtgttagaccatcgtgtatgtacttactggtttctttaagctaccgtacgtaacacagtaccaaaaattgggtggctgaaaacaacaaacacttagaattctggagtccagaagtacaaaatcaatgcgtcagcagggtcatgctcttgctggtgtcttctggcttctgatgtttcctcaggatccttggctgatagatgcgtcactccagtcacatggctgtcttcttgctgtgcgtctttacatcatcatccttctgtatctgtgttcaaattttccctttctatgaggacactagtcatattgtattaggggccaccttgataacttcgttttaactgtgaagaccctatttccaaacacagttacattctgaggtactggcggttaggacttcatatctttttggtgatacacaattcaacctgtaacaatgctgatgacttttaatcttttgtgtataatcttttgttgtgattgtatatttcaggagactactaaagttatttctgccatcttagcaaaattggttttggttatattcgtaaatggctgtgttaactttttgttggaggcctatataatcttgattttttgaaccattggatctcatcactattgaatccattttttatcttatctctctgccaaaatatgaagtctttgccatgactagttgcagtatgttaaaaattcatttgcctgctgtaagaaggtttttgatttttgagtgttttttctcacccacccagttttaatgctgcaggtacagtgtttataattagcagatagagacattgccactgtcttttactaatgagtattgatatttgatctggaaagcctgtgcaagtggttcaaggttttttttatatacatgcatatttatttttaggaaatttatagtgagccacctggatgtctatgtacactgtaagtaaattgctggagagaatttctagcatttagaaggactagatggtggattaaaaatttttttcttccagttattttctgcccactttcttaaggatatagctgttactaaatgaaagtaacagttgaatgccagatcagtttaagtgcattcagacaattattttgaatgaagaactgaacttgatggattcgtacatttataacttaatctaaaaatacataacaagttttagctttcaaactgtatgctggatttctgcaattatttaaggatattgttgtgggtttcacctaaatgaattgagatttccttttatatatgtagtttaacagatctgtattacatttaaattactagaccacaatagtaattactgttactagacccaatcactattactagacccagtagtgatagggtagagatgtaaagaaagtttaaaaaattattcttgaagtttttttctcatttgtgtttttcagtttttttctttccagttgttcatcaagcatatgtggatttggtgggattacagttttactgagaatcaaaggaggatttatataatttaaaaaatatatatttgaaactttcccacagatgttgtttttctggctttttgcatttgaggtcttgtctctgagtggaagttgaggtttcgttgtgtgaaatgaattttgtcactggtttcttatgacttttgtgaattagtttgacaatttaaataggctaggtcatgttttactttgtagtactttgtaatgggagaagtgtaaggtaaaagtttttctcatttgaggaaaatgaattctttgacatgtctaacttattttaaaggtattgctattaaggagtcagcaaaagtgggtgatcaagctcaaaggagggtgatgaaaggtgttgatgacctagacttcttcattggtgatgaagcaatagaaaaacctacatatgcaacaaaggtatgtttttatgatttgtataaataacattttcaaaaaatagtttgttcgatgcttgtgccctctggaattcactctataatagaccttattaatatcctcaaacctcttctcagtagaaatttctttttccctatggcatccttccctgttgctttaacttttttttttcttttttttaataacccctaagaggaaagttttagccctttcaaatgagcagtatttatttttccacacccactggatctcagggccctcaataaaattacctttacttccacattgctacttctgcaaactttttttccccatctttattcaaacttacaccatttttctcttttttgaagtttatgccatctgtaagtgctgttctctttctccctctttttctttttccctttttcttttctacccttttccctccctcttttaattgaggtgtaagtatgtaagtgttaattatacagttcgaagaatttttatgactgtaatcataacaggtaaagaaacagaacaaatctagtaaccctgaagctttccttgtgcttgttcacacagtcactactccattcccaccaaaaaataaatgctattctgacctttatcatcttattttttgacactgactttgtctgatttgcaaatatcctcctttgtacttcttcccttctcataatttattcattaatgaacaactaccatgtgtaaaatactttgccatgtatcgtgagtaaaatggtgtataaaaaaatttccccgactgcaaggctattataatgtggtggaaaggaagacattgaagaaataattacaagtgtgttgggggttagaagaagggaaacacacacacagtgctctgtgcatgtatcacaggagtagctaacctagtgtggggaatcaggaatgtcctcgaggagtaaatctttaagctgaggcttgaagaataaaataggagttagctgctgaggtgggcaggctgagttgttttaggtagagaaaccaatatatgaaaaggctttacagtatgagagggactagaagtgcatgaccaatatgcctgaagcatggagaacgaggtggaaagaagtgaggaggctgtataggtaggcaggaaagagcactgaatatgttgttagaccatgttaaagaatttgaaccctatcctattggcaacattaatgagtatacctagaggaataatttttgcacttaaagtgcaaatattggaatctgcctgtttgaacttgaatcctgtctgtgctaatttctaactttgtgatatcattcagtgacttaacctttctgaattttgatttcttcgtctgtaaaatggagatattattagtacttgaagatttttttcttttctttctttttttttttttttaagacaaagcctcactttgttacccaggatggagttcagtggcatgaacatgactcactgcagccttgaatatcccaggctcaagtgatcctcctacctcagcctcccaagtagcttggaatacagatgcatgccactatgcccagctaattttttgtatttttggtagagatggagtttcatcatgttgcccaggctggtcttgaactcctgggctcaagcaatttgtccccttggcctgccaaagtgctggggttatagatgtgagttaccacgcctgggccaggattgttataaggcttaaggagatgtgtataaagaaattgttatactctagtgctttgaacataatggttactcaatatatgttggcttattttacttagaaaagattactcaggccacatagacaatgaagagaaattatttgggtaaggtaagcatgattctgggaaaaccagataattgactattgctatagtctaagcaagagatattagtgacggcagtggggatagaaatggaaattgtgtaagtgcaatcacacacacagacatttaacttttattgtggaaaacttcacatgtcaaagaacagaaaataatataatgaacccccatgtgcctatcatacaactttggtggttataatctatggacaatctcattttgtctatataatctttccaccctcaacctgcaattattttaaagtaaattgtacatactatttcacttaacaaatacttaactcttaaatatgaaggcttttaaaaaaggtaaatatgacaccttaatttagtatgcagtttctttatctgatatctagtcattgcttaaatttctttgattatttactatattggttattctgtttgaatcaacattaaaatgtggtctactcattggatttagttgataaatctcttaagtctctttttatctataggttattttccctgtgtgttatgtttcttttcttttttgttcttgccatttatttatggaaaaaaacttgagatgtcttgtaaaatttcctatattctagggattctgattattacatactcattgggtcatttaacatggtaccctacttcctatatttacttttttttgttgtaaatggtagttaaatgtaagtctgattagatttatgggaggtttttgtttgtttgttttgacaaggaaaaagtggataattaaagagtaacagggcgtgatgaatgggatattggtgataagctagatgtatcaattgagggtaattcccagctccgagatagtcttatttatcccttatctgctgaaattgagaatgttaaaggaaaaacatctaaaaattattttattttatttttaagacaaggtctcaactttgtcacctaggttgcagtgcagtggcacaatcacagctcactcactgcagcctcaaacttctggactcaagagattttcacacttcagtctcctgagtagctggaaccacaggcgtgtgccaccatgcttcgctaatttattttatttttatttttatttttgagatggaatcttgctctgtctcccaggctggagtgcagtggcgtgatctcacctcactgcatcctccacctcctgggttcaggcgattctcctgcttcagcctcctgagtagctgggattacaggcatgtgccaccacgccggactaatttttgtgtttttagtagagatggggtttcaccatttggccagcctggccttgaactcctgacttcaggtgatctgcccaccttggcctcccaaagtgctgggattacaggtgtgagccactgcgtccggccttttattttattttttatagagacagggtctccttctgttgcccatgctcgtctcaaactcctgggctcaagtgaccctcccatgttggcctctctcaaagtgtgggattacaggcatgagccactgtgccaggcttttaaaaaaattttacttgacatataataattgtacatatttatggagtatgtagtgatattttgatatgtacagtgtgtggtgatcaagtcaatgtaagtagcatattcacctcaaacacttatttttttgtgttgagaatattcagaattctctgttctaactatctgaaaatatataataaattaactgtagtcatcatatagtgctatagaacactagaacttattcttgctatccagctgtaattttgtatcctttattcaagctctccctattcccttctttcccctaccctttccagcctctagtaaccacttttctactctctacttacatgaagtcaatttttttagcttttgcacatgaatgagaacatgcaattttttatcttttagtccctggcttatttcacttaatgtcctttgggctcatctgtgttgccaggaatgacaggatttcactctttttttatggttgaatagtattgtgcatatatactacacatatccgtatggacacttaggttaatttcatattttggctattgtgaagagtactgcaataaacatgagggtgcaggtatctttgatatagtaatttattttcctttgggtatatacccaatagtaggatggctggatcatatggtagttctatttgtggttttttgaggagcctctgtactatgctttatagtggctttacctattaacattccctccacagtatatatgagttcccttttctgcacatccttgccagcatttgtgattttttttgtcttttgggtaatagccattctaactatggtgagacggtatttctttctggttttgatttgcattttcctgatgattagtcatgttggacgtttttttcatgtatttgttggccgttgatgtgacttcttttgagaaatgtctatttagattatttgcccttttaaaaaaatcagtgtttttttttttttttcttgctgttgaattgaattccttatatattctggatgttaatcctctgtcagatgtacagtttgcgggcattttgacccattccataacttgtattttccctctgttgatggttttcctcacagaagcattttaatttaatataatcccatttgtctatttttgcttttgttgcctgtgcttctgaggtcttatttgtaaaatcttttcccgtaccaatgttgtgagaggtttcccctaagttttcttctagtacttttatagttttgggtcttagatttaaatctttaattcattttgagttgatttttgtataaggtgagagctagaggtcttgtttcataaggagaaacacttttgactgggtagtgtagagaggagaaaataagtttaattttgaacacattgtgtttgaggtacttgtgagacgtctgagattttgttagagtcaaatatgtggattttggaggtaagaaacaaggcagagctggagacagagattcagaaagtgtcagttaccttagacgggttgacattacctaggggaacatatcacaggggaagagaactaagacagagcagtgtgccagttaggtttgagtagaggaggaaaagtctgcgaaagagactgagaatgcatgggtagatatgtagaggtaaacactgtagaatggtgctgagatgagctagagcccatagataatttgctgtctttcgctacaaggtggtgatttgtaacctgaatgagaatagttttagaagagtagttgggctagatgaaagtaggcttttgagtgataggccaggaaaaaagtaacagtaagagtactgttcattgagtttcaattgtgattgggagggagagagagatgaagagacacatttcaacgttaagatggaagacatgtctgaatgctaatatgaaagaactattagagattaaagtaacaggaaagataaggtataatcaaggtctctgaaaaagctggagggatgagatccagaacacagatgactgaattgacatgcggaatatcttacattataatggaagtaaatgagaaaaaaggctaagtatggaatccattttacagatttgaattcctgactgttggcttctgctgcttctgcgaaatatgtggtggcatcatctgctggtcatggatgtggggagaaggtgaaatcttagcggtaggggcggcattgacactcgtcattgtgaagagtaaagaggaacagagtagaagagtaaaggcttgccaggcaaggttaggtccatttgagaataatgactatgaattcttagtctttagcaccctagtgcaaatgcttctgcggtataatcagcattctggatataggcaagtttatgttagggatatatgctgggttggattttggtagacaggatgaaaaaagaacatgtgaaataaaggtgatgggtcaaaatctagactgtgtatattgatggctagggaataattaaagcaaccagtggaccaaaagtcttaattggtgttcagaagagatctcttgaggtggttgagtatgctagaataataagaggttgtgatcagagaagggtatacctgcatttcagcgattgagaggtgatagtgatgatgatataagatctatactgtggccaaaatggaaaagagataccactgaaagtgatgaagtcagtcagtcgagaggccagagttcctttccactgattctgtccactcattttaaacgcatttttaagtcttctaagtgctactaacaaaccagaacaaaacttctctcaatctttattcctaccttctgtcctcagcaatttagctatttttctctttccttttaaaacgacacttcttagtgagtctcaagatatttgatatgctctttgttaaatccaattatatgtaacagttttcatccttcttgatttgtctttcttttgcaggattactctaatggttatcttcctaacatggaatatttgtttgtttgtttgtttgtttgtttgtttgtttttgagacggagcctggctctgtcgcccaggctagagtgcagtggcgcgatctcagctcactgcagcctcgacttcgggttcatgccattctcctgcctcagcctcccaagtagttgggactacaggcgcccaccaccgtgcccggctaattttttatatttttagtagagatggggtttcaccgtgttagccaggatggtctcaatctcctgacctcgtgatctgcctgcctcggcctcccaaagtgctgggattacaggcatgagccactgtgcccggcctgttttgtttgtttttatttgttgtttctattgtcactgatttctcctttacccactactcaaacgttggtttctctaggcactgctttcagttctccttttttttttttttctcttctcataaaatggggtgactcaatgttttattctttcattaaagactttctctaggtgatctcctccattcctttgtctgcaaccacagaccagatctctactttcagttccttgactacatcttcacctacctatttcctggctcttgagttttagtatatctaaaacaaaacgtattatatatactccactcttgtttattccaagatcagacaaaacacaatttttatgttttgattaatggatctggtccatcctaacttcaaagctggaaacctgttggcatcttctgacttttttctctttttttttttttttttgagacaggtgtcttgccctgttgcccatgttggaatgcagtggtgagatcttggctcactgcaagaccctccacaatcactttgaccctctgggctcaagtgattcttccacctcagcctcctgagtagcggggactacaggtgtgtgccaccacacctggctaattaaaaattttttttttttttgtagagacagggtctcactacgttgcctaggctggtctcaaactcctgggctcaagccatcctctcaccttggcctcccaaagtgctgggattataggtatgagccaccatgcccagccctttcttattcttattgactgagaaatcttcaatgtggccccttgtcgtccataccactattggtactcttgttctcacttggttctgttaagcttcatttgagctttcccaatgctgctataatagtcttcctaaaaattaaagctgttcttattcccctgcttaaaaatttctctgctgttttatttcttatagaataaaacctaaataaaaggaaaatttttgagaatctagtccctttgatctagaactggtatatctctctacgcaccttcaaatcttttggcacataaatttctcattgataacttcagttttgtttttgtataccatgcagtgtttgtctttctatacatctttttctgttctccacaagttcctccatacctctcattcccctgccaaaaaaaaagccagaaagcagaactgagttaagacccggcttagatatgacctcctcagcgaaaccttttctctcacaaaacaaggtggtcatcttattcaaggaactatttatttatttatttatttatttatttgacagagtgttactctgttgcccaggctggagtggagtgatgtgatcttggcctactgcaacctctgactcctgggttcaagagattctcctgcctcagcctccccagtagctgggattataggtgcctgccaccatgcctgactgatttttgtattttcagtggagatggggcttcaccatattggccaggctggtcttgaactcctgacctcaaatgatccacccacctcaacctcccaaagtgctgggattacaggcgtgagccatcgtgccaccttttttttttttttttttggagacagagtcttactctatcgcccaggctggagtgcaatggagtgatcttggctcactgcaacctccgcctcctgggttcaagtgattctcttgtctcagcctcccgagtagctgggattataggcatgcaccaccacgcctggctaatttttgtatttttagtggagacggggtttcaccatgttggccaggctggtctcaaactcctgacctcaggtgatctgcctgccttggcctcccaaagtgctgggattacaggcatgagccaccacgcccagtcggaactttattttttttaaaaacctgtagtgtaatatttgttcgtatatatttcttttgctagactgagttttttgtatgctggatgtctgtgtccttagcatttgtgccagtggcttacagtaggtacacagtaataattgatgaataaataatacttaaaacatttgaatttgtaaacttctaataatgttaaaaattgaatgataaagtaaactgcaattttttccttccttaaagcaaactggggagtagaagtccttttataagtataatgccttaaaaagtagtgtggaaactagagtaagaagtagatgttagggattgatactgcaaggtatttatttctttgttcattaatttgtttaactttaggtattgaatgtgtattatgttcatggaattatattctgttgcagaggttcacaaactttctcagtgccgttagggtctcagtaacgtttttcactgtgccacctagatcgaaagaaatgtctgatagttctgtttattaaatacctaggtccaggcaacttagtagccacttgaaaaaaataagacacttaaattggaaacgttatttcactgctgagtaatcacatttctgttaggatgcttaggcatcgctcagcttctcaaacctggaatcagatgggacattgccaccctgatttcttgttttatatcgatgttattttatgtgataacttggtttttatgccagcaactgctgacaaaccaacttctgtaagaaataatgtcattgaaaggaatatataatagtttgatttattgttgaaactgaattactgtgacttgtagatcacgcagtgtccaactgatgttgagtaacactatatttccctggaaaatttaaaataactttgcggcgcccttgtgaatttatggtagtacactggggtgctgtctcagttcattttctgttgctataatgaatacttgagactgagtaatttataaagaaaagaggtttattttggcttgtggttctggaggtgaggaagtccaagatgagttggccacatctgatcaacctctggtaaggacctcatgctgcttcataacatgttggggaatggaagaggaaagggacaaaatacaagggacaacttcactttgtaacagcctgccttcaaccctctggagaattaactcagtcctgctgagaactgcattaattcctctaatgacctgatgacctcttaaaggccctaccacctctcgatactataacactgggaattaaattttaacatgagttttggtgggaacacaccacatccaaatcatagtaggtatcttagcacacagttttggaagcatgactcttaaacatttataaaacttttcttataacattttatgtgcttgattcttacaattattctaggtatgtacttacaggtgcactttttatattcggcatacaacaaatacttgttaatggcctaatgcattaaaaattaaggaaattgtgataaagtatagttttttaggcttaatttttgtaggctaacttatccttttattacaaaacttttaaaatctagaaagactagtacaatggtcttccatgtagatttaacagtttttaacattttgacatattcactttgtttttattgaaccatccatctgacaatgcgttattgaactaatttatctttaaatccttaagtacacatcttttaaggatgttctatagtatcacacctatgaatatatcctcatctaatatccactaatgatctgatatttccttttttgtatttttatttgttttttatattaataagatttaatttgtatttccctttttgttttaatagtggccaatccgccatggtatagttgaagattgggacttaatggaaaggtttatggagcaagtgatctttaaatatttaagggcagaacctgaagaccattattttcttttggtaagttacaagttataatttcactgaggaaatttttgaatacacttaatgagaacattttcatcatacttctttggtatactttggttattaaattgtcatatgtctaaatgactttgtaataaagctgtatcatctttaagaccatctagttatggctacaggagaatagtagtatgtcaaagcaccacatgttaaacacttaagaagtgcttttggtagttaatgtctaatctttatgatagaaacagtaagtaatgttcagaaaaatgttggaaacctgtggcacttttttgcttaaaaaacaatagtctgattattatatcattggtatttcttcataacaaaaatacaatataatctaactttttattaaacatctttttattaaagcagtgcatgttcataacttaaaaaatcaaatgactttataagatttaaaacaacaaaataacactttcctttcttacctctcccaacctttggttcatattccccggaggcaaacattttcaattttaacaaagtttgccctgctagtaatcttttaacatgtttcttttatttaacattttttttttatttcttctgtctttaagaatattatacattatttaccaacttcctaataggaaaaatgagaatttccctttttaccttttctctccctcaacacaaaatacctatcctttcccactcctcgcattgtagttacatcacaatttttggttaaatcaatattctgtgtctttcggtgattgtgatggactataaagttgaaagaaccatactatggacactcatacacccacaatctagattcgatgattaaccttaacatttggctataattgcttcatgacgtctatccatctttcacttcattttagtttttaaatcacttcaaagtgagttgcaaatgggagtcatttgacccctaaatactttagcacgtatttcatcaactagagctatcatttgtgtatggttattcttttcatataaaatttacatatcataaaatcaccggtctgcaccattcagtggattttgaccagggtttggcaaactttctaagggagcagatagcaaatatttttggctttgcaggggttatagtccctgaggaaacttaatgagaactttttatacaatggtccctgtcacagctactcagctgtgctgttgtagcatgttagcagccatagacaatacttaaattcataggtatgtctgtgttccaataaatttttttttttaccaaaacaggtggtgggctgtatttgacctgcaggatgcatgatgtgatttgtccaatctttgtcagttacatacatctgtgtaacctaaactcttaccaagatatagagaaattactatcagcgtggaaagttttctcatgcccttttgtaattaatctctgcccccgtgccctagtgacaaccactgtttctttttcatctgagattagctttgcccatgtttgagtgtcaaataatggaatcatgcaatatgtgcattttggtgaaacacttttacttagcataatctggagattgaattatgttgcatatactggtgatttgttgctttttgttgctgggtagtattccattgtataaatttgcctcactttatccattttcctgttgatgaatacctgggctatttttgtttttttttttgtttttgtttttgtttttttaagacagggttttgctctgttgctcaggctggaatgcagtggatcaatcatggctcattgcagtgttgacctcccagctcaaacagttctcccagctcagattcctgagtagctaggacacacaggcccgggccaccacacctgggtaatgtgttctggtttagagatggagtctcactttgtcacccaggctggtcttgaactcctgggctccaagtgatcctcccgccatggcctctcaaagtgctgccaccatgcctggcttagttctagtttttggttataataaaataatttgaccattgtgaaccttcttctacaagactttttgtggacatatgttttcatttctcttgtctaaatacgtaagtatggaattgcagcgtcatagggtaggtacctgattggttttttagggaaactcatgggaacttttcccaagatggtgaacctttttgcacaccccccagtgatgcattagtaatctgcttgctctattcaagatttggcttatcaatcttttatactttttttttgagacagtcttgctctgtcacccaggctggagtgcagtggtgtgatcttggctcactgaaacctccccgcctcccaggtttaagggattcttgtgcctcagcctcctgagtagctgggattacaggcatgcaccaccacacctggctaacttttgtaattttagtagagacaggattttgccatgttggccaggctggtcttgaacttctagtctcaagtaatctgcccacctcggcctcccaaagtgctgggattatagatgtgagccactgcgctgctagcttgtcagtctttaaaattttagccattctggtgggtgtgtacgatttttcatttgcttttaattttaattttcattttctgataattatgttgagcagtctttcatgtacgattgttattattagctatttgtatattttcctttgtggggtcctctgattatcttttatgtagattttttttcttggagtttataatttcactgccttggtttttagtttacttaattttgtatgtattcatcagtaaattatctccagacttttaaacatagctccagaactcttctaaagaagtttaaacaccacagggagtttagcttataaaggttttatgtaaggtaacagtatacttagttgttttgctttatatttcttttgaaataataattttaaaaatatttaatttttaatggattcaagttttatcactttttccctttgtgatttgtacttcagaaatttaaggagttattcctaccttaaggtcaaaaagagaattctgtgtcttttttaaatttaaaaatttttcttttacatttaagtatttgagatacctattagattgccagtcagactcacaagaatcagaggtcttacccagtgttaatctttaaaaattgaaacagtttaagtgatcatgaggcataggtgaaatatgaagtccaagactgccagatctctgagtccttccttgcctctttagagtgtgttctgtcccagacttaacctgtgaggtttctaagtgatgtatacagtcacataaacagaagagtgctctgcaaacatcttgattctatgctcttaacaggtaaattaatataacatttttcagaaagctgtaccattagatctgtagaatctcggcttgtttactgtaatcctatatacttcggggacattcatctaaaagcattacttagatgagggctctcccactggcaaataccattgatgttttttctggaggtttgtcattaccatatttaaaggatgatttgactggaccaccttttccctacctccaaccctctctctccctgcttcatttctttttaatgtttaatctgtataagtggtatgatataggcattcagggtattttttttttaaaatgtgaattaccatactgttttcatatatgtatggatgtttgaattctctatagttttcctttgatctctgtgtctgtctttctacttgtaaatttaatgcattttaaataaaatgtttgaaataaattacttctcatttaaaaattgtcaagaaagttatcaaaataatctgatattatctatttaaaatgttatttatttcaatagactgaacctccattgaatactccagaaaacagggaatatactgctgaaataatgtttgagtccttcaatgttccaggcttgtacattgctgtgcaggtaagcaagttcatactttctaagtttgattcttacattttaacctagtttaatttgctgcctaaaatacgtactttttttttttttctgcaaaggtttaaacataatgtcaaagcatgttatacttctctcctgaattgttaatttagaagtaatattatgggaagtggagatatttagtcaggaaaagagaagtgttaaaaaagtaagttagtggtgtttgggtatttcaagggctttcataggacagaaatgaaggaactaatatttatggaatgctttctctgtgacaagaacattgtatatatatttatccttgtaaataatcctttatcatttatccttataaatctttttgtcctttattgtagtcttttttgattgacttatctttaggtatatttgacaccctaatatttcacttctcttaatttgtacgtttatctgtatggaacagcttctctcccacccctcaggatcagagctgacctcattttttttttttttcccttgtagcagaggtaatccctgacataacacaaatgctttatatgtgtattaattcattatttctattaaatgtagatatttttgtttctgttttttgtggaggaagaaaactaaagctggaaggcactttattcataattaaatggttagctgtgataccaggcagctgaggtctgtctgactttgctctttcttgggatcacactggtttttgtaactccacggtacacagaatcaataagtgataattatggatgaatattttaacttggatagcaaagaactttttaatgtttaatgcaatccataaatttaatgaactgccttttaaattctctgctgctaaaaatatttaaggagtcacttaaacctgtcatgaactttatagaagaattcagtcttgagtgggaggcccttttttagttcttagaatatgaataaaatgaggagttgggaaaattcatctttcacttgggagtttttgcttctcatcctatgttaaatataataaacttatgtttaaccatattgtcaggtaaagcttactttaaaacactggcatcatgagctttgtttcattcctctggagtcgtaatttggtttttcagtgatttccttagtggcctctgagtgctcttaatttcattatttaatctctgttctgttttgttgatgttcagtagtcaataacatttctgtaacatgatgtgctgatacatatctattctagtttgggaccgtaactgtttacaaaagacttgtaaaagtgatcagagataattcttggttgtagatgatagttttgaacttacttatagaggaaggatatctcataatgaagtctaaacagtatatatatatataactagtattaggatggaatttttcattttaagattgtcaaaaaataatgtatagttctgttagcctatagtgattatgtggtgattgtgttaatatgatcttgtgttcagataggagggtgacctagatagctttctaggtcccttttagctattacagtccaggtaggtaaaataagtccagtataagtttagttgtttttaattactagtcatatactttgtttgaggcttggattgtaagaaatttagttttttaaaaaatgaactatgttaatttcttaattctcacacttaaaaaagaattgtgttgtattgtctgtaccaaggtttttcatagaaaaattttatcaacgttgctccataattaaatcatagtagtatttggaggtgtgcgatggcgttttctgtatgtcatatagtcctaaacacatgttaccttaaaaaaatttgaaggtaggcctggcacagtggctcatgcctataatcccagcactttggcaggctgaggcaggtgaatcacaaggtcaggagttcaagatcagcctggctgagatggtgaaaccccgtctctactgaaaatacaaaaattagccgggtgtggtggtgggcacctgtaatcccagctactccggaggctgaggcagagaattgcttgaacccaagaggcggagattgcggtgagccgagatcgtgccactgcattccagcctgggtgacagaaagaaactctgtctcaaagaaaaaaagaaaaagaaggtaatcttttagtaatagttgtttatagccatatatgtattgaataactggaggtagggtggttgtgtactttctgccttacattgcagtttgtaacaggccagcccacgtggacatagtttaagttctggcaagttagttctatacaattttttttttttttttttttgagatggagtcttgctctgtcgctcagtctggagtacagtggcatgatctcggctcattgcaagctccgcctcccgggttcacgccattctcctgcctcagcctcctgagtagctgggactacaggcgcccgccaccgcacctggctaagtttttgtattttttagtagagacggggtttccccgtgttagccaggaaggtctcgatctcctgacctcgtgatctgcccgcctcggcctcccaaagtgctgggattacagacagttagttctgtactgtttaatgcaatcttccacatttttagctttaggacagaaatagcctttataaaatatgtaaatcttacaaatcatgctcctaaaagcaaatgtaaacctctaagtttgtcttaataaaatgtagggagtgagctattttattgcataatacaaaattaattttatgtattttctttccacagatactacatttaaaattgaataaagtactccagggaactagttttttttttttcgattaactctttgtttttttgttttttttttttgtttttttgcctttcttctttctttgtgctcaaggctgttcttgccttagctgcatcttggacctcaagacaagtaggagaacggacgttgaccggtacggtaatagacagtggagatggtgtcactcatgtcattcctgtggtaaggctattttacagttactgaacagaacatgaaataacacatctggcaaagttaaattatacgaattaatgttacttttaaaaaactttaaatgctgcactataatttggccatttgtccagttatagctatgttttgctcaccgtttaaaacttttataaacaattcaaaatgtttcttttactgtaggtttgtactgcaattaagaaaattacaaattgcaatatctggaatggaagtatattaatggctttcattctgttttccagttggatgtgtgttagccatttgatgacctcttttattcataattaacagatttcagactggtgtacagggtaactgtataacagttagttttaagtacctgaactttagtagatgctttatggtttgtacttaataaagcatattaagaaaaatgcatcaaattagattgtcagaaataacatttttcttccaaggccgttgtgcttcagttcttaatgatacatcaagttttaaaaaaattatgcctaatgaattcaaaatgactactagaattcatactgtttattattaaatgggtatatagagaaaggtttatcttttaaagtaatttttatattataatgaatatcacttaaggatttacattattttgaacttttttttttttttattctcactccagtgtttaatgcatcaggcaatgtctgttaaagattacatcctcagggtgactacctttggattagactcctggtcctccaccactttcaccctcatgatatgtcataatggttttagtaataactgccattgtttaacgatagcttaagataaaattcatataccatacaattcacttctttagagtgtacagttcattgatttttagtatattcacaaagtccatccgtccccacaattttagaacattttcatcaccctacaaaggaaccctgtaactattaacagtcaccacccatttccccttgattccttcagcccctggcaaccacgaatctactttttgtctgtgttagatttgcctgtcctggccattttatgtaaatggagttaaacactgtggtcttttgtaactgggtgctttcacttagccgaacattttcaagattcatccatgttttagcacgtatagtatttcatttctttttattgccaaataatatttcattatgtggatatatgagattttatgtagcctttgggaggattttagtaagcttggaaattaggacgtgtccagcatttgatagctttttttagtttacttggcagtttatttttctttcttagtggtacataaaataatttttcatcttaaaattattgtttaaatctgaaaatcagtctgtgataaatattatatttttctttgagtacctcagtttactcattaataaaatgcaaataattgacttgcctaaggtcaccaaataataggtagtgaggctaggatttgacctggttctgcctttcttcagtcttttcttaacagctgcacatctgagcagtactatcagcatgttgataattagaataggtaatttgcagaatagaagttatcaatatgtaaaagaatgagttttagtaaggacattaagagtgggtattctggctggtatggtggctcatgcctgtaatcccagcactttgggaggccaaggtgggcagactgcttgagcctaggagttcaagaccaacagggcaacatgctgaaaccctgtctctacaaaaaatgcaaaaattaattgaacgtggtggttcatgactgtagtcccagctactccagaggctgaggagggaagataacctgaccctggagaggttgaggctgcagtgagccatgatctcaccactgcactctagcttctctagcttgagcaacagagtgagaccctgtctccaaaaaaaaaaaaaaaaaaaaaaggttggtgggggggtgctattcctttttattgtttacttttcccgccttctttagaattagtagagtattttttattattctgttttctctttattgacttattagctatgctatatctgttgtcatttgtttgtttttggtggtggttgttgtatgggttgtagtaaacatctttaacttaccactgtctaattacaaataacattctactacttcataaataataattatacaacagctttgaccttctagtctttgttcttatattgtcattcattttacttttatatgttgtgaactcaataatacattgttaacttgtttcattttgagtggtgtattagtttgctagaactaccgtaataaagtactacagactgggtacctaaagaataatgtatttcctcacaggtctggaggttagaaccaaaaattgtgatataactacaatgtgaggagtgggaaaggataggtatcaggattttggcagggttggtttcttctgaagactttcttcttggcttctagatgtccatcttctttatatgtcttcacatagtcctccccatacatgtctgtgtcttaatctcctcttcttaaggacaccacttatattggattagagaaagcaaccctaatgaattcattttaactagataccactttgaataccctatctccaaaaaacagtcacgttctgagatagagcttaggacttcagcatgggaatttggtggggaggaaaaacacaatttacccagtagcaaaaagttatctttaaaagataacttttttggagacagagtcttgctctgtcgccgaggctggagtgcagtggtgcgatctcagctcgcttcaacctctgcctcctgggtttaagcgattcttgtgtctcagcctcccgagtagctgggattacagatgtgcaccaccacacccagctaatttttttgtatttttagtagagacggggtttcaccatgttgctcaggctggtcttgaactcctgccctcaagtgatccacctgccttggcctcccaaagtcctgggattacaggcatgagccactgtgcccagccttgaaattgagttcttttattcacgtaccatatctagtgctctctattcctttgtgaaggtccagatttccacctagtatcattttccttctgtcaaaatgacatccttcaacatttcttatagtgctgatctgctggctttgaattctttcaacttttgtacatcctttgaaaaagtctttattctcctttagttttgaaagatgatttttgcttggtatagaaggttgacagttttcccctgtagatgtcactccactgtcttctggcttaccttgtttctgaaaataagtcagctgttattcttgtgtgtgtttctttgaatgtaatgtttatttgggtggctgtcttcaagattttctttttattcctgattcattggtttttagcaatttgattgtgatgtacctaagtaaagttttctttatgtctcttctccttggggttcattgagcttcttgtatatatagtttgtaattttcatcatatttggaaagtttttgtctgttactgattacatattttttctcttcctcttttctctcctttaggtactctaatcacatgtatattaggctgcttcacagtgtctcaaagatcatgatgctctgtacatttatttttttataatctttttcttttttttggatagtttttattgctctgtcttcaaattcactattttttcttcactgtgtagtccactgtaatctcatctagtgtttttcttttcatctggtagatttttaaattttagatactgtatttttttcttcagaagttccatttgggtctttttatatcttccatttctctcttcctcatcctcattgttgaccttcttcattatatggagtatatagttgctgttttattgtccttgtcattcctctgtattgtttggtttttctcctcgttaagtgttgtgtttttccgcttccttgcatgcttataatttttgatttggcactctatacattgttgtgtattgtatttttggagttctttataagtatttaggattttttcctgggacatagttaagataccaggaactagtttgatcctctcaggggctccttttaaatgttattaagcaggtccgtaacaggtttttgtccagggctggtttgtccccattcttgaggcaatattcttctgaggactctacttcatgtcttgtgtttgaaaacatctttcaactttggctagtgggatcaggaactatttctggctatgtgtgagctctggtggtggttctgtctacttttttctagaggtcctttctctcaccttgatggtttcctcacaggagtgtgctgatcagtattcagttaaggaggtactctcttcacatcttcccagctccctgttggttcaactcctccccctccaataatttggcctacaaacttcagccactttggcctttctgacctttaaattctatatccctaacttaatgagaccagtttgagttctctttcctattgttgtggcctagtaactctccctaggcagtaggatagagtgtaacattcacgttatttgtttcccttttcttagaaagtatctctgccctactctgccgattgtcaaatgtctgaaaacctttctttctttcttttttttttttgagacggagtttcgctctgtcgcccaggctggagtgcagtggtgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggccgaaaacctttatttcttataaattgtcctgttttctctttaaattgagagggtaagttcaatccctaatattctgtcatgccagatgaaggcatccttaatattctttcctaatgaaatttaattttgccacactatttgttatacttctgacacatcagtaaatttgtgaatcagttctacagaatttagttatttggcattatgatggtgtgtggaaagcttcaggtttgtgaaatggatacatacttgattaggaaaatgataagcactttgtcacatttcttatgaagcaatctaaattttttactgaaattataaatgatttaaaaatagtaccatctgatataaagtctgctatctaaaccatttgatatttatattttgaaatttattatttctatattgttgagttattttagtcatagttataaactgtcagtgggaaaataaatctaagttgctggccattcttagttatagtttctgaggaataaaggtaagttctgagataaagcagtacttgagactataaatacactaacttaataaattggtctttattggttcatatttttgggttatattaattttcaaaacattgaaagtaaatttggtatcttttttcccctctctaggctgaagggtatgtgattggcagctgtattaaacacattccaatcgcaggacgagatataacatattttattcagcaactgctgagagaccgagaagtaggaatccctccagaacaatccttggaaactgctaaggcagtaaaggtaaaaagtgtgataggagtgtaatttagttaaaaattaaaatcacatttataacattaacgtgagaaatttttaatagaagaagagtacttgaaataatcttgttaaccagttataaattattacccttaaatatatttacattttctttgtgtttcttaaaagaaaattattacagcagtttgtcttctgttttcttcatattttatatttgagaggagtaatataagaacattttaccaaatgacattaacataaatttttgtgattattctctttattaaaaataaataattatttcactataaagtccttgcatctcagtttcttcactgaattctttattttaattctaaaagcttttgtcataaaaattattttgatacaattgattcattgtgctatagtatagaagcagtgcttggctcaagtgatagggcacatagaagaaaaacatgaaggctatctaaagtattttattaatttttttctgccatgtaagtattatatcagtgcttcatgcaaactatcaaaatactttagcatcgtctttcaaacttattatttgccacataaccaaaaaatttcagtgggtttcacgtgttttgaaaagcagaactgccatggcaaaagtaacttacttgtctctgtttccatggtttttttttttttaattacctgtaaatttttaaaatttttaatttcttatttttattgatttttttttttttttgtagagatgggatcttgttctgctacccaagctggagcgcagtggcacactcgtggctcactgcagcctcaaactcctgggctcacgtgatcctcccgcgtcagcctcctgagtagctaggactgcagatgcatatcaccatgtctggctaagtttttgtagagatggaggtcttgctatgttgcccaggctggtcttgaactcctggccttaagcaatcctcctgcttcggaatctcaaagtgctggatgtgagtcaccatgcctgggcctctttgcttgtttatgggattttccttgctcgtcagagcttaagaatgaaaatttatcaactacttcctaggtagtaaattagtaaatgactaccaaaagttaccccaagttggtggcataagaattaaatatataaaaagttaatgtgaatactactgattcaacatctttgggaaatctgtgaaattaaagcaaaacgagaaaacaccagagatttaaatctattccagagaagattgatggtcattctgaatgtctttaaaggaatatcatttctttgtcattctcacttccaaggtttggagaagacctcaaatagtgtaatcaaatgtcttcggattccagtattttttctctttgtgtattttgattattactggtaatatttgcatctatcttggatggtgcctgtgatgtgtaaaaatactggaaaaggaagtttttttaaaaaaataaaacaaatattggttggcagttgggagtttataaattacaaatatgatgttataatctataatatatttttcagtgtttttgatgaaaacttttacttaggtcatataaccaaatatgcaacaaaatagagtaatttatatttttagccttttttctttgctcttttatttactcagaccgtaatcagttttgtttcagatagatattaaggatctatattaatttgtgtggttatcacaattattacttattcttcagttctgtattttatttattctccttacctacagcacaagattcattattactgagacagaaaatgttgaatgacattagtgaacattttcaggaaataacattgaaatagtagaagtcagctctccagtctctcaaatactgtttatatttaaagtcagaaaatatgtgtaggagatgagtatgtttatttgtactacacatatgataatatcctaacaaatttttcttccagcttaatttcctaattttattttctgaagagttttttttttttattggattatagtttactgaaaacatgccattcttctttactgttcctataataagcaaaaaaagttacttttgtttctttgtttttcaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagaggtaattttttttaacggaattgtttaaaagtattcagcagcaaatatgaattaatagatattcagagagaattaatctcagaaacttttattagtacactaaaagtttgagtttttatgaaaagtttataaaacattttatgaactttttaaagaaaaaatttgcttttgttaaaataagcaaaattgttgctattttttgcagatttagaaaaaactttttaaaaaatatgtgtggcttatgggggggtcatgaaaagaggagagcccttaaattttttttttcttccctccatcatggactcaggtaaagttttgtaattgaaataaaatattttgggaaaggttctagaaagctccccccctccctatttgtgtaaaatgaccattatacaaagaaccttcaattaaccattaaaatatataactagtagcaaaatagtcttctgtctatgaagttttagcaacataaaggctttattaaattaagaaatacatacttttaataatggaaaattcttctggtaacttagtatcagaattgtaactttattaatagaattactaatattacgtacttactctgcttatttaatgttaagaatagttatttttaaaattttgtttattcactcagcaaatgttaaatggtttgaattttcatgatctcagcttaagcactgggtattcaaagatgaaaaattattttatcttgctcttactgagctcaaagaataaaagagatgagtatttaaacacgtaaggttatagttgctttaatgagtgtatgtatctgctgagggcacaggaacaaagagcatgtaagtctgcttgggagaacatctcaggggagataatggttgaactgagacttaaaggatgaatgggtgtttgtcagtcatgtgtggtaggggagtatatgtatttttgtcagaaggttagctaggcagaggtcttagacatgagagtgctggaaagaaaagtatagaggacagattggtaggagagggatccagataggtattcatggacccagtcttgaagggcagatatgttatgcaagggagttagctagattctgtagtcatgcaaaaattttaagcatagaagataattgtgtaccatattagaaaggttactctcgcagcattggtttggacgggttggaacagaggtgtgaattgtgttggaaataggtgattttactatagtattttagatgaaagatgaatagtatttgtgggtcagtgagaatgaggaaggaggtgagagaaaaatagaatcaacataatcagtaattgcttagatatgaggggagtaagaatatgaggaatctgtgataattcacaggtttgtaacttgggcaacccagtgtgccatccactgaaatttgtaatactgaaggggaggagtaggtgaaatagacaaagatgagtttattatatgcatcttttaaaaggttcaaaaacaaacacttgggtgttgtaaagtcatcaccctttgtggggcacaaaggaagaggttggctgagaaggggctgtggagtagaaaggtgaagaatagggccttcgtgaacacagacacgtggacaggctgagtaagtagagcctgcaaagaatactgaagatgacagagaggtagaagccaagctaaaggattatggtcataaaattgagagaagtgaatgtttcaagaagggagggtaaatagtgccagttgctgcagtgaagtaacattagaggaaaccttagaagtacttggagtttttcagcatctaggttattgatgatcataggggaggcgtttcaatggagtgatacgttagagcagcttgttacttatctcagtgagaggtgaaggtttggaaatcagcagtctggacattctgagagatggctatgaaagaaaaagacagtggacgagtaagaattcagttgcaagaataaggctcaagatagttttaaatttttaagagggcttactccagttacaggagggaaggaattaagtataggtacaggaaaatgaactaggaagggcagaagcacaggtaggtagttgaagaagttcatcatcatagttcatagttttaatttttttatgaggtggaatcaagcttatgttttgggagaagggactggactaaaattgaggccgaagcgggcagatcacgaggtcaggagatcgagaccatcctggctaatatggtgaaaccccgtctctactaaaaaaaaaaaaaaaaaaaaaaaaaaaattagctgggcgtggtggtgggcgcctgtagtcccagctactcgcgaggctgaggcaggagaatggcgtgaacccaggaggtggagcttgcagtgagccgagatcacgccactgcactccagcctgggcgacagagcgagacttcatttcaaaaaaaattgagggcttgtgaagaataatgactttcatatttactgttgaggggaattgagagggtgactagtgagtacatattaatagtatggggcatccattctttactcaaggtagcaggttagatacccaaaacttttagttgtgcaatagtgtcctctcgcctcccccagacagttgtgggaaaggaggaaaaggttttgataaagcagagattaaagtattacagcatagaggagagagcaagtcctgaaagctgaattacctagggatagtgagggtacaggtattggagatcatgatgaaatgacacataataattgtgaattggtagcagaggagtgagcatgagaaggataaggaattgtggtcagactagtatactggagtgtgaaggtttttggtggtacattttctttgcactttatcaaaacataaagattaagaggatgtatacacacaattttaaaggtcaaataacactgacagacttaaaattagcagctcttcaccctcctgctgccattgtgttctatagagcatccactagcttttagttattgctcttggtagtaacccccagatttctaaatactgtgatggtattgcaggaacatggatggagctgtttcttgatatgtcactgttagtggtttaaatgctagcctcctttcagattagttctttctagactctcttttcttccagcctgccaacatgttaggttattgttattaggtaaatcaatagtattgtaatatttatagtattatacctgagactgttgttcacttttgaggcaagtagtgtaatgtgattcttttcccttaaaattcagcttttcctacactttcaccttgtttattcatttgcttcattttctttttttttaactttaagttcaggggtacatgtacaggtttttatataggtaaacttttgtcatggaggttgtacagattgttttgtccccaggtattattaagtctagtatccgttagctatgtttcctgatcctctccctcttcccactctccaccctccgataggccccagtgtctgttgtttccctccgtatgtacatgtttacttatcatttagcttccacttaaaagtgagaacatgcagtaattggttttctgttcttgcactggtttgctgaggataatggcccccagctccatgcatgttcctgcaaagaacatgacctcattcttttttatagctgcatagtattccatggtgtatatgtaccacattttctttatccagtctaccattgatgggcatttaggttgattccatgtctttatttttgtgaagtgctgcagtgaacatacatatgcatgtgcctttatgatagaacaatttatactcctttgggtatgtgggattgctgggttgaatatttatgttttaggttcttgaggaattgccacactgttttccacaatggttgaactaatttacacctaatatacaccaagagagtataagcgtttctttttctttccagctttgccagcacctttttttttctttttaaattgtatttattttttaaaaatattttctctttccttcattttttaggagggatggtgtgagaatattttttgagtttttaataatagccattctgactggtatgagatggtatctcattgtgggtttgatttacatttctctaatgatcagtgacgttgagctttttttcttaagatttttggccacatatatgtcttcttttgaaaattgttcatgtcctttgcccactttttaatggagttgttttttccttgtatatttatttaagttccttatagatgctggatattagacctttgtcagatgtgtaatttgcaaagattttctcccattctgtaggttgtctgtttactctgctgatagtttcttttgctgtgcagaagctctttaattagatcccatttgtcattttttgcttttgccatcttcatcatggaatctttgcccatacccgtgtccagaatggtataatttgcttcattttgtttgtacagtcatttattcattcatttatttattggggtttgaattaactttcttgttatacacggtctggaagggaaccgaggagggtgggtctcattctatatagaggattttaacagtttcttttccaaacaggattgaaatattgtattcattgtttttttgccccctgattcatccttggtcatttacctttccttttaattctcttgctgtcattttagcggagagtcaagagacgggagagataaccacatgtagctggaagttaggacagatttttgtatgggccatttatatgtgagtagattaatagaagtgtgtcagacctcatttcatttaaggcacatcaattaacttgaaattgaaatcttagagaagaatattaaagctccaagttggggacaggaattagaaaattgcagaagatcctgagcaaatgtcctgcatgaataggatcatgaccacacgatggataatagcatgggatataggagatgagcatttgaatggaatatgcttgacaaatgagcttagctgatgccttggctttcttaaaaaccttgaagtaggctggttgtggtggctcacacctgtaatcccagcactttgggaagccaaggtgggcgaatcactcaagcccaggagtttaagaccagcttgggcaacatgggaagagcccgtctctaccaaaaaaatacaaaaaattagccaggcatgtggcgtgtgcctgtagttccagctacttgggaggctgaggtgagagtattgcttgagcccaggaggtccaggctgcaacgagctggcattgcaccattgtactccagtgtgagcaacagagcaagaccctgtctcataaataaataacccaaagctttagatatgtaaataaaatgtgtttcatattgcttaggaaaggtatagttggctggatgaaaatgtgtcttgctgctaatgtttcatatatcattttttctattaatttgaataacctttattgtttcatacaccaatttttctttattttttaactttaaaacattttctgttgtctatagctttatgttccttataagtaatttcttctatgagaaacctgtttctctttttaaaaaacctgttttgttttcttttttttaaaggctgtttttaaaaatcagttatatatatgcacatggtttaaaagtcttggtctgcgtatcctaacaaaaactaggggtgccctgcatgtttctttctcttgttttgtatttctagaggtaaccacttcaaactcttcttagttgcttcttttgctgattacctccttagctatgaattgcttggttatattgcaacttcaaattttttttcagtgttaggcttttcttgttttcttttggaaacagggtcttgctctgtcacccagtgcagtggctgagtcatggctcgctgcagtctccccaggctcaggtgatcctctcacctcagactcccaagtagctgggactacaggtatgtgccaccacttccagctaatttttgtatttttcgtagaaacagggttttgccatgttgcccaggctggtcttgaactcctgggctcgagcaattcacccatcttgccctcccaaagcgctgggattataggaatgagccactgtgcccagccctgtgttaggcgttgtctgtcgaattccaactatggaagaggaagattgtcttttttatccttcttctgtcatcacagacaggacctttctattcccttttcatctcatttgttacattataatttcaagtaggttgaaattcagtgcttatgtttttgtgaccacaaattttgttcatatctgagccatgtagttaaccatgaaatcttttcccttcctataagtaactttgttttccaagaagtcattaataaactgtttgcttagtgctaaaataattaccattcattcacctccaaactctcttcagtagttatataaatctcttctcaggatattcagatgtatagggtttattcatcagtttaattttctgaagtgtcttttacatcccaatctgaacttgcttctgtcggttcccagtatagagttgccatattcctttactatcattctagggattccctttccctctctcttgtgttggatctctttttcgtatatcctatgtctttttcactcctactgtccgattctttattttggtgatcatcttccaatagagttccttttagggtgcatgagagaggaaaatgtctgaagtgtattcattttatcttcacacttgttgatagtttgggtatagaattctaggttggaaataattttccttcagcattttgaaaccattgcttaattgctttccattataacttgaagttaataaaagctgatttatatgtataggacctagtttttttttttttcccctgtacaaatgcttttaggatcttccctttgtcccctagcatactgtgtgtgtgtgtgtgtgtgtgtgtgtgttttttttttgtctttttgttttaatctgtaggttatttcttcaactttacctactgagttttactattggatttttaaaatttctggcaacatttttaattctcaagagcttcccccacccctgcttgaatattcttttttaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactccagcctgggtgacagagcgagactttcatctaaaaaaaaaaaggacacagagatatagcacagtactgaataaccctgttcgttacttttgcttgagcatggtatagcagaaaaactatcttataggtaggaaaaggactatgggaaggttcatgtgtgtgtgtgtgattgttttaggcaaatactgaagagtatagccaacaaaggacgacgtaaagaatttacaagttctgtgttagcaatttgatacagttttaaaaatgagtattatggaacacatttttgtcaggttaatattctctgtacagattttggagaagtaaattttttatagttaaagtaaatgataggttctcaggttaaagtgtcactatgggatcataaaaatacagtggtttgagaactgaaggctctttaaaagatttcacagtctgaagctgaaaatgattgtcgaagatcatggatgcgttcatgggaaataaaatttttaggattctgattctgctgctcactccacttaatcagtaactaagtcattttctgccagcacatgagcttgtctttaaattagttatagagccagctgagttgagctctattctgttttccctgaccctagtctgtaggttgggttctaaaggctcagtatgagccacattttcatacctagtgtatattcctcttagaattccgtatgtacactcctcagcatgcttcaaaaagagattttggctgccaggttcttttcttttattatgataataaaggtcagtagaatctttcttagtgatgtttttacatgatctaaatgaaaagattttgtattagtatgtgtcactttgataacattaaatctcttttcattgtatgcgcagcctgtaaataatttagaactaatcttaaaaactggaaaaaggcagggcgtggtggctcacacctataatcccagcactttgggaggctgaggcaggcggatcacctgaggtcaggagttcgagatcagcctggccaacatggtgaaaccccgtctctactaaaaacacaaaaattagccgggcgtggtggcggacgcttgtaatcccagctactcgggaggctgaggtaggagaattgcttgaacccaggaggcagaggttgcagtgagccaagattgcgccactgcactccagcctgggtgtcagatcgagactcggtctcaaaaaaaaaaaaaaaaagaaaaaaaaaaagaaaaaattgacacatgcctaataattatcaatacagttatagactcagtttaataaataaaggaatattgtctctcaactaggacaacctaatgataaaaatgaatggctgaggagatatacaatacttgtttgtttttcactaattagagctagattttgattatttatttagagacagagtctctctctgtcacccaggctggagtgcagtggtgtgatcataactcagtgtaacctcgaattcctagggtcaagcaatcctttttcctcagccctctcaagtagctggaactacaggtgtgtgccaccatgcctagctagtttttaaattttttgtagagacagggtctcgctatgttgcccaggctggtgtcaaactctgggtctcaagcaatggtcctgccttggcctcccaaagcactgggattataggtgtgagtcaccatgcccagcttcaagttgttttttgtttttgtttaagttagttttttaaaaagtatgtttttcttgagtgccagctgtttggaaatagtaagtttattttgactatggtatatcatcgtttgaatatatagctgatgtttgttattcaaagtagatgtgccaaaaagttcttgagagcgctgaattagtgaacactgagctagctattgctcctaggggaaatacagtattaggtttctttgagcctctggtaacatttttgttatcccattaacatatacccttgtttcatgtgtgtttctttttaaaggcactgcatttagtatatcattttagtatattcatttatattcaatagcactagaacacatgtctgaacaaagctatctaacttgctttttctctgtaagacacatcacagcctccttgtgtttactagccagcacttgagcagtatgcttgggggccattttaaataatgaaatcactaacaaaaatatgaaaaccgtgccactaaatagaactgtgaaaaggacacttgtttatagtatgagagctgaaactagatagcagagtatcatcttgttcaacctcaatggggaatgtgcacatcagtggactcaaatttttgttgctctacacgtgcatgtccatgaataaccatattttgatttggggagtaacaaatatgttttagcgattaggtaaattcacaaatatggaatcatgaataatgagattagactacatttatttatttcatcccctattgatggacttaacgggtttttcctcttagaaacaaggctatagtaaatatgcatatgtaatagcatacatgtttggggagtttcttcagagtttgttgtaagaagtggagttactggtatgtgcatttaaaattttattagctatttgtattagtccgttttcatactgctaataaagacatacctgagactgggcaatttataaaagaaagaggtttaattggacttatggttccacgtggctggggaagcctcacaatcatggcagaaggcaaggaggagcaagtcctgtcttacatgatggcagcaggcaaagagagaatgaggaagacgcaaaagcagaaatccctgataaaaccatcagaccttgtgcaacttattcactccatgagaacagtatgggggaaaccaccctcatgattcaattctctctcaccaggtccctcccacaacacgtggaaattatgggagtacaattcaagatgagatttgggtggggacacagagccagaccatgtcactatgttactattgccaaattattctccatagtggttacatcagtgtatactctcacagcgttatatgaaagtttccatttacccagatttttgccagctcatagtatatgtatgactttacatgtttgctattctgatagttataaaatggtatatatcatcataattttgagttttctctgatttcagtgtcttcaatctgaatctgttagagaccagtattagtggtttctaaaaggccttttgtttttgaactgaaaactttgtttaaccttttattgtgatatttgtcagtagtgatatgatctctattatatatccaacttatttttcagtttgctaatccagactttacacaacctatctcagaagttgtagatgaagtaattcagaattgtcctattgatgtcagacgtcctctctacaaggtatttatagcaaaattgttattcaaggtcttactttaaaaaaacttaaacacctctcataaaaaggatataatagcatttcagtactatatattatatctttaaacttttctctttttaaatattatatttattttctctccactagaatattgtcctctctggaggttcaaccatgttcagggactttggacgtcgcttgcaaagagatttgaaaagaactgtagatgcccggctgaaattaagtgaggaattgagtggtggtagattgaaggttggttttcccaattattggtgagaaggttgagggtgccttccttgattaggatgagaaatatttgccagcattcactctgatttagaaaaataagaggaacctgtcaggtattctaatggaaatggttaatgttatagatttatgtctgtgatattctggatcatttgattcttctaggatattgtctgtatttctggaaaataattcttagtaatacctgtggaaagactttttttttaaatacctctctcatagataattaatatagtagatttctttgcatacaccaacaatcaaattaattatggatccacaaaatgttttatactatagaaggacagcaaagctgagttgagattgatgccattgttgagtagtcaagcctgctctcaaaaactgactttagctcccacatagcaacctcaaagtgtgcagtcaaatcggtggtttaataaagtaacctttgtattacatgtcctggacctttaggcttgaggttaaaaaaaatcaaaattaatttaaaattcttagatgtctactttctatatttagagatagattcttcatttttttcatccttgttaaatattgaagcagaacgttgatttagaggaatgatatggcttttttcaaagctgtttgaaaaaaggtatttcatgtgaataaaataccttctgcttggaagattaccaagaatgaggactttatctgagacttccataatcattcagaattacttaaaagtaaagcacagcactctagggtttgctgattgttgagaaattgcatgatggctgactgttgtcagtgcctatattttgattatcttgagtaaacctatccctaggaatgcagtaaaaagtatatgttttgggtggaaggcaaaatattgaactctgtccctataatgtcatgacttcacacttcaggaagtctactcaatagacttttaaaatgttgtgtttgcttttgcatccccttcccaaccaaccaaaccaccagcccacccccattcatccattcatttgcccatccgtctactccccttacccacatatctatctaccctacctcctacctaaaaaagaagtcattgggttttgcaagtataaattctctgtactgagaatcctactaaccacattgattatgtgaatgaacatagtgcatgttctggtttttttgttagaatacttaaaagattgaagttgattgtcctaatggtatggttatggatgtattaaagtagctgtttagtttttaataactcattacagatatataagtacaaaacaatgctgtatgtttctgagtatagtattttaaaaaagtgagattgtttaacatttttaagctctttttacacttgtaaataagaaataaatttacccagtgatcagtaccgtatcgacatattgaaagaaacagattgggtgtcccttttttgaattgcttcataccagaagtgttgcaggttttgagtttttctggattttggagtatttgcattatatactggttcaacatccttaatccaaaaatctgaaattctgagcatttcctttgaacatcatgttggtgctcaaaaagtttttggatcttggagcattttggattttcagacttgggatgctcatcatgtataggaaaaaccttgtgttttggaggactctgccttcttcaccttagttttacttgctagtaacttttatagatcttaatagcatgcctttatctatctatctctggctttattttccttcagtctgtaatttttaatggcaaccaaacagttttgaaaaaagccatatcattctgtttctataaataggtgtgtgtacacacacacacacactaaattgtagatatgatggttcattatccccaaacattttagtatatttctaaaatcaagaacatattacaattatcaaaatcatgaaattaaccttgatccagtgttatctagttatagaactgattctaattttaccggttgtttcactaatgtcccttataacaaaaggaaaacaaaataccttcttcccccttatccaggatccaatcaaggattgcatgtttcatttacttattgtgttgcttcagtctgttacatactcaatgttttttgtctttcatgaatgaatgtgacatttttgaagagtacagccatttattttgtagcatatccttcagcttgggtttgtttaatatttctgcttgagtaggttcagattatgtacttttggcagtgatgccacagaattgatattgtatcatttttagtgcattgtatcagtagacacatgatagaatttgtcctgtgtgtgaattttgagcttttggttgaagttgtgtctgccaggttttttcactataaagttattatgttttcctttatatttaataagaatctaatgaggagacactttcagactatcctgtttctcttttaagtttcagtcactagtttttagcatccattgtgattcttccctaaaacagttattactgtggtagttgctaaatggagttttgcaatttctgtcattccttctatgtttttaagacttgttttactataagcaagagttttcccttctcccacattcatttattcttttagtaatatctatatgaactcctgatttctcattttgtggtctatatctttaatatcactgtaatatcataatatcagtaataccactcatcattaattttaatcccacatttttttttttttcagatttgaccagtgggagttattcaaatggctcttaggtttttttttttgatgcagccacatctttttttttgcctacttctgtacttcccggcacagcaaggtgtttcaggctgatcttgtactttctcttttctggccctggaatcagccctttttttctccttttctttcttcaagacacccttgtcttattcctgttagtggagaacgttactaagaaaccaagctttgtgctcattgctgttggggtatcactgagtctaggccttctcagtgattagagctaggggtgtgtgtgtgtttatacatctatatctaattctctacataaattaaaaccatgaatttttacagacgtctccagttatagaaggttcactctagttttctgcccttccatattgtaatgcccttctctgacagtgagaaacctggctcctattatctataatatgtttatgtttttgcttaatcctggaatatgtatatgatagtttcagaattgttaatccacaccactgtgaaaaatagacccaaaactagaattcaatatttgcttatattttatcttcagcctgaaggcttataagattcaaaatactatgctcacaagttgcttgtgttagtccctttcctcaccttagtgtgcttatgtttgaaaaaagtacaattagtttaatttgtttttgttgtactttgttttgccccaacctccccttcttttaaggtgttattttttagtatgtaaaacactaacatttagattcttaaagtcagaactgtataaaacatgtgctcattgctatttcccttccatttattctgctctgttccctccctgtctcttccacagtgttcccaacccctttcctctgagacagccaatctcaattgtttctggtttgtaagataccacctgaatttagtacagatattatttttgtatatgtacatttaaggttaaatgacacagaagttgttatttgaatttactatgaagatgatcatactatgtctttctttagccaaaacctattgatgtacaagtcattacacaccacatgcagcgatatgcagtttggtttggaggatcaatgctggcttccacggtgagtgtgatgaagcttacttttattttattttatcattattattttatttatttttgaggtggactttcgctcttgtcacccaggctggagtgcaatggcatgatcttggctcactgcaacctccacctcctgggttaaagtgattctcctgcctcagcctcccaagtagctgggactacaggcatgcgtcaccacacctggctaattttgcatttttagcagagactgggtttcatcatgttggctaggttactcttgaactcctgaccttgggatctgcccaccttggcctcccaaagcaaagtgttgggtttacaggtgtgagccactgctcctggcctttattattattattattttttattgagatgaggtcttactatgttgggccaggctggtctcaaactcttgggctcaagtgatccttccacctcagcctcccaaagagcgctgagtttacaggtgtgagctgctgcgcctggctgaagcttatgtttaaatttatatatatatatttaagatagaagagtccatcaatacttggagaagaacaaagcaaattcctttaaattgtatctcaaaataataggaaactttgtatatatgtgtttgtagtattttaaaaattggaagtaatttaaatttaattggaagtcatttgaatttaattttttttttttttttagcttgctagacattattttagagtgaccattttatactatgttttaaagtttatctgtagggaaagttctgttaaaactggtaatttagtcatcagaaggtccttgtttgttctgtttaagtatttaaaaacattaaggtaaaagttaagcttcattgcatagaaagtatgatgttttacactgaataaagggaattattctaagaatcctgtccccaaattaaaatgtctttaaagccccctaaaaaggtgttctagtgttctaataccattaacctaggaagtattggtgctttgttctggtagtgcatgcaatattaaaatgaaggagcttttatctgaattattgaataactgtacaactttggatttaaaaccatttccaacataagaggtgaaagttatttttttcctcaattttagtcttcttcaattgggccatataacctagttgagtttgtgactttgccttgagaaatgaggtaacacagcatggaacagtctatcttttccagaccttgaatgaggaaggcaaatgatctagacatttcttagaactagacgaaaaatagtcatagcatgactaggagtagttttatctgtagttaggcgaatgccgcttctttacattattggtgcaatgaaagtatgggaaagtctcaacagaacagactggacatttgagaaccttccatttttcaaaatttcagaatcctcgcagcaggtgtgtgagacaaggattggggacaggagttaattgctcttttggagttccgataaagatttatagctgattttaagtcatggctgctagaatttctaagctttcatgccatgaatggactaataataaacattttagacttaacatctattttaaagcatcactcttaaagtttatttcaatataccttcaagatggtagatttttgacccttataaaaatacatattttttgttttcagcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctggatggctggttttgaggttttaaacctgacttgaaatagtaacaccaaacatgattatacaggaatattttaataagtgtatcaccatgcagatgtagaagagagcgaaagtgattgtgtttttctttagattgaatatttgaatcttatgtgtaacaaaaagaagtgggttttagttctttctgtgccctgatattttgtatattaatgaattatccaagattcgatgggatttatcagtgtgtagatagctctataatgcttgaattgtacacttctaagtgtgcagtgcaagagcttgtttatatttcatactttttatactttgaggaaaaaaagtcaaagaaaaattgtatttgagggaaaaaaccatgaccaagtaaaggataaattcaaaaaatagcctcatgagacttggcatacacactcgtgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaaggcacaaatttctttttaatacttgtttcagcctctttaatctctttataagttaactaataaatctattttcttcagacttctgcaatagttctttaaaatcacaacagttagcaagctgacttttgtaatgtgctcaatacaaatacttgtgaacttttaatatgttgagtgctttcattttgataactggatctccatttgatattttcatttgtataactcatttgcagtctgaaaattttttttagtgccagtccctgaacatatcattgaaagttaattttctttgcattttaaaatatctggattatgaagaaaaagtgatgaaaataaattaaaactgaattaccttttctaatgttttttttttttaagtaatgtaattctattttgtttttatgtatgtgatatctgtttctgttgagatttgggagttattgaaatctctgtaatgtgtatggtagaaaatttcttgtgaccttaaaattttaccagttatttatagaaagagaaaatgggaaatgttttataggctttttactagcagtatcagtgaacacttgaactccattattcatgaaaataacacgttaggattggaatacgtctattcaaaagtgaaagaatataaagtgtttagttttttgtttttactctaaagatagaattggggagtaaacttcagtttttgtttagagtggatctgaatatttaaaatcctataataatttttgtgaatcttcattctttgagtatgggattgtaaaagacaaactatatcctacagtagtatcatcatcagtatcaaaggtctcctttttttacttggaaaagtaattcacaaacattataaaaatactattcaaacagtaccaaagagtagattagcaaaagtaagtttttttccctagcctgtctcatttttccatcattacacagactacttggaatgtcttagatgtccttgtattgtaattttctgtgtaggtagaaataaatgtagctttcttattttacacaaataggaacttactgtatatactgttctgcactttgcttttattaaagatcttttgataaagaactatattgataagcagtaaagatgtcatgctcctggcccaataaaatattgttagcattgtcataaatatgtcttttccaccggcgatggttgggtagttaagtgaataagctagaaagacatgtttataaagctatttgatgacaatctcaggcatatttatacagagatgttcttaactgtttgctacaaaaacatgaagatcaaaaactttcttgaagcttacgcttaacttatttggggaaacaaaactccagcccttcttgtgtatgttctgatatccctttgctctacttttagaggagtgaaccctaataggatggtagcagcattcttgtttctttatatctctcctctgtgattgtataccgttttttcaacttaaagcaacttcagctggaaatatgtagaggttggccaaggtgaactaaatagtctgtaacattgattagatatcaagcaacgtgagcatggtagcaaaagcactaactgaagccagtgatttaatttttaattctgattctgataattgatgatatagctcctcgaactttgttttttgttaaaacttggaaaatatatttgtattattttggacaaattatttgaactctctggaccttgattcaatttatatataaggtaaaggcattatactggattatcctgcaatttctttgagttgttagaatataatgtagcttattaatagcaatattagcagtgtagtagattctgactgcaaaacctagccttttctattgattcattagtggtagtaaaggtattatctgatttatcctttttaataggcagtgctttgatcaagtgggaaatagtaatggacaaataaaatcaatgatcattatctaacttgatgcctgcttttcaaaaagtgagcaaatttcacatcttcacccttagacattaattcatggcacctactataagtactcatcctcttcttacctatcttcttttctataggagataaagtggttattcagaccccccaatacaattttttggtttgttttcacagctacttaaaagattaaaataactattcttgcagatatttctaggaatatttttagaaataatatgaaatacagggataataggccaattatgatctttatttttaatttctacagaaaagtactagagaatatatctatagaaacttctttcagataaccctaaagatgatactagaatgtttataaaattattgagaagattatttgtgttataaagcttatttgtaccatagtaaaggatgtttttgttcctcttcattctgggctaatctgtcaatactgaagtccagtcttttcccccttttcttaccagctcaaccttgattcctgtgacccattctttctgatctttcgtagttcatagtcaccaggcatgagtaccttggatagccctctgaagtctgttaccacccagatttccaactcgggttaattggtactaattctattagctggtataaataatccaaaatctgtgcagactctgggagcaaaatgttctactcagtttggaatactgtgccttaaaatatatttcattgtaacagcaccttgtatatatagttggccaaggacagagttgttacaagttacgtggaactttcatagcaaatcttgacagtaaataccttgttcttgtattaggtctatatcctgaattgacctttagcaagaatctttagatctgctggagggctgggatggcttttggacttcagtgaaaaagaatttctgctactcattgttgataacgcttcagtactgtataaatgtttatccttttccacgtaatttgttttctatgatatgagaacttttattataatttgcctcagtcttgatagaatcttaacaaaaataaaatctgtggtcgtctgaggtattctccatgctataacccagtttagctgatgcatttggagcttgggtgctgaaattaaatataacctatttgagttaaggatttattactagtgctccagtggtcacaggaacaataaaaaaggaacaacgatagaaatacgtgatctaggaaagaaggcaactgaaaaacctgaaagaaaaaaaatgaaagattaaaagtatacgatattctattttgatttagcaattacttgttttctagtgttctgtcaatttttggtgacttttataattacattaaaactaagatgctgaattaaaataaagtttctcttttattcaagcaccaacattcacttatattacctatatattgcatcaagttttgagccttcaatcccagaagcattgattgactgtctactgtggttcaagtactgtgcataaagatgaataaatattctgtccttggcttagtctaatagtaaaggcactcttagaggagggacaaatattttgcctagataagatttgagagatagtaagtgcggaatttctcttcataaaaatggtagtgttagttgtttagagggagaagtccagctatgtaaggtgaaagtggggcttataaaagtggatctattgtttaaaaattagtactttgctcctaaaatttttacctaagtgttacatccaacaacagatgaaagtaattcgacagtagcatctgctttattcatttcatatttccagtgcctgacatattgcttggcatatagtagtttagtggatgtgtttgatgaatgaatgagtaaaaattatttttcatgttaaaataaaactttgaattacatgagtatacaacttttgttccttcaaaatacccatatttgtcaaatatgaccgaattacgactttttttctgttccactagtttctaccttagaagtgacattctgcgtaaggtagtgggggattactaagtgatcatgacttttctgaagcaggtcttaaataattatctaagccttcagtcatttcaaaatctctgtagtgtaaatgatcacaggctctaaatcagattgttgtacaaggtaattgacatgtcctgaaatgtaacattcaacattaacagtagaaacaggcctcatttctccctctggcttttattgatcaattttgatattgtccagatcccatgttaaaccacttgatttagagatgacttaattctaaacttcctccatttttaattaataagattcaaggttgcagtaaattgttaatcttatttggaattatattagaaagtcgatatcggaattggaaccacacatctttttcttattgtgggtacatgggatctttcccaaataaattcctgagcaacaagaaaatctgagacttgttttaaatgctaaaatgattagttggaataatgtatacattcatgagatgactaaagcactagtggggtagtttctactgcagtagactgatttttcttagcccaaaccttgaaagatgaatgttttagtagatggagagtaggtggggatgatattttagatatggcagaagcaacttgagttacagcaattggggaggggattagaatattgtgattaggagaagtgaggagaagagtgggagagaagactgaaggatatctgacaccttcaaacacaccctcaaacacaaacattggctaaaaaagttgatgcagttcagggtgaaatcacacacatgattgacataaataacattgtggaaaagtgactttgcaaagaccacacaggtagttgcagaatagaacttactggttataatttttttgatattttactgaatagcatatggtttattaaatttttttcaaaattaatttggcaacatttcttagcttctctgactcattctattgggaaagctgatagcaagattcctgtgctagactactagagggaggtatcagatgaccaagtcatgtctgatactatagttaccagatagttaccaggctaatgtgctgaactaaggaaggagcctaaaactcagcagtctttttgagattggattggactttatgaataggcaatgagctcttaaaaacgacattccatatacagaaaaactatggggatttcagactgcctaatttagcttctccacggggcatacttgaggtcgttcacattttggctatgtatctccacattggtgctaagtttgtgtacctcgtttctgatttcactaatgctgaaagttcaacttgccagtgacctaagtggatcttttatgaattagaaagtacctcacttggcttttgaagactggtaaaacatttttaggctacaaataaaagggaagtttgtaatgatgttataaaatacaatgcttggcatgtggcagatgcttaaacatttgttgaataaagttatcttccttttaagatggtccattgaaaaaatggagcagccgttatatgtctatatatgttttaatgacctcaagctcagagatctgctagtgatctcacctttagataacatctgagttgaatgtctgtggagtcccctgccactggtatatctcaaaagaaatagcattatttggtctgggcagtactgtctttgtctatttatctatcttcacctctataaagtgggaggttgcaactctgtgggcagtattcctcagggcactagaacaatgaatgaaatggtgttacgtattttcccctcaaggagaaatgacttcttaaaccccaagtggaagatttttcattccgtcattagtattctagtattctttttgaaattgaagtagcaacatgcctttgacctgtttcacaaagttgacaaacgactttttgagacatttagccaagagatggaaggagtggcagatgtggcttctgagcttactccttccgtccacccactagatgtctctcttttctgcccttatctgtaagtgaatatatttaaataaggcttgctattaaaatcaaattgaatctggactatggaaataatgcatttcattttcttatttaaagcatgccattttcagtaatatacccatgacttgagtaaaaccaaagatgttctttagggtatgacagtaatttgcagtgggatttatttatcagcagtattgatttggaacattctatatgctaagcactcttcaagatgctgggggtagtggtgaatgaaatacgtgatttttgcattctggaactttaaaagtatattcaagctacagcaaagtaacgttaaaatttcaaaatcagaaataagattgtttacattcttgcattaatgaaatccaggagaggtaaaggattgagtaacattctaagatttatttttttttgcccttgaaattctctttttacagtacttgctagtgttctctacatttttttaaggttagactttgtacagtttctccagttgaaaagatgcgaagttaattgcataattactgaaacgtaagacatgttcatcccttaatattacattacacatacatgataactggctttaattcatcgtgcagatttgaggcactcataaactggccctacatttgtccattgaaaatatatgtactataaatgaaggtttcttccctggaagagaaagttcagaaactgtttccatatttgcaacatgtgatctagaactacataagtggtacgtttttcatgtttcaatctgaatcctaagtgatggcatggattggtttaaccagttgctctgtattattttagcatagaactgaccattggcatcccgctcccaagataattttcctaaggtgagctttaccatggaagaagattgtgattttgattttatatcccaaaatatatttactcaaagtatgctttcctctgtatcctaataatttaagttggctattttccacagaaaatttcaataacttaaaaatgctcaaagttataaaattaccttaagaacgaactcaaaatgtatggtgttctgaggtccaggcgttatgtgctcggggtcccttacatccttggctagatcattaccctttccaaagtagctggcctccttgggcttattataaacttacaaatgagcaactatagaaggaagtaaagttccttaagaaagtggatgcgggccattttagcttaagtagtaagcaaacgagctgaagctacacttatcaagaaagcaaacagctttcttccatgtgctgccaaattcttttagagtatccttataaaacctgcaaaatggactcaaaatttatagcttaaagctaacacttataaagaagatccgcatcccaggttgtgagttttggggatagcacttcagaatgagataaaagctgcttgaggttagatacatatgaaggcttgtaaatattttgaaaaatggaattaatatgtgttctggcagcacaaaagtcttttaggtagccttgagttattttagagtgagggagctttcccttcacatctcattgtgccaagtaggactcctgctctaagatgtcttacacacctggctctaagcagcagctgtagtaatgcatatgtgatgtcgctgctgacctcaagagggggctccacacattgagtaaaaacaaagcaatcttacatggagaggccttcctgacacttgtcatcactgctgcctttgaatgtgtaccttagtgtcatctctgagataagggccagttctaatacatgtggctgatcaacaggacatggttgaatacttggtaaggacttctctttaggaatggttttcatgtattaatctagttttaattaatctaaacattgatgaacttgattatattttggtgcagagctgaactgctttatcagatgggaagttttgtctcatgttcactaaatccaagtaagtttaccctagaattattaaaaacagagagaagttctagtttcatgtctttcacgcttctgaacaacaactttttgtgctatctgttctctgatttacacccaccagactaatttacaaacaactccttgcagtgtattaacgtttcatgatgagatgaagtggaaagtgttctatgacacaaaagccctttactcaaggggtaccgcagggttgagaaaagctttccactccaaatggtgtcattatgttctctataatgggtgcgattgtttaataatgacatatttgagctgagatgattgaacatacattatttgagtaataaaaactcaataggctatgcctttttaagcagttaatgtatgcctagggtaagataagacagaaaaggctcgttgtcatcctccataaaaagagcaaaatcttaaaggtgcaggtttgaaagtatatttctgtaaacgggatttacacagaaggctatcctgtgtgcatagctgtttcctttgaaaagttccctttgtaggagcaactttgttgaatagattcctattgaaatcctattaaaataatggttttttccagctgaggaggattggcttgccttcagttttgcaagtgggaagctcttctaattttaggagagctccctaacctgccacttgacctaacctctttaggttgatgaacttgaaatactgctgcttcttggtaatcaggttcagtccaaaatttttttctaagtatgtaccatataagagacactgtgccagaccttggcgggaatacagtgtactttgtatttacagtctcgcatggagacagccctgaatattactaaccaaaatgcaggacagtgtgtgtttagtgttgtaacggaagtgagtaagtaaaaattaactcagactgaggaagtataaatctgtcttgtccttcatcacacacagataaagccaggagacaatatttctcccaaggacctgctacagctataacctgtcataactcccttcgagtgactatttcccttcttactcgctgagaaactttcttctctaaaatcacagactatcagaaaatctacggttgaaagttctatcagtaagaatgaaacatcccacttttacataattcactttgacagagagaagcagccttgattcccaaaggaaatgcagaacttcagataaggacttcttggacacacattccacatctatcttaactatagtttccatggatacaggatcctaggcccacttgcacacctgatccctttagacacagccctgctttgttctgagcctatggaaatgctgattcatttgaattttaccctacccttaaatcttaatttctgtggttcctctgtgtatagtttccttcatgataatgggtcatctttgtcagactataggtttgttaacagtatttgatactgcagacatgagaccacgaaaactgtattgatttttttatttcagtaattctcaatttagcattatatatgtgtgtgtatttacataatatgtaacatatatccctttatcctgttttttccacttttaatggttttgcctttttttttccttttttttttctttttttcttttttttgagacagagtcttgctctatcacccaggcttgagtgcagtggcttgatctcaccccattgcaacctctgcctcctgggttcaagtgattcttgtgcctcagtctcctgagtagctggaattacaggcatgcaccaccacacccagctaatttttgtactttagagacggggtttcaacatattggccaggcttgtctcgaactcctgaccttaagggatctgcccaactctgcctcccaaagtgcagggattacaagcgtgagccaccgtgcccagccagttccacctgatttttaaaattgcgttggccagcattggacacacagtaaatgtttaataaatactttccacgttgaatcaaagaagtttcctatcttagctatttccttgaaactttcctgaagtttgaaacctaacagatcatcagtgacgtcctcatcacagtttcacctctgcctaataaagcacaaattactcttaagcagtgaggcgctgtgcagttgaagccttttataactccatttgtctgcagtcacctaaatgtcagtggacagatgtgtttgtcatagtgtgtgataagtgcaaataacccttgttagtagtgtcattagagatgaaatagatgcataggaactaagaggtcataagctgtcaggttttactctaaggaaatatagaatgtcatttgcacctgaaaatgtgcagaagtaaatggacaattcttcaccccaatctgtttttcaaagctttgcatgtttacatttgttcatccactaccttagtcacagcatagtgaaataaaccataaattaaaaatagctcagcgtacca

SEQ ID NO: 185 - DNA, 3362 bp, Mus musculus
ggttgtgggctctcacattgccataccctcctcatggcccccttcactcataacagtacctgcctagacctcgaagcactagtttccaaccctgcttgagttaactacttccatgacaactgtgcaaggccagagtgtgggcagctaccttgagggccaccggcatgggctgcattctaaagtcctgtaacaacgcacaagtacaactgaatagaactcggaacaaaggcatcagggccacggtgcaagtctttgttcatccgttccccgactgctcaccctgtctgataccgctcttttccacccagaaaagcagccactcaagttttaagaatggatgtatgccgcggacgttttcgattaggccgttttctctcaggcactggaggatattcgtggctgcaggaggcgcttccaccctttcctcaacctagcaaagaagtaactgaaactaacccaagggttacaaccgaaaagccccttccagcttcagaagcagaactggaagctcggatagacttctccgcctctacactcctggaaaacccgcagtggatttcaccaacttcaggatcggagcccaggcaggcgaacgtaccttattgcgcatgctcgctagcccctcccgctcggagcggaagggggagcgctgggggcctgggcctggcctggccggggcgtcggcaccggcggccatcttggcttcccggggaaaggcggcgtgaggggaagaagttgtagggtggggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtatacaaaactaggatatgctggaaatacagaaccacagtttatcatcccttcctgtattgctattaaggagtcagcaaaagtgggtgatcaagctcaaaggagggtgatgaaaggtgttgatgacctagacttcttcattggtgatgaagcaatagaaaaacctacatatgcaacaaagtggccaatccgccatggtatagttgaagattgggacttaatggaaaggtttatggagcaagtgatctttaaatatttaagggcagaacctgaagaccattattttcttttgactgaacctccattgaatactccagaaaacagggaatatactgctgaaataatgtttgagtccttcaatgttccaggcttgtacattgctgtgcaggctgttcttgccttagctgcatcttggacctcaagacaagtaggagaacggacgttgaccggtacggtaatagacagtggagatggtgtcactcatgtcattcctgtggctgaagggtatgtgattggcagctgtattaaacacattccaatcgcaggacgagatataacatattttattcagcaactgctgagagaccgagaagtaggaatccctccagaacaatccttggaaactgctaaggcagtaaaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagagtttgctaatccagactttacacaacctatctcagaagttgtagatgaagtaattcagaattgtcctattgatgtcagacgtcctctctacaagaatattgtcctctctggaggttcaaccatgttcagggactttggacgtcgcttgcaaagagatttgaaaagaactgtagatgcccggctgaaattaagtgaggaattgagtggtggtagattgaagccaaaacctattgatgtacaagtcattacacaccacatgcagcgatatgcagtttggtttggaggatcaatgctggcttccacgcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctggatggctggttttgaggttttaaacctgacttgaaatagtaacaccaaacatgattatacaggaatattttaataagtgtatcaccatgcagatgtagaagagagcgaaagtgattgtgtttttctttagattgaatatttgaatcttatgtgtaacaaaaagaagtgggttttagttctttctgtgccctgatattttgtatattaatgaattatccaagattcgatgggatttatcagtgtgtagatagctctataatgcttgaattgtacacttctaagtgtgcagtgcaagagcttgtttatatttcatactttttatactttgaggaaaaaaagtcaaagaaaaattgtatttgagggaaaaaaccatgaccaagtaaaggataaattcaaaaaatagcctcatgagacttggcatacacactcgtgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaaggcacaaatttctttttaatacttgtttcagcctctttaatctctttataagttaactaataaatctattttcttcagacttctgcaatagttctttaaaatcacaacagttagcaagctgacttttgtaatgtgctcaatacaaatacttgtgaacttttaatatgttgagtgctttcattttgataactggatctccatttgatattttcatttgtataactcatttgcagtctgaaaattttttttagtgccagtccctgaacatatcattgaaagttaattttctttgcattttaaaatatctggattatgaagaaaaagtgatgaaaataaattaaaactgaattaccttttctaa

SEQ ID NO: 186 - protein, 445 aa, Mus musculus
PLSPAANLWPLAARSRRRQQQQQARRKMAGRLPACVVDCGTGYTKLGYAGNTEPQFIIPSCIAIKESAKVGDQAQRRVMKGVDDLDFFIGDEAIEKPTYATKWPIRHGIVEDWDLMERFMEQVIFKYLRAEPEDHYFLLTEPPLNTPENREYTAEIMFESFNVPGLYIAVQAVLALAASWTSRQVGERTLTGTVIDSGDGVTHVIPVAEGYVIGSCIKHIPIAGRDITYFIQQLLRDREVGIPPEQSLETAKAVKERYSYVCPDLVKEFNKYDTDGSKWIKQYTGINAISKKEFSIDVGYERFLGPEIFFHPEFANPDFTQPISEVVDEVIQNCPIDVRRPLYKNIVLSGGSTMFRDFGRRLQRDLKRTVDARLKLSEELSGGRLKPKPIDVQVITHHMQRYAVWFGGSMLASTPEFYQVCHTKKDYEEIGPSICRHNPVFGVMS

SEQ ID NO: 187 - DNA, 47601 bp, Mus musculus
  misc_feature (1)...(47601): n = A,T,C or G
acctctctagcccctcagatcatcttcaagttctggagatccttctccaaacgaaacagctcagggaggcccctcccttttttctttccttcctattagtgatttttagagtctacaaattatgggaatgctttcctgtggttctttcctgtggcttctcattagtgcttgtatttctcgtgatttcagcctagagatgctggacaaagttgaacccccaactatcccagaaggctatgccatgtccgtggccttccactgtctgttggatcttgtccgtggaatcaccaccatgatagaaggagagttgggagaggtagaagcagagggtcccagtgtcacagagggagcctcttcacagtcgtcagaacggcgagacgagcaggcggcatccgacccgatggaccaggaaacaggtgtgctgtggctccctgcttgtcactgctgctactcttcagtcctttgaactttggggagaattgagggagtgtccctgatactgacacatcaccatgctgctcttacttcctcttgcttttgtacacacgtcgtcgctgtatttttttctgagctacttgagatgaagtctagacgtgctgtctcactgcagctgtctcactgcagctgtctcactgcagctgtctcactgcagctgtctcactgcagctgtcttactgcccctcgctcagtacctgcacctggttttctaaaagcagccatagtctccccgattctgatgcagtcatcagaagttaggatcaatctaggatttaatattaacctaggtcttattcgtatttaccatttgtcccagtgtttctccttgtggtccttgtttttgaatatactgctgtgtgaggatattttcctacaatgtggagcacagttcttcagctcttgttctatatgaccttgaccttgttagaaggatgtatcccgaggtagtttattcactctaagattaacacaggttattcctatgtttaactggctactagtttgatgtatcagtatgtgaggaagcaaaaatgccaggttttggagatgttcacttttgaatatacttggatttttattgaagtatacgcactggctgtgcttttttagtgtggtgctcttttcaggcccgatagtgttcttttgacatgtctcgtgtccctccgtccccttacaactcaacacaagatgctctcagtgagctcatgtttccagtccagtccaggtgttgatgagttttccaggaagcccaggtagatagagccgagactgacaaggacacctgtcacgtgtctggatttgaaatgtctgcttccttgtactaaaggccacgaagtcaccccaggttctctgcttgtagatcatttctgcaaggtcagttctaactttacagatttgtaaatctcatctccactgtgaggtgcccagtgcgatttgattcagtgtatttacttacgcttcattctcaacatatataatggtgttctagctgagcaaacctttagactctagtccacattaatttctacttgatcacacaggtagacagtttggctactgaaggaaatggaactggcattatgtacctttaaaaagatatttcttaactgcatagtggactatcatgttttaactctcatgttttaaaacaacttcaagacttttttttttttttattatggaactatcacagcttctgcattttcattatctgggtattgtacatattagtgtgtgatacctaataactgagttattgactcatagactgccagcttgctgtaatggtgtcacctggttaactgttatttttttagcagtgagcagagctgtttgggaagagatggtgagcgcttgctggtgtggccttctcgctgcgctctcgctcctcctcgacgccaggtactacgtctgagtctgtaagctttacattgtgtcattgcagttaaagccgacgctacagtaacttccccgtgtcccaggcatttatttcctatgcccagttttctgtgtgagtagaactttgacgttctttttcaattccatgtgcagtatgataacttgtgtgcacactgtcgtgagaagctggggtgattagcattgccgtctcctgctttctgtaagaacatcgtgtctctccccacacccacccccgagcctgagtttgctccgcactcccaccagagtagtcatgatgctttcatcagagatacagctttcaaactatggagcgctgtgtcatgtcaaggcttgccactgcctagcactgatgatcatttgcttgctatttctccccagaattagctgactttaagatgcttgatgccaggtgtggttcctgcctctaacccagcacttgggaggttggtgaagatggattggaatgagtttgaggccagcctgaataaacaccctgtctcgggaaacacagagaatgcttgatatttttagtttaatctttattccatccatgaattgtattacatgttataggtcaggctttagatatttgattacttgattaaacttcccatcctaagtgcattgggtctagcttttcttgaaacctccctgagtgcatacgctgaatcttgttgtaaagcgtaactgaagtaagcggaaagctaaacagagcgcttgtcttccagcacagatgaggctgccaccgagaacattttgaaggctgaactgaccatggctgctctctgtggaagactgggccttgtgacctcgagagacgcctttataactgcaatatgcaaaggctccttgccgccacactatgctctgactgtgctgaacgccaccactgcggcgacactctccaataaatgtaagcactaagctgcacagcttcctccatctgctgggccagcagagaagggggtgggaactccacgttcaggctcctcccatcccgggcatggacggtgctccctccggcaggtgtgctcccgcctttccattttgtcctcttcaacacagtgcttttatctcctgaaagggaagagagaagatgagacttagggtcattggactctttgtttctctttcccatgtggccacatagaatatatctcttttcttctgctcatcccttaaaaaaaaatgtggagagattaaattgtaattgcaatgttaagtaatacttatatgttataaagatatgtgctataactatggccttccttgtaactatagtatgttgttggggtgatgactcctggttttctgtctggcctaatacaactgcaatatttccaccacttacattatactaatggtaaaaaactaattatcttggctaatactttgagaacgctaagatttattacatttaatttatatatatttcaatgtgatacccagatttcacactcaaaatttatttgcctataactagaaaagaaaacattgattcatgtttaaaatacttaatgtgttctagttctgttttgctcataaaacgggctactagcattttataattataacttacatggaaaattatttcacgtttgcttctgttattttttgcacctaggtgtcagatgtttacatacatctgaatggcagtactgctgttgaattggaagggttgaactgaactttattctgattcatcttttacaatataatagtaccttgacagaaatgtgagctctattctgcactgaggctttctgttgtgttctagcatattctatccagggccaaagtgttatgatgatcagcccgtccagcgagtctcaccagcaagttgtggccgtgggtcagcctcttgcagtgcagcctcaaggaacagtgatggtaatttgactagggtcggggttgttgtggttaccagttagtggtcagggcctctgttgtgctccagttttgtactttccaaatggtattactttctgagtttccttttcctgaacatagtaattatttattttcttgacatgattatagccagtatattaacttaactttctttgtgcatgcatgtgtgtatgcccattgctatgtatgtaagcacatgtgtagcagcaagtgtgcgtatatgtttgtgtgtagagaccagaggtcgtcgtctgccgtcttcctctatctgctgatgcacggtttctaactcactgaatctagagccccctgctagtctaggtggcccatctccatctccagatgctgggcttatagatgaatcaccgtgctctcccagcattaacatggattatggggatctgaacttcaaccctcacacctatgtggctttggcatccagctggtgggtaaactgaggcaggcagttgttgggggtcagtgcttagagccgctgatggcagtggatccagatacctacaggggctgatcccaatggcagcctgcaagtagagaagttattcagcagacctttctctgaaggaacagtagaacagtgggtgaaacaaaaggcaaagtccaataacttcatacactcaaatatttacatacacacatgcagacagacagacagacagacagacagatatattcacattcacacattgaatggttagaggaaagctccagcaagcagtacatatatacacccagttggtggatggagcaagctgcagcacacacccagacaagctttcgatatatgcacacatacacataggcgatgaatggagggaacagtgttccagctctccacactggtctttcttccatagcttgtacatcccagcaagatctttgaagcagtatagaatcacagtgcgttaccttttggttttcttctgataaatgattatgaaaacacagtgtgtcccctgcatctttacaagaaataacgttaagtagtacaggtaaagaaaacaaattatttccccaaacccacgtatattcatagctaagcaacttgttatagactaacaaagtgtaagtaagcaagggagttttctcagccagtttctcttactggcaggcagcaatttgcagttacaaagaaaggagtaattattttattatttatctttaaaagtagtcttgtaaaattcttgagtcacagatctaaaccttcatataaaaatcagtcatatctaccttaaatactcagaatgcatatttattcatcagcttatcttactaaatcatatcaggaagctgagggcaaacatgggtacaagaaatcaatcatcgccagtccagcctcagtgagagtcaggtcaccagtgctgccgttgtctcgtcccctgactataaaaggttaaataataagagtgtgcctttctgaacttgatatggttccctaagattttctacatcagagccagtaagtagcaaaaacatttcaacctagcttcactaacaactgtatttttccaaatgtcttctaaaggcagtagtcattgctgacaatctaagtatctaagttcttctctagggtggtgattgaaccattaactgccccagcagcagtgcctgagagaaagcaagcattagtactgtgagtgccagagtcacagcccagtgaggggctggagggccctttcaagttttcatacaattcttagattaagagggatgtgaaggcagcaagcagagcagaaccccataacagcatgaagtcctcaggacactggtcctcgggccgtgccacaccgaggctcatctctgtggctatggtaccaggtgggctgcatttcatgagttctaaagccatttgtcgttcctcctgcctgacccttggcaatgtggcaaacagtttcctcagcaaactgtcactccagccatagtaacacaactttgtgttttgtaaaaccacccaaacttcttttcctagtattcttgcttttcatttaagacagtctttgaatgcattcgtgctgatctgtgagctgttaatttttaagaatctatagaagttgctacaatctgtttcttttcgacatagctgacttccaaaaatattcagtgcatgaggactctgctgaacttggcccactgtcacggcgctgttcttggaacatcatggcaacttgttctggcaactcttcaggtatgctgcagtactggattctaggtgtatgactgctaacagttaaacaatgcctgctgcagtactggattctaggtgtatgactgctaacagttaaacaatgcctgctgcagtactggattctaggtgtatgactgctaacagttaaacaatgcctgctggccctttaggaaggcctaagagatagtatgaggcagagacatggcaagaagtaagcaagtgttagcaatgcgtcaggaagtaatggactgcttacagtgccataaactctactgctcatgctataattatttcatatgaatggtgctaattactttgctcctaattattaggatattactgtgtttagttttcattgtgagctattaccattgattttagttattagaatttttaaggttttatcttgttttaattttagcatcttgtgtggattctgggactaaagcctagtagtggtggtgccttgaagcctggcagagcagtagaagggcccagcacagtaagtggcagcccctgtagttggtgggggcttcctgaaatgtcacgcacactccacactgacgtcccccttcttctaggttctgacaacagcggtgatgacggacttgccagtgatctccaacatcctttctagactgtttgaaagctcacagtaagtccctgttgtaaactgacagctacactgttttgagctgtatatttgagatgaaattgtctttttcattttcattttaggtatcttgatgacgtatctttgcatcatttaataaatgcactttgttccttatctctagaagcaatggatatggcctatggaaataataaggtgtggtaatctacatttctttttagttatacaaggtatataagtcaccctagtgtttgatggtagggctggggctttggttgcagtggcctgtaggtaggtgtttagcgcttgtagcaggagtaaagacggcacggtgtagctgctgatttgtccatgtgtgtagtaggtttaaagttatgtcccttctttcttacatgcaacacggcttttatacggagctgtcacaaactatcttgacagtgcttgccaggaccacttacgatgcaggaaacacaagactgcagttaggacgtgggctgtagattttggtggtgggtttgccctcattggagtggaaaatcagaaactaatcatttcttctggagataatgattctcctcaccttaaaattaaacattttcattgtctactaattgagtaaatagaacaagactctgtccttcctgctaggtaaggatagactaggacttctgcatattagcattcaagagcatttctttctgtactcagaatattttctattaaatttgtaaagcacaggaaaaattgaacttaaccatattttagaaattgctatttgaaatgaaatgtttgaggctaacagcattgagtggtaaagcacttgccaacattgtaggaggccttgggtttgattcaatcacagcaaaaatatatacagaaaaaaaaaattgttaggtgagagagcaactcacagtgctcatctgattgtcctgaggtcctagctctatataaaaatggaatggaaccctttatacctgtgtgagtatgtgtgagagtgtgtgagagtgtgtgtgtgtgtgtgtgtgtgtgtgtgtgtgtgacacgcatgcacgtgcgcacgcgccctatgcccttgcaggccaggagatgtaagatcccctggaattataggtagtataagccaccaatgtgggctctaggaactaaacttcaatcctctgcaggagcaaccagcactcttaaccaatgagccatctctctagccccctctctacatttaaaaataagcatagtctgatcacttcccaatatgaagataagccagtggcacatgcctttaattctagcactcaggaggcagaggcaggttcaaggccagcctgctctacagagtgagttacaggacagccagggatacacagagaaaccctgtcttgtcttgaaaaaacaaacaaacaaaaaagttgttaaaatatcttctctaaaaaaatcttcagcgaggtcaacctggtctacagagtgagttccaggacagtcagggctacacagagaaaccctgtctcgaaaaaccaaaaaaaaaaaaaaaaaaaaatcttcatgtatgaatctagaacatgtatatgttctttgaaatgctacagatcattatgatgtacaccctattaaatgagaaggacagagaagtgctgatcctagggagccattcctcggggagacttactttctgacacaatctaattgtatagtaatatctccattttatacattaaaatttcactagatactgtaatttatgtaagttatgtagctactcagtggtctagtcaagatgagataccaggaagtttgtaggcatcagtcttaaacttgtaccttacttatccataaatagcaattttctaccccaaccctcagggcatctataggttagaccatgccacacttgtcttgaatcccaggtgtaacttgcattaggaaaggaaaagatactgttaaacattcccatgttgcaaatgttttcttttttaaaatttttattttcaacaccataaaaacattaagaatgcagaatttttaaaaaaaacttagatttgtaggtctctaagatctgtaacttagtcgcttctctgccagtatactttggtggtaactttaggagttgatttagagtctcagaaagatttgtctcatgataatagggtctactgtatttcctgctaactttacatgtacaaaccaatcataatttaatcattgtagtgttgtattttattattagccatcacagaattctcttcaatgtatcaaagtaatatgtttcctccttaggagccatctctctttgctgttgccaaactattagaaactggtcttgttaatatgcacaggatagagattttatggagacctctgactggccatctacttgaggtgaagtgtcttgcttaaatactatcattgtttactgataaaatcatgtccactgatcttatgatccagcataatgacatgttagccgacctccttcctcacgcagtgtattttatcagaggactatagttgtgctgtgcttagcttggggaagggtgaatcttgtaaacaatgggtaagtgttttccttgtaaaatggcagtgctgtcagctgtgtgttagcatctgcttccttccatcacagtctcctgctcccctccatttcaggtagttctgaagttttgaagcaatttgggatgagagtgagttacaaataacttgttcacaagtttgctgctgtggaggtagcaggagaggagagggctgttgcgctgatactaggtcacagacagtgagtgaggatctgatggagagacacgcccagatagtgagctggcgcttaactccagcggcttgtgtgtgctcggggaccatgatcatttcatgtcaccttcgaagcctgagaacaatgctgtccttcttcctaagattttactcattttattgggattaaatttaccaacgaaggatgttactaatatatgagattgttttatgacttagccagcttaagtgcgactgagctgagcatagtgctgtgtaaactgagcttgccttatcgagggctgagcccttgggccaatgggaaagaggaacagctgacacccttagggtcagctcactgtgctcctatgacatgctctctccttcctttcctgtgacttgttctggtttcatcttgtctttgttttttctctcttgcttcccttgcctttattcagaaggtaagcgcacagaaaatatttaggtataatttttcttttactctttactgaatacatgatgtttttctgttctcgggttaatgtgtatttctcaccttatgtatgcaattgaatgaagtttgttgggtgtgtgtctctcaggtctgccagcatccaaactctcggatgcgggagtggggagcagaagctttgacgtcactcattagagcggggctgacgttcagccatgagcctccacttccacagaaccaggtaaaagtgctgtttgcaggccactgcagctgcagttctatgttaacgtcacctcgtgacactctagcattacctttctttcatgagactgtcttaatgtagcgcaggcaggccttagtttataggcaaggatgaccgtgaattcttgggcctcctgccctcccctttcaagtgctgggattttaggatgtatgctccaagccaatgtctaaaacagaatccttaaacttaatactctgttttacatgtcgggtacggatcactcggagttttatggcggtcttcataaaagagtctagatgatgctgaattaagttactgcagctctggacctccctctcactacccagggacaaagcatgtgttgcagcagcaagcacgtgaagttggggtcacactgcgtgtcttcctctaccacggctcagtttactttctgtagatcaggctggccttgaactcacagcttttgcctcccgagcacttgcttggataaaaggcgcgcaccaccaggcagggcttgcttcactcttgagacaatctctcggtgaatctggagctccccaaaggagcgggactgctccacccacaggctcagtgagcaccggggctgaggacggttgctgtgctgctgctgtgctgctgcctgccttcttatgtaggtctggactcagtgctcaggcttactcggcaaggccccagctccaataaaagagacttcatccataaatctttttgtcactttatactggcagaatttttgccattcatacgtaatttacagtggagtgtttgtttgtttttaagttcactgacgtttcagggtttcaacactgagtaaactgaagtatctgtcggccatcaccagtccccttaccatctcattgtctgctagctgtattctacacatgacttcagcacaccattgttgactgtcacctttagaacaggacaggatggttggcaggacagagagacctctgctcttgtggagcttgcttcttagtgatttccttttcctctgctatagcttaaagggcctgttttgcttgtttcttcttcttcttcttcttcttcttcttcttcttcttcttcttcttcttcttcttcttcttcttcttcttcttcttcttcttcttcttcttcttcttcgtttgtttgtttcttcttttggttagtgctagggactgaaccccaaggccttgcatgtgctaagctgttagcaccctaacactcaggacacccactgctcttgatgtttaaagacaggatctttctgtagagtcctggctggcttcagactttcagtcctcctgcctttgcctcctgagtactgaaactgtgaacatatgtcactaaacctggtagctctagttgaaggctttaaaaaaatataaagtcatcactgacaaaatggctcagtgggcaaaggtgattgtcgtcaattctgacaacctgagttcaattcccaggacttgcatgccgcaagagagagctgactcctgcgagctgttctccgacgtgcacacgtatgatatggtacatactcataaacactaagtcagtagtgataaaaagacagtcagactccttttctacttgcttcaatttcctcaatgtctgatcaatgttcattgcatggtaaacacttactaaatatgtgttcagtaaatcagccacaaagaacaaagtttggagagaagaaaattaaatagtgaagtgtttttaagatgtcaaaagaggtaacacagagtactttttgtctcagcaaattttgtggcttttgtcatttatgttaataattgctattaaagcatgtaatttcagactttatagttagatcttttgtatcatacttggtaattttacatttaaatacatgctatacattaatacagtaaatgaaagataatactagatattgggaattgttttctttaagtgtagctaaggctatatttcctttagcaaggtctatggggagaggtagccccacatttcccctgaaattgtactgaaggaaagcagaggagtggcaaaactctaaagatcactgctagagaaatcatattctgttcttttactagaaaatttctgtttactgcagtattgtgaatggaggtgaacctgaacctcacaggaacagcagagacgggtgctacactctgtagtcacagcacttgggaaactgaggcacaagatcacttgagctcaagtccaactgggcagcatagagaaggcattgcagaaagatgcggtggggggtggggtggtggtggagggggacaagggactggcagttgtaacaaggctacctgcggtgttttggacgtctttgcctaattaccttcttgttccctttttagagactacagctgcttttattgaacccattaaaagagatgtccaatattaaccatccagatattcgactcaagcaattagaatgtgtgttgcagattctgcaaagccagggagacagtcttgggcctgggtggccgttagttcttggagtcatgggagcaatcagaaatgatcaagggtaagtgtttaaaatggatacgcaacgtgtaagaggtcagaagggtgccatcctgatggcctgcagtgagaatttttatctctgccctgctgctcatgccctagctctccctgtcacagtgcttcataacctacccaggcagttctgggaactcgcaagtattgttttgcttttaaaggtatagaagatttgctgtttcgtgccatttatattagaatataagatcttattataagataaataatttaacattttataatgcatctaaggactccatatattaggaaattcttaagaaattgctttaaaatgactatttgtttcttaaacatttattctgtgcttactgtattcccagaactgagcttgtgggctcttccgagtacacaaataaatggccactcccctaaaaggggaatacagggaagaaagcactttactgtaagccaggcaaagctccagtggaaggggtggagccagagcatacggcatcctgtgtgtctaaaggctgtttgcatttactttgagtatgcttgagagggaagtgaggagtttacacgggaaagttgtagtcagatgtgcatttgacagagtccactgtgacaagggcacggagagagagcagcaagtgtgggcgtgtgacaggtgcttcctagaagtgacaggtgtttgaggtatgtaacagattgactggggacaaagggagacgtgcagtctagaatgattctcacacttagggcataggtgaatagtcaaatcccattaaataaagagggatccagaaggaagagcacagtagaatgggatgtggggttttacttaacttagggcagaacattagtgaagaaattaaacaggtcctgggtattcgtgtctgagatcacactgtcacacacactctagtgacaggggcactgcagtgttatattaaaactacagagacaattaatgatagtattagagaaattaaatgtttaagtatttgtaatagtaaatgtccttatagtccagcattctgagattattaaagtcaaaaagaccaatcaatgtgcatcaagttgaaactgatttccttaactcacaccacagagtagaacgtgtgctgtaaagtggcagggacccatgtgcatccagggctgagaaactctgcaacattgaagactcgattatttacgttacttaccatttgttccaggctacgttcagtggctatgataaacaccatggcctaaagaaacttgagttactgggcttacacgtcacagtcagagtccaccatgaagagaagccaaggcaggaactgccccagaacccgtggggacactgcttactggcctgctgtccatagactgctgagtaggctttctcctacagcccaggaccacctgtccaggggtgacacaggccatagtgcacagggtcctcccgcatcagtcacctgcaggccagtgatggagatagtccctcaattacagttctctcctgagatgactctagtctgtcaggtggactgaagaaccagccagaacaccaccaaactttttctccaagaccatctgcctcttgtgaaatttatactgtacttttctcacagaacggatctgtaattgtgcttaggtacttttaagaggtactgtgtagatattaaaaacagcagcagcagaggcacttaccctcggctactgagtaagcacacttgtgcatgtgctgggccacagaagaaagctttggtgcatgagggagaaaggggctgtgacagcctcccctctgcgctgtcacaggggtcctgggtcgttggttggtgctcagtgctaacactgatttccccatctctgcttcccaaatgtcaggattgaatctaatcttatttgttaatctcatcaaggtccctttactccttgtttatttgagaaagcatatgtaattatgtggctgttgaggtactgtgcaaccagggagggcatccctgttaaaattctaaaataaaagtttgctgggttcagattattgtaaagttttcctacccctttcttttaaattcatatttcccgtttcttttgttttcagagaatcattaataagaactgcctttcagtgtcttcagttggttgtgacagattttctacccacaatgccttgttcttgcctacagatagttgtagatgttgcaggtagctttggactgcataaccaagaacttaatattagcttaacgtcaataggcttattggtaagtactattgcctttttatgataagatccttttaaaatgatttatgcagttaacagtgaatgcttacaaatatagggtagacacttgaaatttttactgacttttaagtaccaagcatatcctccatgaattagtaaataatttcggaaacagtctgttagtagtgggacatttgaaacaattttgatattactgacctttgaagtttgagttttgctgagtttatgagagtacttcgtgaaacaataatagtaaatgcatataaagaaaatcatgggctggagagatggctcagtggttaagagcactgattattcttccagaggtcctgagttcaaaccccagcaaccacatggtggctcacaaccatctgtagtgggatctgagtcctcttctggtgtgtctgaagacagtgatggtgtactcatatacataaaataaataaatcttataaaaaatcatgattgatgtagtgtacaggttaagtgaccttaaatattactttcataacattttttcatagactatttaataacaaagctttatttactatttgtatagacccatagtctgtcaacaaaactgttagacacaggagacagcatgttgtagtggaaggctctgtgtatgttagcacttgtggattcttgaattatggacatttaaatctcatttcacatatcttgagtatggaattagtatgttagcgtattgcaagtgtttcatatgaatcagatatgaagagaactgcccccagtgtctgtagtttatctaaggaaattgtttagattctctgacctcatgttacagttgcgagagtgtgtaaagctgaacttatgtttctctcccaagttagttaagtagtttatttaggatctcctaaatgtttattgtgactcagagattccataaagttgaactttaaatttctcacacaaagtagttaacttggtatttttctatgaaaattatggccatggaagactactcagtcagaccctccctgctgacaaagagcagagcagctgactgactgtgcgctctaacagcactcagtgccttccctcacttcctgtggaggtcacagctctgtcgtcattaactcacatacttcactactgctgagaannnnnnnnnnnnnnnnnnnnnnnnnnnnnnnnnnnnnnnnnnnnnnnnatttctatacttttctttttagtggaatatatcagattattttttccaaagtaggggaaacgattgaaaaagaattaaataaagaagaggcagctcagcagaagcaggccgaggagaaaggagtgtctctgaaccggccgttccaccccgcgccaccgttcgactgcttgtggctctgcctctatgccaagctgggggagctttgtgtggacccccgccctgccgtgaggaagagcgcagggcagaccctgttctccacgatcggagcgcacgggaccctgctgcagcactccacctggcacaccgttatttggaaggtactggggacggtggggctgctcgttttccgctttcagtcacatgtgtacactttctaaacagtcattcctaggcgcttgtttattttatgtatatgagtacactgtagctgttttcagacacaccagaagagggcatcagattccattacagatggctgtgagccaccatgtggttgctgggaactgaactcaggacctctggaagagcagtcagtgctcctaaccactgagccatctcaccagcccaaacaaataaatttttaaagattgattttcattatttttactgtgtgtgtgtgtgtatatgcatgtggacgcatgagtgtgtgtgtgtgtgtgtgtgtgtgtgtgtgtgtgtgtgagagagagagagagagagagagagagagagagagatgcacacaagagcagaggtacccacagaagctagacgtttttaatctccattcactagtccattctctttctccctgagagggtcactagttccttaatgctgcaagtaaaaccaccaccacagttaccactgcttcaacttcctgcttttcctcctcctcttcctcctccgatttctctttcctctcctatactcaactgtccttctttccttctttctctttttgtgtctgtgctgggtcttgaacccaggaccttgtgcctaaactattagttcatctgtctgtgacattttctatttcgtaaacatatctactctgttcagtgctcctcccccatttgttcttattttcctttaagtgtaaaaactctccaagttgtaactaagttttgcttgttggttggttttctcaacacctcatttggtcctgaggtctggacatcccgtggtaatccgttctgcctggattcttgtctcaggtataatcgcagagatgtttccactgataacaagtcctggctgtgcgctatctgttagtttacttttctaattccgtgaacttaaggataagtttaagaatacacagttgccttttctagtcaattcctctaatttatgtggattaataaaactgttacatatttttataacttttattttctattgctatatcttaagctaactcatcaatatttttatatgatttttaaaataaatatttaggtactctttcatctactggaccgagttcgagaatcttctacaactgcagacaaagaaaagattgagtctggaggtggaaatattttaattcatcactcaagagacacggcagagaagcagtgggctgagacctgggtattgacattggctggagtagcacggatcttcaacaccaggagatacttgctgcagcctctaggtgtgcaatattgtctttctctgcttatacaactaatctgtgttaaaggaaagttggaacacacttaggaaactctttgggaattgatatattgtactagaatagtcagcagtcttaactgtaggccttacttgatgtggtgtacatgctcgtttcatcgaggggaagaacctgccctggacgcacctttcagagtccagtggtgaagagacacacacacacacggctggacttgagagaagagccgtgattatgcccttaagcccacagtgactgcatcatgtggtttccacagtgactgcatcatgtggttgctgggaatgaaggttgctcgctagggttggccttgcactccggcctaaagttttattattatatctaagtacactgtagctgtcttcagatgcaccagaagagggcgtcagatatcattaaggatggttgtgagccatcatgtggttgctggggtttgaactcaggaccttaggaagggcagtcagtgatcttaaccactgagccatctctccaacccgggatgtggtatttttaattatcatatttattatgtatgggagggcatgtgtgggcattctgcctcgcatgagtggtggaagtggaggttggcttgagggaattgggaagccacactgtgtagctgtcctgactgcacctgatgtctcactgtaggagtgtctggattgtagaggcaggctacccatcaggcattgtggttctgtggatgaggctcagttgtgagtcttgtgtggcaagtgccttctgctcagccattgtgccagcccatgggtcatagttttagtatgttagttcctaattttattcttttgacttctatgtcaatgtaagcagaagataaagcaactatgcttcaaagtatctgagaggatttgctcattgaatactaattgactccccccccttcattgatacaggagacttctcaagagcttgggatgttcttcttgaccacatccagtcagctgcactcagtaaaaacaatgaagtgtccctggccgctctgaaaagcttccaggagatattacagattgtgtcccctgtccgagactcagagaagcccgagccccctgccgttagcgtgcccgtacccgtccttctaggaaacctttccggcccaggcctgagcaggccgtttgtgaggacagactccattggagaaaagcttggcagatgcggctcggagacgcctgtggtgactgacgagctggaagatctgaagctctggtgggctgcctggaacacctggcacaggactggatctgaaagcacagagccgcccagctccgtcgatgagctgacctttatccccagccagcctttccttacagccttagttcagatcttccctgccctctaccagcacataaaagctggcttcagcatggccgacttgcagaagctgggcgtcatcctgcacagcgctgtctctgtccccatcagttctgacgcctctcctttcatccttccgtcttacacggaagcggtcctgacaagtttacaggaagctgtgcttacggccttagacgttctccagaaggtaatgtgatttcagtgctcgcctgaaagctgtaaggaatagggttctttgggtttttattttattgttttgtggtaaatttcagaagataaatttaggactttctgagattgctatgtatgtacactttgggataaatttaagattgtcaagatttttaaaacttattcttgagatagttaaaaaagtaactcaggtctgttttgagttgttaagaagctgcttgtcgggcggtggtggtgcacgcctttaatcccagcactcgggaggcagaggcagatggatttctgagttcgaggccagcctggtctacaaagtgagttccaggacagccagggctacacagagaaaccctgtctcaaaaaaccaaaaaaaaaaaaaaaaaaaaaaaaaagtaaaatgccttcatgggctggagagatggctcagcggttaagatcaccaactgctcttccaaagtcctgagttcaaatcccagcaaccacatggtggctcacaaccatctgtaatgagatctgacgcccttttctggtgcatctgaaggcagctacagtgtacttaggtaaaataataataaatagatcttaaaagaaagagagaaagaaaggaaggaaggaagaaagaaaagaaagagaaagaaagaaagaaagaaagaaagaaagaaagaaagaaagaaagaaagaaagaaaggaaggaaggaaggaaaaagaaagaaagaaagaaagaaaggaaggaaggaaggaaggaaggaaggaagaaaagaagctgcttgtggccgctacctcgctacctctagtcaaagttaattctgaactgtgggtagcctatgccaagacacaagggtgagctggaaaaagtggctttcttactgcagatttaaattctgtatttttagctgtgtgtcttgtttttttacaacaaatcaataaatagatatgaaaaatagtgaataaatccagactgggaagcaagaccatatcaaaataaaagcatttttttagattatccaggaaattgctacctcagttcataacaatcaagatcctaaacaagggctaacaggatggctaagcaggtaaaggagcttgccgccaagccgtattatggtccctaggacccacatggcaggagaacttccaaaagttgtgccctccacacacattacaaggtatgaacatatacatgtataaatgtgctaagaaaaagaagaaaagaaaagttatattcccagcacttggaaatctgctacaggaaggtttgcatgaagtttgaacccacccttgattacagtgtgagactatgtcaggaagcaaacattaacagaaaaggccaactcagtaatcagccaagacgtgagagagtcatggtctgtcatcaaggctcatttgtaaggagacagtcctactctctagtcctggctcctttattccctggacatgaccacagcacccctacactgccctgaaggcaggcagactaagcaatagtctttatctatttaaccatagttccattgttcaggaaacaaattgtgactaagatgagaaattaacacaatctgacattcaatactgtttgagggacatgaatttctatgactcaaagtaagtttgtagttcatcatccttgtgttaggattttattgctgtgaatggacagcatgaccaagacaactcatattaaggacatcatttagttggacctggttcatagatgttcactccattgtcatccaggcaggatgtatggcagcttacaggcaggcatcacaggagtactctacatcttgatccacaggcagccaggaggagactgccatccacgctggcctaacttgagatacatatgacacctcaaagccctctttccacagtgacacacttcctccaacaaggccacacctcctaatagtgctactcatgggccaagcattcaaacacatgagtgtgtggggaccaagcctattcagaccacagtactttccctctgactagatcacacagctacattgcttatgcctttccctgaagtgaatgaaaaagggtttctatcagaaaaatgttgtcatttggagaattcccaaattcttggactcccttaactgcacattcagggctgttatatatgcatagaaggtaataaaaaacagcacacaccctttaaattcaaggaaaaccatgaaagtttacttttgaataactgctttagcagaaaaagaacaaatacaattattcattgtggctactgggaatttatctgagctttgactctgaacacaaaatgtaatgtcattccaaacctgaaaacttattcctgtcactagaagcattctgcgtaattgtttcaaagatgtatttatgtttcagctctaatgcctgtgagtatgtagaccgggtgtggggcaaaaatcagctgttatgtccatgagcttacagcattagagagaagtcagcttcatcttgacccactgctggtctttgtagcaaatgtcagatgcacaccccagtctcacctacttgtcataccaggcttgaactttcccctctgtgttagagagtaagtatgagttcactaagagcatctttaacctgactaaacagtgtgaggctgccttttgtttagtgactgtttagaaagcttgagttcccagtatgaaaagacggcagagcacatgggattctcaagggtctgggtgagcaaatgcatccacagggaggaatgcatcctaatgttcacactttgcttcccaggccatctgtgttggaccagaaaacatgcagatcatgtacccggctatatttgaccagttgctggcgttcgtagagttttcctgtaaacctccacagtatggacagctggaaacaaagcacattgcaaatgccaagtacaaccaggtagctcgcaaactgtgtctgttctgtagtaagttctagatgagttccagtccagatagactgtggttacctaaggaagcgctcctctgtgctcaggtgtcccttacagaacacaagtgttacccgagacatcgctctctctctccagagggtccttctcagaggtcgccctgccctgcgctcccttctttcctcagaagtgagagctcctttccaccctttctctttgcagccccattcttctacaaattgggtataaacccctaggcctggtcttacctttaaatagatatctacaatgcaagatgaagaaatctgtgtgtactaaacaagttgtccattgctggtgtgaaatttagttggattttacatccatcccatcgccttagctggcagattatacctttggctaatttataacaagagtagatttttgaacgcacgcactgctgattttcttcactcaacataagagttataatttatagagtccgaaaagtagttctaatgtgtattaatttttctcattctatttgtcttgcatcacaatggaatcacaatagatccaactatttgcaccggtgagttaaatttcctaaccctgtcctaatctgctgccaacacagtgcatctccccagtcttcatagagggctctgtgctttcccggtagctggaacttttgcctgaatgagaattcttttttatgacgtgcatttgtttttttgaaaactttgcatgtaatgtgatctgatgtagaaccaaggcctgaacttgtaaggaaaaagagcttccttctcaaaaacagtatcatttccttcagacccttcccctctaactccatgtgaaaatattactttctaggcggaatgggtagccttgaattatgtaccgtttgctgaaagatctttagaagtagttgtggatttgtatcaaaaaacggcttgtcataaagcagtggtgaatgagaaagtcctccagaatattattaaggtaatgtatcttcttatctctataattttacatggtattatacaattattgaaatttctctaggcagtatattgggataaatgaataaaacatttgctatttatagtgacttcaaatacatggattgtatttggcaagcatattttttattatatgggatgttttggagtggagtgagggtacttcagtagtagggcttgaacctctgaaatgccaggaaatgcttttctgctgaattctacctctagtctggcaaggtcaatgtgatatagtccttaaaagagtccttaagtcttacgggagctcagaactcagagggagtcagtttgtctgcttagctgttgatgaagacttgtcttgagaggccatatgcagaacaccacatttgggtttctctttaaagattaaacatttgttcactatgtttctccttatttcttcactttccctctgtttgaaggacaatctaaagctaaactccttttctaggtttcctattcttgcatgattaatttattgcagtattagaaaaagcacattgaaacatttgagtaaagtgtaaaactcaaggaattttagttctcaaacatgaaagtatctcaggttgttccctctcccctggccactgggaacacataggcagcattggcctcttttgggcaggcaggagacctttagggactatgctttctgctgggagagccacagcaggatagttgcaaactggtacattttctgttcctaactctttgtaatagtatccttattgtgattttaaagaaagagaactgaggttcaagaagtagttaatgactcgtgcttagatgagaccgtggtaaagctcatggctgccgcacagtacttgggaggctgagacaggaggatagtgatttgagtacagcctgaactacattagtaagactgtccaattaaaaacacacatatgctgcttttagagctgaggttagctcagtggtactggtcattcttggcatacagaaggccctgggtctagttctcaattccaaacaaaacgaagtatgtctgtccaggagcgtcagtctttcttgaccgtctttcagtgaaaatcttcatgctgtgctttcatggatttacctgacttttagttttgaatgtcgctgtgtggattttaaccaaactgaactttctctccagactctcagggttcctctcagtttgaagtattcatgcccttctgaaagcacgtggaaactggcggtagcctctctcctcaaagtcctgtccatcggactgcccgttgcccgacagcatgcttcctcggggaaatttgacagcatgtggccagagttagccagcacgcttgaagactttctctttactaaaaggtcaggtcattggtctaaaatggagcgagagcctttaaggagatgggagactatgtctgcaactgtgcagatgggggtcttactctctctccactgacagtcactgactgctgggctgcacacacaactggaaggatgtgtctgtgccttaggtactttgtcactgtggtgggaagactagtgcttgatgcaggggacctggtgctcagtgtatttttacatttaaagtgtacaaataaaacaaggcctgctaaccatctagctgtaggcatatgtatactacacctctaaactaaatgcattgatgctattttatacatataacataaaagaaaattatagagacttagatgtcagataaggaaggttcctattggagccttgcgcttactggggattgcttgcagatgcgttcttaggcatgcacagctttggtcttctcttctgttgacgaggatgatactgcttagttcttggggctgcagtgaggacacatgcgagtaatgcagacaaagctcttacaaacactggctgattccagcaacagttaatacttaagctgctcttaaacagtgaatacttcaatatcctactcatttgtgattatcttactatccatgcatcagaaagtctagactcccttgactctctcagaactattgactatctgttcttgctgtaaccactttgctttagaaaattaaattgggcctttcctttatgcatgttctcttatgtttactctaaggaatttaatgtattgtcttacaaaataataatgggcttggttgagggtcatttctgtcactatcagatagcataaataaaatcagatgtcctctcaatggtgactcaggggtggggggcacctttcttactcacactccactgggagaagtttagttttacagatgttcagctcaagattgctccgagtatttaacagatcatttacaggaagtactgtaatttagcagcggcttcttttgagtgagccgtaatgtctcagcctgagcaggaagagctaatgttttatcacttgagtactgcttatctccaggttgtccagaaaatgaaatcaagtctttcttttttctttttagcatacctccagataatctctctattcaagaatttcaaagaaatgaaagtattgatgttgaagtaagcaagcttagaaaattttttctgtgttttatactgtatttgaggatgataaatggaatgtaaagattttaatgttagtagggaagggcatgtgtgtgtgtctctctctctctctgtctgtgtgtgtgtgtgtgtatacctgtatgtgtgtcagaggacagctttgcggaaccttccactttttcatgggttcagcacctgctgagctgtcttgccagccttgaggggttttagctgtgaagctttggttggggaaggaggtgggatctgttatctttgaggtagctgaatgtttacgtaaatcaaatacattattttctcatgtagacttgaaagtgtagccattgtaaaagtctcgcctatgtgccattgctgtttaagcctcatgtaagcttttttttttcctttagaggataaaataaactgtatgttaggacacagtatgcaacaaaaatgaatatgactttaatttctcatagttcataatttctggttatgaaaaataagtttaacgttaattttggatatttaaatgtgggtgagtctcaaatatggctgagcatttttctatatatttgtggttgggtgaagatcaacatatgttcaaactgtagcacagtaaaccttagtgttgactctccttataggtaagatggatgaagaggcaggctagtggtcatgttgtaggaacagtaaaacgttcatgtactgcggtcagagaagggtcgttactttttcaaaaagtaaaatttagctctgactctagacaatctcatttgaatcggccgtctcttccgaaggaaaagtagatttggcgctctctcctttgctgtaggttgttcagctcatcagtgcggagatcctcccgtatgccaacctcattcctaaagcgttcgtgggtcagatgatgaccatgctcaacaagggctccatccactctcagccgtgctcattcacaggtgcgtgactcggggccgcttacagcccgagcgaggatagtcacatgtgtaagtcatgcttcagcgtgggacgtagagagtgagggttataccgggaaatggaggcgatcatatacgtaagctctgattaagtgagtcacatggggcttctgcagtcggatgaattatgcatggtgacagaatttactacattttgaagtcatggattattgtaaagagtctagtatagaaaaaaagagaatattctgccacttagaatgttggttttagtagggaaaaagtttcttaacatttcttaacggagcaaacagtgagtgcctactatgtaccacactgtgctagagaggtgtctcactcttgggaacatttctgaggatacataccacagtatgtataaagaacacactccattcattatgccctctaatatgtctaaattttgttataatttctggttattaaaacatgtactcagatctcagaagtaactgtgacacaatgggatttttttatgtgaggtcatacatttttgcaggttattttctatgccttagtcccaacctttactagagctaccctgaccatttatacagtttgaccactagatggctctcttgctgcttacttcacaagccaagggttttgtggttttttttgttttttgttttttttttttccactcaccccagcatttcaaaaaactggcctgcacagcatgggaatttcagagaaaaataattaagtgggcttattttttatataatacttatatttaaaatggtagatattctaatagagtacaattaaaattaggtacaaatatttcaagggctgaatcatcaggttttctgatagcccgcctaccaagtatggtgtgacgtgtaccaaggccaggtagccctgcctaccgtgtgtggtgtgagcacagcaacactgaaagaaagacaggcgctcacacgcactccaaggactgcataaagaacatgctgtctcagcttttcctttgcgttttctgtaaacacacacagaaagacattccatgctaggcgagttcctagggtcacttggttcttggatctttagcatggactgatggccaaacttcacagactctcagggtttcggaaggccaaaagaaagaagtaaataaaagaaagaggttcttccagaggggtgaaggagaccatgggggggcggggggagtgtggtgcgggcaggcacagcagtggggcagtgagctgagaactcctcaaccccaggcgggagactgagagtgaaatcaagggctagagggggagccgactgagagagagaacatgtgtgtgctgagagtggtgtatggctctgaaacctcaaagcccacccctagtgacacacgtcctcactgaggccacgcctcctaagagtccccagcagtacttctgcctgtggagtgtgcagtgttcaagttccagaaactgttgctcaaaccacaggagtgaccaagaacatagagcagaaaccggtgggaaaatttgtgctaaactaagatcagaaagaaagaaaattagtcagaggcgtttatcaggtacctctgataactgcatcttcctggagggaacagagaaatatagaaaagggaattgctgaagactaaagatatcctcaccttagagatgataactctgtgcccaaaacaatgaaggataaagatcacacaatatccacacacttaccataaaaggaagatcagtcactctcagccacaacaacttttcaaatggtctacaagttctcccggaactgcgcatttctcaaagacttgacatgggggctagaaatggagagttctcaccatggaggcgtgtacctaggcacagctgggcaggtctgagtctaggatggtagttctcatactttagcagaaagggtgtcctgttcccagggtttctgcctcggacagggtgggataggagagttcccacttcccacaatggctctcgagcagctggaagccagctgtatgtcttacacagtaacgtaacggcagcctcagaagaacaacaaaggtttattttcctccatcccttcttaggaagccacttccagatatcttcatgaagcagggtaaaccgagaaagcaggaagctagggttctgggagacatgagggagaacggcgttggccaaagactacctgccagttatggctaaagaagttgactaggaagaactagtccagagcagagcaggctcatgctcctgaaaacatgtggctagggaaggagaaaagatggtaagacagaaaaggcagtaagtgtgggttttgacttagatgaagctcttgagaagtttgttcgggttttgtcattgttgtttaaggtgtcatctcaggtactccaaactgtcctcaaaaaatgcatacctcaatgactggcaccaaacttcctgtgcagcctagagtgcccttaagcttttcattctcatgctggagttgccggcatgccaccatgtctactttatgtagtactgggtattgaacctagaatccaaacgcagagcctcgtgtgtactaggcaagcattctgccaaccaggggacactcattgcccttaaaactcactttatagccttgtcacaagataagaaaaatgttgggaccaacagatagatactggccatcaagcctgaagccttaagtgcagtcactagaatgcacatggagagaactgactcctgcgggttgtcttctgccttccacatgtataatgtggcatgtgcacatgtgcacacacatgcatgcacacacacgcacacatacacacatgtacatacacaagcacatgtacatacacaatatacgcacatgcacatgcacacacacacacatgcaaacacactctaaacaaaggaaaagcaaaaagaacatgttgattatgggcagcctctctttgcaccttcctagaggaaagattgttatttactagatatttactaagtagtattaactaaaggttgttcatcagtgcctttcatcttattgatatccttattcctagcttgctaggctcgttattaatgtgcactgtgttaacattttttaataatcaaatgttgctaattttacagaagcagaaattgacattcgtttgagagaagaattttctaaaatgtgttttgaaacattgctccagttttccttcagtaacaaagtcacaacaccccaggaaggctacatctcacgaatggcactctctgtgcttttaaagaggtctcaggatgttctgcatcgctacatagaggatgagaggctgagtggaaaatgccctctcccaaggtacgcatttaattaaggaggaaatacattgatatcataatgagtagcaaagattgctcaaaaccaagagatttcttaagagaactagatggaactgaggtcattggtaactgtatgtgccctctacagtgtaaatattcataggttttgctgcagacacataacacttgtgatggtgatgatgacgcttcaggcctttcttgtagattaagaactatgtgatagccggacagtggtggcgcacacctttaatcccagcacttgggaggcagaggcaggcggatttctgagtttgaggccaaccttttgaatctaaagaatattgaatctgaaaatcgaccctctgacagaggctctgcatgagaactgtggattggcaagaaaacacaatctttttctataaagggaaattaagagactaattacttctagcttatttttgattgacatttcttgatttctgtcacctgttcctgtcttttttttttttttttttttaaatgagtaaactgtagctgtcttcagacacaccagaagagggcatcagatcccatcacaaccatagatggttgtagtttctgggaattgaactcaggacctcagaagagcaatcagtgctcttaaccactgagccatctctcccacccacctgttcctgtcttaaatctgttttttctaatctgtttaacaaagcccctgcccctacactgatcccttcttgtatatccagcttgtatttgtggcaggggctgcagggctgatctcagttgagctatggactggaattcaacaacagatatatatctccatccgttttaatgtagaaactggggtttaagtctatatatgtgtgtgtgtgtatgtgtgtgtgtgtgtgtgtgtgtgtgtgtgtgtgtgtgtgtatgtatatgtgtgtgtgtatatatgtatatatataattttgtttaatgtagaaactggagtgtaagtcaaaggaaacagtaactatgaaagggcagacatcctcaggtcaggaaagaattggggacagtgagcccctcatgatgagtttctggtagaaaccgatcagccatgatcctttgtttgtttctgaagttggaagtggtctgacagaggatgtggtcttcttgcttcatcatgcccgtgtcttactagcttgctcgctgcaggtctgttccaggttagatctccccaggatgatatgaatgcctttccctcagtttttaagattttaaaattctttactcatttagagtttattttacagttttctaatttgatgagtgaaatcacaaaattacattttaaaaaatgaccaatacttattaactctctacaatcttgaattttaaatttctagatcataaattataggcctctgccttcagacgtgtatatacagaaacatcctgaggcagcttactagtaatttgattatggacatgattaaagttgattcctgatatatacatgaaagtacagagataaaagctgctttgagtggatattattactagatcataaatattagttcagaaaacatctttttttcatttttttgtgttgaagatgtaacagcttctttaatatttcttttaaattttatttttgtcatctttatttatgtgttagtatgtggacattagtacaagtggctgaagaaaccaggggtgagtgtgtaatgtcctgaagctagagctgtaggcagtgtgagccgtgggatgtaggttctcagaatcaagcgcagatcatctgcaagagcagtccacggtcttaaccactgagctgcctcccccactctacctgctctctgtaatctgagctcgatttatagtcatctgatgaagctgtttcgttctgtgtcacacacagcattatgtgctttctacaagtgacatccagcatcagtctgcttgcacaggccatttggtgcctggggtgcagcttagtccccaaaccacatcaccagggcctgctcgtgaagcttctcgtctcagcagacaggacactgaggcaggaggatcagaaattcaaagtcatccccagttacaagtttgaattcagcctggggaatgtgggagatcctgtctcaaggcttgatgtagtgccctgtgccacactggatggccaggctccctgtgggatccagatctgtaccagcaacccatgggatggaacaccggggtgttcttttcacctttgcatccttcattacacgcttattggttactgttaaatactgctaattggccgtctcagaattaatgtctggcttgcttcatgattgtcgtcatagcagtacagtaagagaggagaagcaggcgagcgtcactgcagttctgagagctctttcagcagcagataaaatacagagcaggggttagaaggagctttcccatttcatctttggcagatttctattaaccagaaaacaaaacatcattttgtaggaagttttaaagcatgtgttgtaaaatattgtagtgactctcgcctttaatcccagctctcataaggcagagtcaggcagatctctgagtttgaggctaacctggtctacaaatcgagttccaggacagcaaagataacccaggaaaaacccaaaacaaaacaaagcaaagcaaaacaaaacaaaagtaactgtagctagtggcagggctgccctgtgaatgcaggttttcaggaattgaattgctccactgataattttggtaagcttaactacaaatcagacttggtgaggcaactacagattggtagcaaccacggcactgatgtgtggattgttataagcttgatgagtttgccttttataagaatcttaacctctttttatttcattgtagtcaatatttttctgaaattatatctatttgtacaaactttgggagaaaaaaattatttgttgtatcttaaaaaatcctaatggaaatcatctcttacttatcctttttaggcagcaagtgacagaaatcatattcgttctaaaagctgtcagcactctcatcgactcactgaagaagacccagcccgagaatggtaggtgcttgaggacttggctgtcctcccagacattgcacatctgtcctctctgtcagggttatcactgtgtggtacctttgtattgtcactaaggtaggggaatgtgagaacgtagccccattgtgttctttgttctcccgtcctctccatgacaaaaactcaagtcacatcaactcagtaaagttaacttgaaagctggtaggcctacgagacacccttggctgacaacctgactttgataagaatagaggacagccagctctgtgcatatctaaacatttatatcagagacataatgataaaaaaattataaaatattttatttttaagacaatagtacctgaagaacacctgaggtgctatctggcctccactcatacatgcactcacacacatacatgtgtacaacgcacaaatatagaaaaaaatagcagttggaatcatgctctaaacaaatgaagtgactttttcattttgatgtaaccataagttatggtgatagattagaaaagtataataggcttcatcaagaaaagaagaaggatgccagcttttctgtccgaatcatgtggattgcatagccagtccaagcctgatgcaagagttggctatcaggtgtagaaccaacaggctccacatcgatttaaactttttattattgtcttactatagtgttgttgctggaagtgaggtgtttggagacttaacattttttaagaggttttgtttttattattttgtttgatggtaagtttttaagtaggctatatacatataaataacttaaaacagaggttctcgctgggtaagggcacctgcaccaaacctgagagcttgagttcagtgacgacacgataggagaagaaagtcagctcccacaatcatgtaatacaaaatacatactccaggcacccccagctttccatacaaataaataacaatatcccctgtttgtaatcacctttttcttgtctatttttcacttaaacattatgtatattctttcacatcaatacatgcatctctttaatattctttttgtagtttgaggtttgggaagcagagtcacatagaagtcaggatggccttgggctgctacctctcagcagagggtgaccttgagttactaaccttttttctctacctcccagtcctggggtacaggcatgtgcgggtacacctggctctctgtcaggaaatcccgcagaaatcacagtgggctttaggataaacatgctgtaagaactgaacctgagtagcctcccccaggttctgttgggtgtcatcttcgtgtatctcctctaacaagccgaggggtagtgtagtggcttgactggtcgggtagagccgccatctgtatgctcttccaaaggcagctggaacaggccagataaacttcctagagcagtggtgcctggcttttttgttttgttttttggtacctttgctgatttttttttaagccaacctctaccccaaagcaaaagtaaaaagaaatatggtgtagattcttctttcattattattacataatatttaatgtgtgtgtagagcagggctgaacactgccacacccacatgtgggtcagatgtaaactgcagggacttggttctcttcctgcagtgagtgttaggatcacacagacagtaaggtgtggctgcagccttacttgccaagccgtcttcagggtcttggttcagatcttcacatttcagtaggtaaacaacagaagtgtgcttgctcatccaccatcccctatgttcaccgtgcagccccttctcctcttccagccctgtcctgaagaagcctgttcaaaaacggaggtagggctggagagatggctcagaggttaagagcactgactgcacttccagaggtcctgagttcaattcccagcaacctcatgggggctcacaaccacctgtaatgagatctgacgccctcttctggtgtgcacgagagtgacagttattcacagacatgaaatatcttaaaagaaaaggagttagcagatgcatagttttccacagaagtgacctaaggaaataacattagcactgagcagtgtcagacacattagatgaaaaaaacttgcataagcatctttcttgggaaactgaattatataatctgagtcggcttctcaaccgtaagcttctgagctgctgggctttaagaggagagagatatgaaatgtgaaccgagctgatttgaccagggcttgttccagaaattgagagtctatgtaaaggaacccctttccttatattacatcagaagagctgagacagagaacagttccctgacgtgaccagaataccaagctctgccttatttcggggggtggggtgggggtgggggaatgttaccacctagtaaattagactaaagtatggaataattataaaaagttctttgagccaggtatggtggcacatgcctttaataccagcacttgggaggcagagacaggcttatctctgagttcaaagccagcctagtctactgagtaagttctaggacaaccagggctacacagaaaccctgtctcaataccgcccaaaacagggggcgtgttttgtacactttcatggtactgtttgcttgtgtgctacgctgcctcccagactgtgggtttgttccacacagtaacataacatctgccagcaggttttatgtgaggattgaacactacaaagtacttaccagagaatacggggggggggggggggggtcaggcctgggtaacttgctgagatactgtatcagactaaaaggtaaaagagagggcccatagccgggcggtggtggcgcacgcctttaatcccagcactcaggaggcagaggcaggcggatttctgagttcgaggccagcctggtctataaagtgagttccagaacagccagggctacacagagaaaccctgtcatgaaaaaccaaaataaaaacaaacaaacaaacaaacaaaaaaagagggcccaaggttcagattagcagtataacacttgtgtgtacatgactctgggccagaccccagcaaacaataggtactataaaagtaacccgtgatttcagtataaacagattactggttctggtgggtcactctgcccacctgatgaagagcatcctgttggtggatgaggttaggaaagcaggctggctcctctgcccagtctcgtgatgtgcattaaagactagcaggctctgtaagatggctgcatctgttcagtgacttgacattcaaatcgctaccaagggcattactgagtaggaaagtgcataaaaaggttttctatttgttcttgacacgcacactatgttttctgacaactatgcagaaaataacattttggaccattgtgttactttaacttgcaaagttcgttggtctctacggctgtcctcactggtcatttctctcttcctcttaagagtttacttatgtttatcttctgtgcatgaatgtttgccagaagagggcactggattcccctgaggctgaaattagaaatagctgttagctgccatgtgggtgctgagaaccaaaccctggtcttctgcaagagcagccagtgctcttaaccacggagccagcttcagccctgattttcttacctaatttctaagtacacaatactctattatctcctttttcatactttactaattatatcatgaagtcttataaaattaagaaattaaaagatgcttgtcgaaccatttctgttatatctttaattgtgtttatgtaaattgggtgaccgtactgtgatctgcactgtattttgagacatttctatttgtattctttgactgcagttgatggcaatacctggtcacaagtgattgccttgtatccgacgttggtggagtgcatcacctgctcatcctcagacgtcggctctgccctgaaagaggcactggctccctttaaggacttcatgcagccgccagcatccagagttcaaaatggagagtcttgagcagctgcagcacgtgtggaggaagagataccctgaggaacgccttccccggagtcttgtagaggacggacgctctactgaagtcactcttggcagctgtgtttgccttctttaaattaaagtgtaattatctgggtacagtaattcatacaaaagcctccatgttaaccagggctcctggaggagctgagcctttgcctgggtgaccgtgctgggagggacagtgagcactgcttcacacctgctaccatgtcttcagttggtgacttaaaagtgagcttatgtacagtttgttgtgtatgtgttaatgatgtactttttaaaaagaaagaaatgatatttccattcagatttttgaggctggtgttttgcaccctttttcaagtacagaatcatactaaaattttatgcaaggtggtactataacattccatactctctacaaccagcccttgagaacaaagggaactgacaatactgtgtgtataataaacaggacagttctgtataaaacagttgcatttatttaaaattttaaaatactgatgatgctaaatgctcgaagctgtatttattattaatacaaacttgtttgcttacgtttctacttctgatttgccttcttgtggggcagataagcttaccgtgtactcgtacagatggcttcatgctgtttacatgcattgtcggtgacgagaaggatcgagggagtgcaacagcagaggtatgatggctgactgcacctctggaatgcaggtcctaacgtaacagagacatgttgtagcaggatgaccggtcatacctcactcctttcagcctctctctgaactctcatgcctctttttacactgctgtctgaattttaaagacttttcatattttctattcctatgctttcaacatctgaaaggcaagatgactttatacttcatgaaacttttctgtgaggttttgttcttctctgttcttccttttctgggttcctcccaagaggacccagcatgaggctgacccacagtctaaagcgcgtgtcccagggcaggcgagtgctggaggagagcagaggctcgctgcgctcaggaggggctcctgctgccccaggagaggactgcagcagggcacgggcctctcacgaaactcacgttgacctagcccgctgtaggttttttaattaattatgctgttacaatattttttccaagtaaaaattttatttcacaagtgctggagacatgaaacatgttgaaaatgttgctattaataagaagtgatagtgaggttaatattattttaatgcactagaaagcttttgactttaacaagattataaattttggtctctccaaaataatcataaacctataaggaggtgttagagttgagtaatcactgaggtagttttgaggctattttaattatgtaatgatttaatttgcactatattctttatatgtatgacaaggcctattttgaaggaatattatttttactcacatgaatcaatgaatttctattttattattttacttagggttaaggtaaaacatggtatttcatagactctgctgtcagtgttttcttaaaggtgtaaaaaaatgactcaagccgtgtattttttatattttgatatactcacttgtgaattaaagaataggactatcactgataaagtatcaaaatagtaagagtggcaacattttgaaaatattgccatgggtttctataaagtcagtgtccgctcgtgagaaggaacagaggattgcaacctgaacagcccttctctgaagctatctgtgagccagggctctacagcacacccttacctcggatcatctgagctaatacagtattagttttcaggaccagcgagcgtcgtgctgtatagttcaaaacataaaaatgtgaggcatgggttaatgtgcagtaaccagtgccagtctcaatgccaagcaagcgggccactcccttggtagaataacagccccctccccccaatccctctcaacccgcaaggagtgagtcccagtcattaacgcttttgggtcacacatgcttctaggctaccttttctgaaatgtgctggcctcagagtggttaacatggtatccttgtcctgtaaacatgacttgggtttttcagtccatacaagaactgactgcggggttactagatgcaaggatatctctaaagcctccaccacgaagcaccaagttaaatccccttcattgccttcctgtccccacccccgccccacccctgtctcagtgcagtgagttttaaatctcagagtcttcaccactgaccccctctgttagaccactgaacgccaggctgtactaacagcggtgcagtcatggagggctcaatagaactgtttgctggcacaggtcgtcctttgggctctggtggtacaaccactatcaagggagaaagggcaattccgtagcgtctcagttcttcaggattaatcttaaggttttgttttactgcaagcattttgcataccatctattaaaagcctattgtgtgccaaaggtgggggaaaacttgttattaagtctaactagaaaagaagtgcttttaacttgtttatatttttactacactaacattgatggtctcagttgtttcctcacaaatggttattaagtcaacattctttaaattatatagagcatcagaagaaaacagtggagaatttattttctttatgttatcatagtgactaagtcactttaagcagcagccaataacagttatctgtcctttctcctacagtatttagaatgttatatttattgtcggtttggtaccaccttgtcccaggtgagcatttggccaatggtcagctaaaaagctgcaagtgaactaataaactagagaacattgcaaatacatcccttgtaatgaaacacgcatgacagtcatgtcattaaaaggcgccattgaatactctcctcaaacgtagaataattcatgtgcagaaccaaatccgtaagagttggctaagggccgctaaactagaaccctttcaggaaatacttacctgtgactgccactgaaattaactggaaatcaagagccaagatagattacttttcagcctcagaatatcgtgaattataggtttttctaggaaactacctcgaggtagacaaaaacagtctgaaattaactggaaatcaagagccaagatagattacttttcagcctcagaatatcgtgaattataggtttttctaggaaactacctcgaggtagacaaaaacagtctcgattcagaagcatcgccaggagccgagagtgctcccacttatctgccaggacccgagagtgctcccacttatctgccagcagccgagagtgctcccacttagcagagttggctgttgcagctacttgtcaaaagtatcgcagttgactatgcatagtgctacaaggctatcttcattagactgaactgattggttgggtttttttgttgttgtttttaagttattcataagaagaacaggaattatatgacacattgtattactgacttacgtatggtgaaggaatagttttcaatcctttatggtcatttgaattaaacaatttgtatctctggagagtagagtggtgcttttattctaatgctcagtctttgtaagtgggaaagaaagttgtgagtggctcctaatttacatgtaaccccctcagaagacttccacgaaatccagtcgtttttactgtgttagcagtgtctgcatagctgtgcggataagctggatgtagtggctcaggcctgtaagcccagcagcgctcaagagattcccacgaggagtccaggccagctagcactacacagggaggccttgctcagaaagcagacagagcggtgtggtgctgcgtctcattgggactcaatactctgtgatctcaatgtggtgggcagagggcctgcctcccagttcacctttaagcagatcctctaagctgctgctttctgtgtctcagacggtgatgatgccgagtcactgcttctgtagacagatgcttgagggcacagtggcacccttgggtgcttgctcgggttgtgtggtgatgcactcttacggccaaacaggatctgaatggtttttttctttgggcagcactgtcattccgtcctgtctagattataactttgcctcacttcctcctaacctttatttatctctgcagtcctttttattctctacccatcccttctctcttcaggggactctgacagagaccctggcgacggccttcttgttgatgagattgtagcgtgccttctcttcggccactgttgcctgtttactgcgctgaagtcccctaccattttaaacaacagaacaatgtgaagcagttggaggctgttgcctactgtatgtctgagtttgtgattctgctgccaagacacagaacgggattgctataaataactggattcagtagctaaacttggaacagttaggtctgcactgccgcgaacagcaaagcggtgccacttctctttagagggagtatttaaaacttgtaggcatttctgttgtggcttttgaagcagggttgttttggctttggggaagttcctgttttgggaggtaaacactttgaatgtgggtaagtttatgtcatctaaatactaatcctggtgatatgtgcactgcttgcttccagggagtgttgtcatttctgtttcatctgtgtctgcgtttctattacaaagcagtagtttggaggatagtgagacagctcagcagtcaggagcactggctgctcttccagaggaccgtagttcaattctcagcaaccacatggcggctcacaaccatctaactccagttccaggggataggacgccctcttcaggcctgcctggccaccatgcacacacgtggtgagcaggcatacatgcacgcaaactatgcacacacacaattaaatcctgtggctagcaattttgattgaaggccagagtgttttatcttgtttctgagtactcctggaatatgttggtatctactgttgctcatggtgacagactctattacactgctgggaaagatgggatccttgagtaagaaaaggaacattnnnnnnnnnnnnnnnnnnnnctcagcagtcaggagcactggctgctcttccagaggaccgtagttcaattctcagcaaccacatggcagctcacaaccatctaactccagttccaggggataggacgccctcttcaggcctgcctggccaccatgcacacacgtggtgagcaggcatacatgcacgcaaaactatgcacacacacaattaaatcctgtggctagcaattttgattgaaggccagagtgttttatcttgtttctgagtactcctggaatatgttggtatctactgttgctcatggtgacagactctattacactgctgggaaagatgggatccttgagtaagaaaaggaacattactgaattttgagatcattttcagttgctacaaatacaattacctaaagttttattttaaactaaaactcagtaaatagtgtagccacaaaagatctcttaaaccatgccattatttgcaaaactactgtagcctaatagcaattactacttactgtgacatttttctgggtgcaagaaagactcgaaagagatactattacagtcttactccgcttatctaagcaactaagatattaagatataaacctaaatgcaagttccattttctctgcagcttttactccctctgtgtcataattttagctcacagcactcaacttctttctcaaggcagttgccatatggtgtttatgtcagactggatatatttatctcattttgcgagattccttttttagcttctaacacagttctcgaaagtaataccataccactgtttctgtacgtgttccttacaatccccatgttgttgagatgtatcagttatgcaatacaatccgaaaagtttcttggcttccagtccaagtctttgtaatctgggctaggtgtttcttcagagctccgtagttagaactgttgagtgcatcggcactccgtttgcattcggttctcacgcaggtgaacccacatgttttatccctgtcctactagttaacctcaaccaatgcgtgtaaacagtagatctgcacggaactgtaaggtgaaagagtggagagatacttgttaaagctgttgatatataaagggaaaacagtgaatgtacatagttgtgagaatcttgaaaaacccaggtccggttgaaagcacgcaccctcatgtggggtgcattgggggaggtggggggaaccaattctgaacttattaggaccttgtgcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgtggtggtggtggtggtggtggtggtggtggtggtggtggtggtgggtgatgggtggtttttaatttgaggcagctattttgagactgcccctctgtatcagtgagtgctaagcccatccacagctcaaattctgtttcatatcttcttttttgactagacatatagatgtaacttctgatcctccagaggctgaaacaggaagatgacttgaacccagggaccacagggcaaaggagggaaaaaaaaaaattcctgctttgaaaattcctatatcatttagtgtgcagtaacttctaaatcgctgctgtggggtgcttgagggacatagcatttcttctcctttagtccttatagtaggaagttagggtgaggacagcaaagctcagaggtcactttctagagtcacagacctaacccagcacggctcacttgaagacccattttttcggctataaatggtcgttagcaaaaatgtctcattgcattaatatcttactgacataaattactgtttttgcgactgtgcatttggggaaaatatacacaaatattaaatgaacttcaaataccgaggagaaattgtataacagctcacctccgtgtgagctgcatgggactttttcaccggtgcaggtctaaggcatttgtttaaagcctctgggttttgctcgttttgtgtcagcattagtacagtggttaaaaggccaagagtcttcctaaactcagttcctgttgtttgctgaatctgttacctgagcaagttaatcagcccgttttggtgttcttgtctatgaaatggaattaatagtagtgattaatatgtagttattaaatatatcttgacaaggaattttagaaagcactgtgactgtccttggtaagattttagttgtgataggaataaaacacacagttcagaaagtgggcgaggaaacagggcagcctcttccttgtctttcactgcacagccatcaggcatggtcctctgagtgtctccttgtcacgtgactggatattgtagctagatgagaaaaccttatacctcaaatattgctgaatggaaggcaacgtagtcaagctctggagtggccataacacaggcgtgcccttgtcactgccttagagagtagaggcacacgattactaaatcccctatggtgcttcaggttaatactgctcttcatattcaaggggcgaccagaaaaggaaaggagaggctcggtgctgaatatggaactttcagttttgacggctaggaatgctgcatctataaacggcaggatgtggggagatactgaaaaagatggatgatggggggggctcttttttgaagattttaattgtgtgtgtatatgggaaagggatatgtacacatgagtacagatgcctgagaaatctggaagaaggctcaaggtctcctggagctggacttacaggtcctctgcaagaacgactattgagccatctttccagcactaagggaaggtgtgtgtttttagtagaactggcgagggcggggtggagggggaggttggctttgaggaactgaaatctaatcattaaactccttaaaagccaaaaactttgcaaaggcagaggtttacttttaacccaaaactaaggaagataaatgtgtgatgtgtagagtataggtggcgatagagagtagggaaaccagccgggggttagtgttcctgctgaggtgatggtagagaagctaagagtgctgtgtttgcaaggatgcagagaggagaaggcgctgcacaccgtcaccctgccaccctagcacttgagagtcaggcagacgaaaatagttgcaagttgtgagcaagccaggtctagatcgtgagaaaatgtctcaaagcgggagttaggatgaattaggtagattgtacatacttggatgatagtgatggtgagaatattggtggtgacaggacaatgtgtgtgatgattgtattgatgtcggacttgtccgagataaggcagtgcaacaccggaaccaggtttagttagaaacttaccttttagaccaaacgtacacttgatagccacttaaactttaccttttagaccaaacgtacacttgatagccacttaaactccacgctacagtggccagctaacttggcatggcgcaaattaacatgacccactgtgcagcaagttttagccctgttattgtttaagaaaagatgctgtacatatcagtatggcagacagtaaattagcatttcgttgcaagtatgttacacaagcactcaaataaaaaaatttaattaggaataactgaaatgaacatttacgatggcttgaaatactaagattagtataatactgaaacctgtccatagcctaaacaggcaggtagtttgaatatgtatgtatgaaacgtgtaggcgggttgataaaattgaaaagttgtacttcaaataattgggtcctgtatactttgtaagtgaaagttaattcgtgttagtactgactccagggtctgttgtgctaaattgtactggactgggtgggtgtgaggtggggtgagtctccaaaatgaattaaatatatgtattcgcgcgtgtttttaccaaattttgctccagatgtttgtgatctgggggctgtagagattaaagtctagagaaacttcccagattgcaaccgaagatactcatttctctaaccaaccgttctgtatttgtcttgtgtactgtggatttccagcagctttatgaataatgggattgccaaataacactaaataaaggagctaggcagataagtttgaaattcagataccatcccccatttagtatacggaatctacacgtgtaaaaaggagcattcctttacgtggaattccagtttagcaagacatcctggattttatctgacaaatcttagtgactttgaaaacaaaacaaaacaaacaaacaaaaaaagcctttaagaaacctgtaaaagagaagcaaaacgaaaaagttatgtgggccggccacgcggaggtgaagccctactgcagtcggctctcttccaaaccgtgcctaaaaatagggagaaggcaggcgccccacgttcggcgagcgtgcgcactagactcgccgggcacggctttcccgccagtttctgcggcgagcagccgcggccgcgccggggtggagcgctgcgggccgcgccgggcggccggagcgggaaggaggtgccggaactttccccgccggccggggcacaacgtggctcgcccgcccgccgccatctttacagcgcccgccgggagcaccggggctccggaaggcgcgccgagcggacggagctcggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagggagggagcctccgccctggggcgatccggcgcgcgctgccggccggcggcggagaggaggacgaggcgccgctgcgctccgcgtggtccgccggctcccacaccatggccctggctgaggtagtagtttgtgctgttggtcgggttgtgacattgcccgctgtggagataactgcgcaagctactgccttgctagtgctggtgatgctcagcgccgcggaggacaatggccggggatcccctttgttttccggggcgcggggaccgcacggccggcgcggaaaccgttagctccccgcattcccgcaggggctgcgggccgaggcggcggccgcggcgccttccggagcccgcggggagagcgaagccttcgcgattgctccccgagaggagccgcggcggccgc

SEQ ID NO: 188 - DNA, 2725 bp, Mus musculus
gtctgccagcatccaaactctcggatgcgggagtggggagcagaagctttgacgtcactcattagagcggggctgacgttcagccatgagcctccacttccacagaaccagagactacagctgcttttattgaacccattaaaagagatgtccaatattaaccatccagatattcgactcaagcaattagaatgtgtgttgcagattctgcaaagccagggagacagtcttgggcctgggtggccgttagttcttggagtcatgggagcaatcagaaatgatcaaggagaatcattaataagaactgcctttcagtgtcttcagttggttgtgacagattttctacccacaatgccttgttcttgcctacagatagttgtagatgttgcaggagacttctcaagagcttgggatgttcttcttgaccacatccagtcagctgcactcagtaaaaacaatgaagtgtccctggccgctctgaaaagcttccaggagatattacagattgtgtcccctgtccgagactcagagaagcccgagccccctgccgttagcgtgcccgtacccgtccttctaggaaacctttccggcccaggcctgagcaggccgtttgtgaggacagactccattggagaaaagcttggcagatgcggctcggagacgcctgtggtgactgacgagctggaagatctgaagctctggtgggctgcctggaacacctggcacaggactggatctgaaagcacagagccgcccagctccgtcgatgagctgacctttatccccagccagcctttccttacagccttagttcagatcttccctgccctctaccagcacataaaagctggcttcagcatggccgacttgcagaagctgggcgtcatcctgcacagcgctgtctctgtccccatcagttctgacgcctctcctttcatccttccgtcttacacggaagcggtcctgacaagtttacaggaagctgtgcttacggccttagacgttctccagaaggccatctgtgttggaccagaaaacatgcagatcatgtacccggctatatttgaccagttgctggcgttcgtagagttttcctgtaaacctccacagtatggacagctggaaacaaagcacattgcaaatgccaagtacaaccaggcggaatgggtagccttgaattatgtaccgtttgctgaaagatctttagaagtagttgtggatttgtatcaaaaaacggcttgtcataaagcagtggtgaatgagaaagtcctccagaatattattaagactctcagggttcctctcagtttgaagtattcatgcccttctgaaagcacgtggaaactggcggtagcctctctcctcaaagtcctgtccatcggactgcccgttgcccgacagcatgcttcctcggggaaatttgacagcatgtggccagagttagccagcacgcttgaagactttctctttactaaaagcatacctccagataatctctctattcaagaatttcaaagaaatgaaagtattgatgttgaagttgttcagctcatcagtgcggagatcctcccgtatgccaacctcattcctaaagcgttcgtgggtcagatgatgaccatgctcaacaagggctccatccactctcagccgtgctcattcacagaagcagaaattgacattcgtttgagagaagaattttctaaaatgtgttttgaaacattgctccagttttccttcagtaacaaagtcacaacaccccaggaaggctacatctcacgaatggcactctctgtgcttttaaagaggtctcaggatgttctgcatcgctacatagaggatgagaggctgagtggaaaatgccctctcccaaggcagcaagtgacagaaatcatattcgttctaaaagctgtcagcactctcatcgactcactgaagaagacccagcccgagaatgttgatggcaatacctggtcacaagtgattgccttgtatccgacgttggtggagtgcatcacctgctcatcctcagacgtcggctctgccctgaaagaggcactggctccctttaaggacttcatgcagccgccagcatccagagttcaaaatggagagtcttgagcagctgcagcacgtgtggaggaagagataccctgaggaacgccttccccggagtcttgtagaggacggacgctctactgaagtcactcttggcagctgtgtttgccttctttaaattaaagtgtaattatctgggtacagtaattcatacaaaagcctccatgttaaccagggctcctggaggagctgagcctttgcctgggtgaccgtgctgggagggacagtgagcactgcttcacacctgctaccatgtcttcagttggtgacttaaaagtgagcttatgtacagtttgttgtgtatgtgttaatgatgtactttttaaaaagaaagaaatgatatttccattcagatttttgaggctggtgttttgcaccctttttcaagtacagaatcatactaaaattttatgcaaggtggtactataacattccatactctctacaaccagcccttgagaacaaagggaactgacaatactgtgtgtataataaacaggacagttctgtataaaacagttgcatttatttaaaattttaaaatactgatgatgctaaatgctcgaagctgtatttattattaatacaaacttgtttgcttacgtttcta

SEQ ID NO: 189 - protein, 705 aa, Mus musculus
VCQHPNSRMREWGAEALTSLIRAGLTFSHEPPLPQNQRLQLLLLNPLKEMSNINHPDIRLKQLECVLQILQSQGDSLGPGWPLVLGVMGAIRNDQGESLIRTAFQCLQLVVTDFLPTMPCSCLQIVVDVAGDFSRAWDVLLDHIQSAALSKNNEVSLAALKSFQEILQIVSPVRDSEKPEPPAVSVPVPVLLGNLSGPGLSRPFVRTDSIGEKLGRCGSETPVVTDELEDLKLWWAAWNTWHRTGSESTEPPSSVDELTFIPSQPFLTALVQIFPALYQHIKAGFSMADLQKLGVILHSAVSVPISSDASPFILPSYTEAVLTSLQEAVLTALDVLQKAICVGPENMQIMYPAIFDQLLAFVEFSCKPPQYGQLETKHIANAKYNQAEWVALNYVPFAERSLEVVVDLYQKTACHKAVVNEKVLQNIIKTLRVPLSLKYSCPSESTWKLAVASLLKVLSIGLPVARQHASSGKFDSMWPELASTLEDFLFTKSIPPDNLSIQEFQRNESIDVEVVQLISAEILPYANLIPKAFVGQMMTMLNKGSIHSQPCSFTEAEIDIRLREEFSKMCFETLLQFSFSNKVTTPQEGYISRMALSVLLKRSQDVLHRYIEDERLSGKCPLPRQQVTEIIFVLKAVSTLIDSLKKTQPENVDGNTWSQVIALYPTLVECITCSSSDVGSALKEALAPFKDFMQPPASRVQNGES

SEQ ID NO: 190 - DNA, 54200 bp, Homo sapiens
gatcacagcactgcactccagccttggcaacagacccagaccttgtctctgtaaaaaaaaatgataataataaaaaggctgttttgtctacattgaaaatctgttggtcagtgtagccaccttcatcggtgatcttagctagatctggataacttgctacaggttctacatcagcacttgctgcttcaccttgtacttgtaggttatggtgataacgtcttttcttaaacctcatgaactagcccctgctagcttcagacttttcttctgcagcttcctcaccttgctcagcttttatagaattgaggagaattagggtctttctctggattaggcgttggcttaagggaatcttgtagctggtttgaccttctatccagacagctgaaagtttgttgataccatcaataagcctgctgtactttcttctttctttctttttttttttttttttttttttttctgagacggagtcttgcgcttgttacccaggctgaagtgcagtggcatgatcttggctcactgcaacctctgcctcctgggttcaagtgattctcctgcctcagcctcccatgtagctggaattataggcgcccgccatgatgtactttcttatagtttgtttgttctttggagtagcacttttcgtttccttcaagaacttatcctgtgcattcacaacttggctcactggcacaagaggcccaggttttggcctgtcttgattttcgacatgccttcctcactaagcttaattatttctagcttttgattgaaagtgagacaaatgcgactcttccttttacttgaacacttacaggtcattgtagggttattaattggcctaatttcactgttgttgtatctcaagaaatagggaggcctgagaagaagtaaaaagatgaggaaacaacctgacgatgaaacagtcagaaaactcacattaagtttgccatcttacataggtgcggctcatgcaccccaaaatagttgcaatagtcacatcaaagatcacggatcatagatcaccataacagacatagtaataattaaaaagtttgaaatattacaagtattactaaaatgtggcacagagacacaaagtgatcacatgctgctggaaaaaaacggtaccaacagacttgttcaatgcagggttgccacaaacctttataaattgcaatttataaaaattacaattatctgtgaagcacaacaaagagaagtgcaataaaacaaggcatctctgtaatgaaatcttagagaattgttaacattacatgaaataaacatgcacagaattgttttcaacatatattttaaggcaattatttagaatcttttaaatgtatattaaaactcagaagttttataaatttgaactttaaattttcctcacaagctagataagttactacattcatctcttcctacgttcagctcttaatatttgtggcttctgcatctgtagattcaaccaactataaatagaaaatttttttttaaaacaagatagttgtatctgtactgaacatgtacaggctttcttgtcaatattacctaaatacagtataactagttacatagcatttaccttatgttaggtattaaaagttacctagtattattcaaagtatacaggaggatgtgtgtagattatattcaaatactacaccattttatataacagacttgaggatttgtggatttgggtatggggtgggaggtcctgaaaccaatcccccacggataccgagggacaactgtattttactattactattatttttcccatttttacatgggaaaaaatgtaagcatgttgcatatatgattgcaagtgggtggctagtgcaacattgcttaaattactgctggatagcacctcctttattttacatttatgttcacagtactggattctctacattttaaccattggcataattatcattaatataagatatgtttggaaacagtaattgctcgtgtatgaaattacaaacttattaaacaatattaaggaattgttaacattgttagggtgataatgatattatagtttttttttatagttaacagttgttatatttaggtggtagatacatcaatatgttcaagttccttatactattcttggttttttgtatgttcttgacattttttataataaaaaagtaaaaaaaaaaaagttagctcaagattgtttccccactttctcctgaaataatgtagagacactgacagaagaagagatgttttcattgaatctattctactaggaaagagatttttgaagtaatgtttttaaagttttactctgaaaggtaaaacagccacatgttgcatatttatgtgtttaaaacaaaaccttggatgaactaatatttttctactttgctttttagtggaatatttcagattattttttccaaagaggggaaactattgaaaaagaactaaataaggaagaggcagcacagcaaaagcaggcagaagagaaaggagttgttttaaatcggccattccaccctgcaccgccatttgattgcttgtggttatgtctttatgcaaaattgggtgaactatgtgtggatccccgtcctgctgtcaggaagagtgcagggcaaactctgttttctacaattggtgcgcatggaactttattacagcattcaacctggcacactgttatctggaaggtattgtaaaatagattggactatcagcttttaatgagtcatgcttatatattaatactttttcagttaaacttatttcttttaatttttaaagaatttccatgcatttgtgtatttgacaaaacaggaaataactgtgtcatattgtaaattgtacctcataaagagcaaattaaatattaacagccttatctctgtttctgtcttcatctcttattattatatctctcgtgatttctgcctttgcctttctgtctcctttttttcccccagttttcccaaatggtaaaaaccaggagttactaaacaacaaagggtaatcaatcccttaccatagagtagaaagcttttggggtttttgtttgttttacttttgaggtctacttatagatatgtaatttaaatataatcaaaagagaattttattaacagatgaatatcaatagcaatgaagtttatttgtagactcaccaaacaaaagtaacctccaaatggtatattgtacatgtaatgtttattcattaaattacaatttcatttttttcttcttttgaaactttctaataaaatcagcagtttattagtgatcattccctctttgctaaaagtctcatcttttttgttccatctgttccattataataaaattctgtttataatcctttcacttgcttttgtgagtttttcaaattaatagaccccaaaatgtcttcttaaaaaattaatgggctgggcatggtgactgacacctgtaatcccagtactttaggaggctgaggcagcaggatcacctgaggtcaggggttcaagaccaacctggccaatatggtgaaaccccatatctattatagtaaaagccctctttccttctgtcttgtatttcagttccatcccatagttcctcctcagatcacaaacatgcttaattctcccatacagtttgtttttaatctaatacttttctgattctaattttcctttcaagcaacttcattttttatcttcttgctgcctaattcttaatgatttttttctcacacaccttgcattgtcttattttctgtaattgatttccagactattctacttcagtctcttaaacattagagaataacagaatcaccttaaagacttgttaaagcacagatttttgagccactattgtcagccctccctgaacttgagtttctgattattttggcctggagtgagtcctgagaatttgaatttctatcaagttcctgggtgaagcttgatgctgctggttagttcagagaccacactttgagaaacacagaaattattcataggctacagttggtctttttttgtgagtgaaagatagggtcttgctctgtcacccaggcttgagtgcagcggcctgatcgtagcacactacagccttgacctgccaggctcaagcgatcctcccacctcagcctcttgagtagctaggactgtaggctcacactaccaagcccagctaatttttaaaattttttttgtagagatagtctcaccatattgccccggctgttctcaaactctaggcttcaagcaatcatccccactttatggccttccaaagcactgggattacaggtgtgagccatctccagtaattctacttttgtcctggacccctctccttacctttgtgtgtgtgtgtttttgttttgtcgtgatctctgctcactgcaagctccgccttccagattcacaccattctcctgcctcagcctcccgagtagctgggactacacgcgcccgccaccacacccggctaattttttttgtatttttagtagagacagggtaacactgtgttagccaggatggtctcgatctcctgacctcgtgatccgcccgcctcggcctcccaaagtgctgggattacaggcatgagccactgcgcctggccagctttgttcttttcttatacattaacccataaattctccattgatgcctcaacaagtcttatattttatccatttaatttaatttaattttttttttgagacaggatctcactctgttgcccaggatggcatgcagtggcatgatcacagctcactgcagcctcaacctctcctgggggctcaggtgatcctcccacctcagcctcccaagtagctgggactacagatgtataacaccacatttagctaattttgggttttttttttggtagggactgggtttcgccatgttgcccaggctggtcttgaactcctgggctcaagcaatctgcccaccttggcttcccaaagtgccaggattacagatgtgagccattgtgcccaaccttatttttttatattccatgataaacttaagaatgtataattatggccaggcacagtggcccacgcctgtaatcccaacactttgggaggtcgaggcgggcagttcacctcaggtcagaagttcgagaccagcctggccaacatgatgaaaccccatctctactaaaaatacaaaaattagctggtgtggtggtggacacctgtaatcccagctactcaggagtctgaggcaggagaatcacttggacctgggaggcagaggttgcagtgaggcgagattgtgccattgcactccagcctggatgatagagtgagactccatctaaaaaaaaaaaaaaaaaagaatgtataattactctattggtcagtttcctccaatatatagggattgataagactgtcaagtatattttttgtaacaatttgtagattcttatgctgttgctcctatgctattacttaagctatattatcaatgcattttaaatgacattttaataaatatttaggtactctttcatctactggacagagttcgagagtcctctaccactgcagacaaagaaaagattgagtctggaggtggcaatattctcattcatcattcaagggacaccgccgagaagcaatgggctgagacgtgggtattaacattggctggagtagcaaggatcttcaacactagaagatatttgctgcagcctttaggtatacgtacatttttttctgattatacaagtaattaatgttaaaagaaatttggaaaatacagacgattcttttagagtctatcttaacttagtctttatgtgtggtgtgtgtgtaagcatctgtgttttcattcgtttgtacctactgtgggctagcctctagaggatacaatgaaaggcaaaatacacgtcattcttgctatcatgggcatgaggaagtacccataattacataaataaaggcgaaatttctacaatgacgtgttacaaggagtggtactttgtgagcttcggtaagtatttgacctggccagtgaattccagatggactttcctgagaaagcaatagttttcctgagatctgtagggtaagtaggagttcatcaggcaagagtaagacgaagtgtggagagccttatagtcaatgagagaatgtaaaagagacaggagaagattgaggaaaagagatggtggatgctagcatgtttaaaggtctagaatgaggagaataagaaagagtttgattatcaaagagattgagaggtagtgaaaggccagatcatccagatcatgtagaatgtcttaggagaaagttaggaggctgggcatggtggctcatgcctataatctcaacacttcggaaggctgaggcaacaggatagcttgagcccaggagtttgaaaccagcctgagaaatataatgagatctcatctctacaaaaatttttttaaaataaaaaatcatccaaatgtggtggtgcacacctgcaatcccagctacttgggaggctgagttgcaaggcttgcttgagcctgggatgtggaggttgctgcagttagccaagatcgtgccactgcactcaagtctgcgtgacagagtgagaccctgtctcgaaaaaaaaaaaaggatttcatcctaagagcaatgaaaaaaactactgatagattttaattcatgatttgacatgatcaaatatgcacttcaaaaagatcacaaagtgcatgtcttagtgtatatgtagaatggaatggcaacaaggaaggatgacaggatgttgttggactggttaggaagctgttggttgtgtatatcagtggttctcaaacagggcctattatactcccataagacatttggcaattttggagacatttttagttgtcataactggggaaggttgagcattactgctatctggggagggtagaggcaagggttgatgctacacatcttacaatgcagcctcctataacaaagaattatacaaccagaaatgtcaatggactaagactgagaaacctggttgccgattatactactttcaattctggtggtaatgctggtggtggtagaaaaaggtgaacagagatacttttgtacatagttatgagcatgttgtacatattatctattttattatttcgtgtttggcattttttaaactaatttatgttaaagcacaagcatatttactcattccataagcatttttgtatattgttctttatgtgcacttttttctccttttttccaaaaactatttatggtgtctgatccatttagcatgttagggcttggtatatgtatttttaaatattgggattttttcatataaaatttacgtacagtgaaatgcacaaattttcactgtacatttgctaagttttgacaaaatgagcatcatttttagtaccttcatgatatttctcttaaaagctgagaacgaatagatttatatatatatatattttttttttttttttttttttttttttttttgagatggagtctcgttcttgttgcccaggctggagtgcaatggcacgatcttggctcaccccaacctctgcctcccaggttcaagcgattctcctgcctcagcctcctgagtagcagggattacagacaggcatgcgccaccatgcccggctaattttgtatttttagtagaaacgggatttcttcatgttggtcaggctagtctcaaactcctgacttcaggtgatctgcctgcctcagcctcccaaagtgctgggattacaggcgtgagccatcacgcccagcctagatttagattttttttaaatgaagacataagacagttaatgtctttgataattttttataactttaagaaatgatatttgttattttagaataagttttatatttttaacataaccacgtgcaatatataattatatctactcttttaaagggaccccttctctgacataaaatatgttaatagagaaattgcaggagtttttctccctaaatggcacgggatattctaaatctgatattaggtcaccattctgattggcaaatatagtgattcatgagacttttaaactttgatggcaacaggtagaagtgttttaattgtttgacattttaaaatgtaatttgtcaaaactcttttaaacagtttacttaaaattctgtgtttttattgtatgtaaattatacctcaatttttttttttttttttgagatggagttttggagtttcactcttgttgcccaggctggagtgcagtggtgtgatctcggctcactgaaacctctgcctcctaggttcaagcgattctcttgcctcggcctctgagtagctgggattacaggtgcccaccaccatgcccagctaattttttgtatttttagtcgagacagggtttcatcatgttggccaggctggtcccgaactcctgacctctggtgatccacccgccttggccttccaaagtgcagggattacagatgtgaggcactgggcccagccctcaatttttaataaaaagaatatggaggggaaagatgcatataactaggcaggtgttacagtttgtccagagtaggcagatagtacctattgttttataccagacctacttcaagcttttctattaaccgattgctttcccaggaatttggggtttatcccttttttaaaaaaatctggtcatttatcagctttccaaaatgaaagtccttaaaccttgattatttattttacatgtttcatagcctacttatgttgtactgctttggaaaatatcaactttcctaattttttacatcattttaatgtaggtatgtggataataatccatgttattaacaaagccagtaggcttgtttgctgtagggaaaagatctggctggacatggtggctcatggctgtaatcccagccctttggaagactgaggcaggaggattgcttgagcccagcatgggcaacatggtgaaaccctatctctacaaaaaatacaaaaattagccaagtgtggtggtgtgcatctgtagtcccagctactcaggaagctgaggtaggaggatcgcttgagcccaggagttcaagaccagactggacaacatagcaagatcccatcactacaaaaaataatttaaaaataaattagccaggcatggtggcatgtgcctgtgatcccagccacacttgggaggctgaggtgggagaatcacttgagctcagtgagccatgatcataccacatgacactctagcctgggtaacagagtgtgataccatctcttaaaaaaaaaaaagaaaaaaattctgcagctctaaaataatttaaatatgaaaactaaagtataaagttaagatttatgaatgtgacatagtttatcttaaatatttaggccaataaaaaaacatgtattatactgtcctaagttacgacttttccaatgattctctggttaagaacgagaacttcttacttaatcattaataaaggtgggtagactgaagatgttactgaaatgcttttgtttcaacctcgttgatttaattttctgttatcctttggcagaagttctgggaaatggtataaatatgtataagtacatacatattttggggtttttaatttttttttatttcagtagcttttggggtacaagtggttattggttacatggatgaattgtatagtggtgaagtctgagattttagtgcactcgtcacctacctgagttttgtttttaagattgaaacattatttgatatatccatcatcctcctcttggtgccctttgttcctatatctgaaaaatttttttactgaatttctaggttgtgataattttaattcccattgttagtaccttagtacctagtcatatattttccagttctgtaggattttaagcagaaaaattaagcaaatatgctttcaagtgtctaatatgaagagaaaatttgatcgcttttatgataatagtttttttttctcttcctaatataggagatttttcaagagcttgggatgttcttcttgaccatatacagtcagcagcactcagcaaaaacaatgaagtatctctggctgctctgaaaagcttccaggaaattttacagattgtgtcccctgtcagagactcagataagcctgagacaccacctgtagttaatgtacctgtgcctgttcttatagggcccatatcaggcatgagcaggccatttgtaagaacagattccattggagaaaaactaggaagatatagtagctctgagccacccattgttactgatgagcttgaagatttgaatctatggtgggctgcgtggaatacctggtatagaattggatctgaaagtactaagcctcctattacttttgataaactaacttttattcctagccagccttttcttacagctttaattcagatatttccagctctctaccaacacataaaaactggtttcaatatggatgacttgcaaaagttgggagtcatattgcacagtgctatttcagtcccaataagttcagatgcatccccttttattcttccatcttataccgaagcagttttgacaagtttacaggaagctgtacttacagctttagatgttctccaaaaggtaatataattttagtggctaagtaatactgcatatagttctctgaaattttttttattttgctatatatttgcggggataaattttagatcatcaagattgttttatatgtatactttgggataaactgaggattgtcaagatctaggtattttgaaaacttgtggatttctgttgcattttgaaaggtaattcatgtatgttttgaatcttaaagaagctgcctgcatcctaatgtttcacttcaccaggatttttggtttgtccacgcaagtcttcacaagaggatataatatttggaataaaagttttagtaaagtacttttataattagaaaattaataagcagtgggattatatttttttaatctgtgcttaaatttagttctgaaattattgaaagcctatattaaaaaaagaaatttataaaaagtatttttcctcatggtttttaaagagatttatttttactgtgtgtattttgttattgcaaaaaaaatactattcagataaacagatctaaaattatggagcaaattcagattagcaagcaaggctagatcaaattcaaagtgttttttagactagcaagaaaaattgatagcacaattcacagtcatcaaaatgctaagctttaaaaaaatgccaactgagtagccagccattccaacaaagtaaaaacattctaataagattggagtagatctagattctgatcacacatgttatcagtaaccatttgtgtagtgtaaattagatttctgattaactgcatcttacccaactggaatgataaaaattttcacagtaagaatttctactgtatgatgatacctcttaattacctctggaagaagtttagctgagcagtagttcttgaactgttgaaccctagttgtgttgtgcaggaaaaaagaatctggcatttaaaaaaattcagtgtaggggtattagttttctacaattgaactcaaaatacccatctttattttcaatggggaagaaaagtaattacccaccctgtccattggacatgcaaataagttgcttatagacttcaggggatggaagagttatcctatcagaaaagaaaataagacataggccctttgagatgcccgtaatctggtactctgattcagatctttgattcaggtttttatatatgtgtacaggataaacaagaaactttttttttttttcagaaaaaaatgtaagttttatttttaaaaaactctgctttagcagtgagaggaaaagtggaatcatttatcccaactactagtaatttgttcagagcttttaatagctttgaaaacagtctgaaactttggaagggttattgttgttaatttatattattttaaaattattattaatgttcacactagccattgttgtgttgtatgattacctaaatgatgtttcatagaccttgaatgtgagatttttaatgggtttctagtatctcctaacagaaaaatgtatattttattatcagagtgtttttatatttttttccacagatgtaagaaaatttttgcacaagccaaatttacttgcttttggactttatccttaaactaatagttatcgagcaaaacactttattgatagaaagctattttctttcctaagagataaactgatttctgatatcatgttttctttctaaaggggagcatttatgttgttcttcctcagtgcttttatattgtttaggacttcaagttctcagtcttctctttgttctcaaaccaccagttcccagccaagttgacttagttatatgtgctaatttatttatttatgtattgccaagttattttagcatacatagaggaactgggaatttaattatctgctttctgtatgtgctttactgtaagtcctgaagtcaggaaactgcatctgtcttattttttgctaaacttcttagtcagatggctggataccatatctgcattaatcaccggggctgccggagttgcactccaggagacagcatcacattgtatgtgaatgatgcccttggagttgtgtaacaaagccctgtcttctaaataacatgggcaagtttcttaatctttctatacttcagcctcctcatctataaagtaaaaataataagtctacaactttttgcttgttatgtgggatatttgtaaggcacttagtgcctggcatgagttaaacatccagtaaatgttagctgttgttattttcatcatcaagttctctagcaaagaccttagtacgtgccaggcactgaaaagattattattaaatgagttagtaagtgaaaccttaaacaatataagaaatcaggtgttcaatattttttcttgtcttcaaatagacagctttcaaggactaataggaaatattatctagattgcttatcagttcttagcttttggactaaaatttgttatcaggtttattctatagatttttctgatattcagacttcagaatactgaagaaaagcccataaaaactttttcttagatggagtttgttgttaaaaaattgtgggttccaaattatgcattttaaagtccccaaattgctctatatatcaactataacactattagtatgttttcttatcataaaggaccattgaaaatcaaaatgcatagttaagtcattaatttgtgttaagattcttacaaagaaattataatacttagttttctcaggtacccacataggttttttgttgttgttagacattgaaaataaaacaattcacttagagtaattcagtctctttttccacagtaattactacttgtttacttctaagagttaagatccagcaagaggttaatgaggaagaaagtagaactattacaagcagtcagtaaagagaatttttagagtgtataaattttactattcaaattcttcattatttctgagaaaaaaatattgagacatggtattagatgtctttttactactttcttacattataattataggacaatcacacttgggtatgggcagcacttgcatatctactttatatctcagtgcagttttatctaaaagttccgttatagctaaatggctacatctcctctgagggaaaataaaactaatgtgttatctaataagctaaaagccatggagtgcataaaataaattttgtacatactgtttttaaagaaactttttaaaaaagttaaatggtttgaattttggtttaagattttaagagtacctaccctctcaggcataaagtgatcatcctttttgtcttataaagcacaagtatattttagacacttcataaataatatcattaaatgtttttctcatggagaaaaatgaagacttaaacaagaaaatacgaaaagaaaaatttgtggctagaaaaaaaaacccaatttaagtattttcaacacatttgaaataattaaaatctgcagtatcatgatatgcattttattctttcttcctatcaaattatttgaagtaagaaacctagagaaactagttactatttattaaaatgttttcttatattaaaatattttattttaaatcaaatcgatatatttagatacatttcacattaaatatacacagccctgtcaaaaattaatccatacatttcttttagaaacaaattttcgtagatgacttattttcccaactgtaacacacatgattatttgtttaagttggtggaccaggcatggtgcagaaatcagatgtcatttcaatgaactgatatcacagaatttgaagtcagtgtcatcgtggtcagtcacacattcttaatggcctaatggctgtattactgaacaaatgatcagattgtagaacctgaggactgcctgggacttcactttgttggccctttttctattcttttaagaaataaatcacactgtaaaaaagaacattttttagctgattaacagtttcagcctatactttattctataacagtttaaaatagtttgtgtcctttagggctcagaaaagatggtataatacataaaataagacagtttttaagattctgtggttaaacaaatatatacacagtaaagaacttaatggagttcagattatgcattctaatgttcttattttgcttttataggccatttgtgtaggaccagaaaacatgcagataatgtatccagctatatttgaccagttgttggcatttgtagaattttcctgtaaacctccacagtatggacagctggaaacaaagcacattgcaaatgcaaaatataatcaggtaatttactgtaaattttatttactttgtaagatttcatggcttataaatacagatagttccacttaagatggactttgattatctcggaaaaggatacttttcactcacaaatatatttatacatgtctgttagcagtttaagctgaacagaaatattgtttgggaaactagttctgtgttctttttctcctcatttatgactttcctcttccaactgattcttcagaaagtttggcctttcatattactctccagtacatctttcttgaaaaatataagttcctttgtacctctttcttggttgccccatcccaatacaaaacagcttctaaatccctaagtctaatcttacttaaaacagatacctgccatgcaagatgaagaaactgtttgtactaaataagaagttgtacactactggtgtgaagtttagttggattttatataaaatatttttatagccatagttggcaaattttaactttgtttaagtaaatttctgaatgcatgcccatgctgattttgttcactcaacataaaaattataattttatatcgtccgaaagtagtttaaatatgtattaacttttctcattctatttgtcttgcaacacaatggaatcacaatagatccaactatttgcaccggtgagttaaatttcctaaaattgtcctaacctcttggcaacaaataaagtacatctttcccggttcttggtagaatgctgtatgtgctttttccaatagttttaatttttgcctggctgaaaattatttttttcatgaagtacatatctctttgaaaactttgcatgtaatataatctgacctaaaaccaaggcctgaactttaagacaaagatgctttctctttgaaaacaatatgattaatttaatctcagtttatttttaactgcatgtgaaaatattactttctaggcggaatgggtagccttgaattatgtgccgtttgctgaaaggtctttagaagtagttgtggatttataccaaaaaacagcgtgtcacaaagcagtggtgaatgagaaagtgctccagaatattattaaggtatctttttttcatttctacactttcattagatggtgtgaacattattgaaattattccttaggtaatacattatcattatattgggataaatagaaaatacaatttgtagtattatttgtaatgacttttctccaatattcatgaattgtatttagcaagccatttttctaaaagttctttttagtgaaaaatattttaacataaatatgcattaaatttgttacagttcttaatgagaacacatggacacaggaaggggagcatcacacaccggggcctgttgtggggtggggggagggggagggatagcattaggagagatacctaatgtaaatgatgagttaatgggtgcagcacaccaacatggcacatgtatacatatgtaacaaacctgcatgttgtgcacatgtaccctaaaacttaaagtataattaaaaaaaatttgttacagttcttacattttcccacataacccagtgagggggtttcttaggacaatattcctcaaggttcaagattgatgagcattcagagagaaattcacaatgcagcccatacacttaactgaacatgcatgctgacttttttaaagccacttttttagtatatggacagccatttaaaagattcttgttgattgtgttccgttcctctaaggcttatttcttgtttttccctctgttttgaaggactagccctaaaccttgttcttcctctagcatgtggatgtaccttatattgattgtataaataccagaccaacttgagctgtcttctctaaagactcatctatcccaacctttcttcattggtgattattttcatttttctttcagccatctcatacaaggattcttaagccttggatactacaagaattttctctcaactgtacttactactcaaattgtcatcctctttcagctttcctttatttccatatcccttaaacagtttgtggccttcacctagtcaccactcactctttgcctgttgtgtgttggcttacgtccatattgctccacagaaactgctttcttaaacttacaaaagaccaaatcttcatatcctcagtccttctctaatgatttatcttccctatagcatggtactggccttctgaaacctgagccttctgaaagctctttcttcccttgactttcacgatacttttctctcctcactgcttacctcaccaaaactatcctctcactttatttattgagcatatttttgaagcatctttctacaaggtgctagcaattttaaaatgaataaaatgattcttagatttaataattcaatatggagaataaagaaaggcaaacaagtaatactacagtatgttaagtgctaggtaaagaccatagtggaggctttgcattcagatagcctgacttcgaatagtccactgttactggcttactgctttatgacttttggcaaatagacctatctgagcatgtttctcgtctttaaaagaaggataataccaatactacttacatgtcttacctataatgagagaatccattgagatacagcatttaatgatgcttgccaagtaatcagtgctgaataaaaattgagttcctctgaaagacaaaaaactaagtcaactgctgaggggatttgggcaagaattaatagagatgacacttgaaaaagttaagagttaggttaaaaagggggaggcaggtattataggtaaattaagccgtgttaaagatcatggtatatttttaagaaatgttgagaaatttagttcagaacctgggatatgtctgaaaacataactgttggtcttctaagccatcataagatcagactttattctttaaccattgaaggattaaacactacaaagtaatatgaatcagtttgtgtatttttattttttttagagacagagttttattctgtcacccaggcaggagtggagtggcataattatagcttattgcggcctcaagctcctgatctcatgtgatcttcctgcctcagcctcccaagtcgctgggactacaggtgggcaccaccacccccagctgatttttaaattttttatagagactggatcttgctttgttgcccaggctggtctcaaactcctggcctcaggcagtcctctaacctccttctcccaaagcactaggattgtaggtgtgagccactgtgcctggcctcagtttatatatatgtatacatcttttttcttttttttgagacagactcttgctctattgcctgggctggagtgcagtggctcagtcactgcagtctccacctcccgggttcaagcagttctcctgcctcagccccctgagtagctgggaatacaggcacacaccaccacgcatggctaatttttgtatttttagtagagacggggtttcaccttgttggctaggcaggttttgaactcttgccctcaagtgatccgctcacctcagcctcccaaagtgctgggattaaaggcatgaaacaccatgccgagccactcagtttgtatttttaaaggagttaaatgatctcttttctataatcccatttcattgatgccacttaccacattgttttgtggttaattggacaaggctctttctccaaaattgtgaaccttgtggtgacaggcaattactgagcacatactgtataccacttcctgtttagatgtgtaaacatttttaaaaataaaatatataaattgaatggatctgctatgcttaatgtttttcttgattttaataaaatatcaattgcagtagcaaaccatacttttcttttatcttagcttgagttataaaatgtaaactcaaaatggccctatatcacttagtattcttttggttgcaaatgacatacactcaggctctgactagctttaacaataaagggaacttttgggcatgcttaattggaaaattcaaagatagaggaaggccattatgactggctgatccagtggttcagcagtatcatcaaaaaccacatttctttctccagaaagttctgctaagaattgaccatatcgtttctcttcatagctgtaggccagtaacaagattatatgtccaataggaagagagagaggaagagagagagtgtgtatgttcctgcatacacacattcacacacttctattcttcttcttaagttcctaaaattaatttttagtggatcaactttggtcccatacccactcttgaaccaatgattatggccagggaaattgattggattcattggcttaatcaactcatcatctctttgcctgaattcccaaactggaagtagggacagttcctcccaaagcacatggattatatggaggtggaaggaggggaaggggataaatagattctgggtgtgctaattatctgttaatgaaggcacatttcaagctaatatgtaatggttaatatgtatattgtatgagtattcagtaataatttgtgtggaagatgatgatatttggttttatgtccttgaaatatgaaaatttttctacttttagacccaaatttttacgtaacagcagaatttttactctaatgcaaattgcctgacagtatgccaaaactgtttgtcagtggtgctgtgtgttagttcattatgatgttttggttaatctagtgttctaattgcaagatagaactgtgatcagagaaattcattctgaaccaccaaattagttcttttaataaataaaagccacctgtctcaaaagttgatcagttgaaaagagaagtcactatacttagtcactatatatctagtcactgtacatgactcaaacgctctactcctgtacccctcaatggtcaaatcttaaattatcagttttactgaactatttggagaaggaaaaaagtacacaaaaatagaagtaaaaaagtacacaaaaatattagagtaggatataaaattcaaataattttacagatagaacatacaacttcaaagtattgacattttatgttgtgtttactcttccctcaccattagtgggaaaatacagtcatgtactgcttaaggaccgagatacgttctgagagatgcatcattaggccgtttcatcgttgtctgaacatcatagtgtacttacacaaacctagatgatatagcctacttcacacctatgctatatggtctaacctatatatgtggcagatgactgcataagcaatattgaccctttgcatatgggatatccacatcagccaaattattttttgctggaataactatggcagaattttctttttctttttttttttttttttttttttttttttgagacagagtctcactctgtcgccgggctggagtacagtggtgtgatctcggctcactgcaacctctgcctcccgggttcaagcgattctctgcctcagcctcctgagtagctgggactataggcacgtgccaccacacccagctcatttttgtatttttagtagagatgaggtttcaccatgttggcccagatggtcttgatctcttgacctcgtgatccacccaccttggcctcccaaagtgctgcgattacaggcgtgagccaccacgctcggccagaattttctaatccataacatcgggttaagaaaaggtacagaattgtgtttccttctcttaacttttcagataatatccctattatttatgatgaaaaactgaggttcaaaaatgttatttatgtaggctcattgtttataagatagagataggatttaaaagtatatctttccaggcagtatttgaggactacgtctgagaattggcctttctgcgaaataacatcctttttaaatgaaaataccatcctttttaagatgaaaatacctatgctattttttctctgctgtagtttttcttaattaaaattgtgtgtgtatgttttaattaatgcttatattaaactgtctttattttcagactcttagggttcctctcagtttgaagtattcctgcccttctgaaagcacatggaaactagcagtatcctctctcctcagagttctttctattgggctacctgttgcccggcagcatgcttcttctggaaaatttgacagtatgtggccagaactagccaatacttttgaagattttctctttactaaaaggtcagctcattcatttttaaaattaagacaagaagtggcacattatatcttcagttgctctaaaaacagttgtctttattcattaacaaagtaattgattataaaggttgctagattgtattaaaaacacacctgaattagccatttatccattgggtacattatccatgaacaatggagatttttgctttttgtatttttgcttataagacaggaatattatatataaaacaatacaaatgcatcatatttaagaattttaacttaataaaactaagaagattcagtttttaatttgatgcccattgggcattgcaagagaaaaacaatgttagaaaatcagtgtattaccagaataaataggatgagtggcaatataatgatcagctctttaagatgtttagatttgtcaaagattaacaattttcattgtatggtatctaatttaaagcttgtatttaggatgctatttcaacccctcactgaactacttactgtaggatgattggaacacagactacattttttgaatgaagaatttgctgaggtccatctagagttgtgctattcagtacagtagcaattgctagttacaaatgactaattaaaaccaaactttaaataaaattaaaattttcttcagtctctctaggcatgttttaagtactcattgccacgggtgactagcagctgccacactgggtagagcagattattggacatttccatcatcacagaaagttgtgttgggcaggacagatttaaagcgtgcccttttactaaatgtggacttgtctgtaatagctgtaatagccaggcagtgtttaatccttctagcacaagtaattatcgtttgtgttacattggtgaaattcttttctgagacagagccttgctttgttgcccagacccaagtgcagcagtgtgatcacagctcactgcagcctcgacctcccaggctcaagcaatcctctcacctcagcctcctgagtagctgggaccacaagtgcacaccaccacacctggctaattttaaaattttttgtagagatggagggtctcactgtgttgcctaggtgtcttgaactaacttctgggctcaagtgatcctcccacttcggcttcacaaagtgctgggattacaggcatgagccactgtgcctggccaattttttaaatgtttgtatccatcaatcattttttgatattgtagaatgataccgtgtactgctaaataaccatttaacattattagtttgaagccacttaaattatggatttgatgtacttgaagaaaaaaactacattggcatatggataatgattgagtcccccacagaatgaattaactgaaaaaaattttctttactattctaatatggtttagttattcagtaaaaaaaatttctagggtgcagaagattaacttgcattttcccagtaaaagtttgtcttatagttcagaatttaaaataataacaggtgatcctaatttctgtcttgcaagtggtcagactttgttttgtagtttatgtatttttcacttctagaaatgttattgataccaatgtaagcatactctgtttctgaaggaaaaattataggcgctcataaactatattcaaacaaattatgttttcatctttaaaataactctgaaaatttgagttccttcgtagacataagagcctgagtcactgttaatttgtatcaagcacataggttgagaaatttacatttttccttttattttctaattgtctatatatgcttaatgcccccattaacaaattgaataagctttcagatcagctttttttttttttttgcaatgagtaaaacttctttaagtattgctttccctagcaaggtgtggtgacacacctgtaatcccagctactttgggaggctgaggtgggaggattgccgaggcccaggagtcaaatccagcctgagcaacatagcaagatcctgtatataaaaaaaaatggttttctatgtaaaataataatattttatataattttgtattaatgcagttgtagtataatttcatttaaaattttagctctaaatttggaggtttttttttgcttgtttttgtttttcttgagagtttttctgccatcttccttattcttgaatttcttattaaatattcttcactttctggactttattcttattttattaaatcccgttttctgaagttttttaatatagaaaagtggacactggaaccaaaggccaaataatagtattttacataattttgtatcaatgcagttgtagtataatttcatttaaaatattttgcctgattatggctctacttaccttaaaggtttgagtatgtttggtgtgttggaaaatacattacttaagaagcagccagcatagtggataagagcattggcttggcaaccagactacctggattcaaatcccagtagtactactttgtactactttttagacaagttattaaacctttcagtgactcatttttcctcatctgttaaatgtcaataataatgctccctaacttacagggttattgtgaggattaaatcacttaaaatgaatgaatgcttagaatagcacctggcatgtaagtactttaaaatgcttgtttccactattattgtcattaatgttttttctttcttttaaaaaaggtgacattatccatattaattcccatgaaacaactattattttaaaccaaaattctaaaggccaaaactctaaatgactgagacttggaaatttagctctaaatttggaggtttttgtttgtttttgtttttcttgagacagtgtctcgctctgtcacccaggctggagtgaagtcgcatgttcatggctcactgcggccttgacctcctggcctcaggtgattctcccacctcagcctctcttgtagctcggactataggcatgcaccaccacacccagctaatttttgtattttttttgtagagatgggattttgccatgttgcccaggcttggagttatttttaatggctaaaaataataaagcttctaaattcagctctcaagtaacacagtatcagtattctaagttatggttattctagttacagatttaagctttctactccatggagtagttgatgaacaccctagattgagagtcaggagacctgtgacctggtcctgacttgctgtctactttctgttgatcgtgagctggtcctttcccatcactaggcattattttctttatttgaaagacaaaaagaaggccaaccggagtacgtaatcccagcattttgtgaggccaagttgggtggattgcttgggcccaggagttcaagaccagcctgggcaacatagtgagactccgcctctacaaaaaaatttaaaaattagccagatatggtggcatgtgcctgtagtcccagctacttgggatgctgaggtgggatgatcacttgagcccaggaggttgagattgcagtgagctgtgactgtgccactgcactccagcctgggcaacagagtgagaccctgtctcaacaaagaaagatgaaaagttatttgttggagtaattgtaaaggtccatgaatgtttaatcatggacagcttatactggataaagccagtttagtttttgtttcatagttcaaaaatactttaaggctcaaattgaaagcttttattggtcagttgatactaaaagtgcagtgttaagagaacttaaaaaccatgcacattttcagtttcataacaggttttctctttgtttttattttctaaataattgataactttggaggtcataaacttttagattttaaaccttacttaatgccacatatgtactatgttctatagctgaagtttatcagtagtgtttgaacagtaggaagattgttttggaaagttgcttggaatagcaagacttaatgaatttaaataagactaatacttgattattttttatattggtacctttataaatcctttaacctaattaatacatactctaagactttaagaataaacatatctctgtctgtaatattccccaaactttttgatctgcaagatgctttggcaagggaatacaataacacagaaaatacaaataaaatgaactagcagaaaagaaagcctttgcatgtcgttgagggctataagtaaacagtttaagagaaagaaaaagacaaagttgaaaaacacaaggactgcaatttggtagacacttgaagtctattagaaattcatttagccaactttgagtaccaaaacatggtagttataaaggagacacaatgggtgagtgggaagttacacaatctgtggaccttatattaaaaatcacaaagtactgtgcaaaagaattgaaaacacatgtttacacaaaaacttgtacactaatgttcatagcagtgttattcatagtagcaaaaaagtgaaattgaatgtaatatattcaatattcaatatattgaatgtaatatagtagcaaaaaagacaaattgaatgtaatgtattcatacagtggaacattattcagccataaaaaagaatgaagtgctaatgcatgctcaaacatggatgaacatttacaacataatgctaagcggaagaaactagacacaaaaggctatatattgtatgatcttgtttatgggatatatccagagtaacaaatccatagagacaaagtagatttatggttcccaggagttgaggggaagggagatgagggagagtgactgctaatgggtacagatctttttgggggggtgatcaaaatgttctggaattagaaatggtgatggttgtacaactttatgaatatactaaggaacactaaattgtatattttaaaagggtgaattttataatatatagattatattgcaacaaaaattttaatatgtcatacagagagaactgacaaaatacaaataacactttataagtttgaaggctcttttttattttaaataaagattcatgaaaataaatttttaaagattactgtagttttcaaatttaaggaatttaagatcttacatggcttatttgtaacctgcagtattgaccattgccccttataatttataggtaaattctgttagtcagcatttttaaaagctcaatcgatgtttttgatatgtttgctagttataaattaaataactattagttatccagtttttagttttgtatgctactctcttccctcatcatatgatattttaaaaatctagttcagtgtttctgatatatgatccaaatagtattaatattattaatgtgttgaaataaacacactaatacaccttagcacacagtatacacactaaaagtattaatattgttagtgtgtatatttctataaacactaataatatagaaatatacacactaataatattaatattattttattatttttgcctcttcattttttgttgatcatcaactcatccttagttacctccaccatcatcacaaatcttttaatattactaaacccttaccttccttggttataaattaaaattaaacacaacttttgtctctagagatgcagatatagtctgtgaagctgctttgatggcagtgattgtgaaattcctctgattggttcaggtttgggtaaatttctttcagtttttttactctagttcctactaccaatttatagttagcttaggacttggacaccagaatctaagttctatgagaaatggactgagtctgtcctgttcacagctagatcttgaacacccaagaatataatacctgatgcaaagtagttggtactcagtagatatttgttgaatgaaaaatgtccaaatcaaagaaaccacagtctgatgcccatatattcctatatacaaaattgtacattatacttaatatacagaagtgtatattaaacctaaatgttctaatactatttttacatctacaacataaaaaagaataatgtaggctcaaatatcagataaatctaggttgagattgtggcctcatcatttacttaaagtgtgttcttgggcatattagtaggcattctaagtttcagttccctcttctcttgattatataataattactacatggaattgctatgggagattaatacaaataaagctcatagtactgtggctgtctaactttttagctgtcattattctaacagttattactatcctattctcaactgtttttaaatagtatcttgctgttttttaactttatgtccattttactgttcactcttatgagccacagagtctggaatccaccttggttctctcagaactattgattttctttgttcttgttggaacaattttctgctttagaaaatctgcatcagtcttcttctttacagattttccctctttattgtaaagatctttaatccattgtatttattacaaattaatgattaatggactgtctctgagtgaataattcagcagctgaactaaggctgtcttaaataaccaccaatataagtgaattcaggtaacaccacaatggtaacttttgctctgctgcagatgatagctctttacctttcgttgttttttcattcataatattgaaataagtttagttctacagattttatttagttcaagattggacctagtgtttttgtagttagagtatcatgtttgtaattagcttagtcatttaaactaatgactttaatttacaacattactcttttaaataaataataatgccccaacctgggttggaagacataattttttgacatttgaatactgtttttctattttgtttgtatttgcagggaatattttatctttaaaaatcaagtgtttttttttttttagcatacctccagataatctctctattcaagagtttcaaagaaatgaaaatattgatgtcgaggtaaggaggctatttaaaatgttttcctgtgaccatttttgaaaccaaatagtaaaaatgtttgaactatacagttgctgaaagaataaagtaataggttaagattaaaactgaaagcattaaaactcttacaggttaaacgttgatgtttaaaggactggcattttaaaagtgacttccttagatttgttacagtcttgtgctttgtgcgtgttgtcccaatacttagttgtgttcatttaataagtttaaaaagagtttattcgatgaaataaatccatcagtcaggaggcatatatttgagagcttactctgcagtttgacataccagatgtttctggttcaaattaatcagaaagttgcttgaatttttcagtttttaatcagctgtatatacagcctatggaattcttaaagcaaatagtgttttttaaagaatatattttgaggctgggaactgtgactcgtacttgtaatcctagtgctttgagaggctgaggcaggaggattgcttgagaccaggagtttgagaccagcctaggcaacatagcaagacaccatctctacaaaaaaaaaaaagttttttaagttaattgggcatggtggttcacacctgtagtcctagtttctcgggagactgaagtgagaggatcacttgagctcaggagttggaggctgcagtgagctacagctgtaccactgtgcttcagcctgggcaacagagcaagaccctgtctctgaaaaaaaaaagtaaaaaaaataagtaaaaaagtaagaaatatgttttgaggattataaatggaatttaaataagcagttcttgtggttgtggatttttttgttgatggtagggttttggtggtttttttcctttaagtgggatagaggaacttttaagtaaataaaatcaattacattactttaaaatatacatttggccgggcgcggtggctcacacctgtaatctcagcactttgggaggtggaggcaggcagaccatgaggtcaggagattgagaccatcctggttaacatggtgaaaccccgtctctactaaaaaaaaaaaaaaaaattagctgggcgtggtggtgggcccctgtagtcccagctacttgggaggctgaggcaggggaatggcgtgagcctgggaggcggagcttgcagtgagccgagatcacgccactgcactgcagcctgggtgacagagcaagactccatttcaaaataaataaataaataaaatatacatttaaaatgcataggcattatcatatggaaacaaaatattgcctttcgtgccattactgtattaaagctcttgtggactttaaagggcaaaataacatactacatgttagagataaactatttgacaaaaatgaatataactttaatttctcttacagctgatagtttttggttataaaaagtgatttaaatgttattcttaatcctattttgaatattttaattctaacatgggtaaatttcatatgctatttttctctagagccctatttgcagttatcatgctgaagatcaacatttgtccaaatggttggcatagtaaacagttatggtactgactattttgtattaaagttactaggacagatgagagaaacagattagtagtcattctgtatgttaacattaaaatgtttgtgtacttctttaaaggagagttctttaactgattttcatttaaagtaaaatttaaattttactctagaaattattttagtctctttcaaagaaaacaatacatttgcatttgcctcttttgttttaggtagttcaacttatcagcaatgagatactaccttatgccaattttattcctaaggaatttgttggtcaaataatgacaatgcttaacaagggctcaatacattctcagtcatcttcatttacaggtatgttaatttttttaagtattaaaaagtattgaagtacttttgaagaaactgtcagtagaaatgtttaatcctatgattttggtaatgtaaactggagaatggtaaggtgatttttaggattgtaatatagaactaagctttatgaggagaaatgttatgacatgactattctgtggaatagaatgtttttattccatgtttctattctgtgaaatactgtgtttctgatcatatatcagaaacactgaactaaattttttaaatatcataactgcaaactgtgaagaattaaattgcaaagcactttatggaatccatggatgtcactgcaggctgacagaagttaccagttttgtgaagtcatagattggaaaggaatataaaaatatgaatgtatattctgccacttagcagtcaattaacttttgagtctcagttttgtaatctttaaaatggagatattaataccatcttctcaggactataaattacagagttcatttaaaaaaataagatgcctcaacattttttaagggaattaacatttactcagtgccaactatgtacaagatactatgctagaatgttatattatttctcacaacatttctgtgaggataggtaagaccatattacaggaaagaaaattgatttagaaaggttgaaaaaattgctcacaatcttagggctagaggccaaattcatgcttaaaaagaactacatgcttcttttcattatatcatgctgccttaattgggaactgatatataaattactgtttgttattaattctctttttgtaaacctgagctcaagtcttaaactgtggcatcagccaggtgcagtgattcatgcccataatcctagtgttctgggatcgctaggtgggatcccaaggtgggaggatcgcttgaggccagtagtttgagaccagcctgggcagcacagtgagactgcctctgtctctacaaaagattttaaaattagctgggcatggtgacacatgcctgtagtcctagatactcgggtggctgaagtgggatggcttgagcccaggaggccgaggtgacggagttatgattgtaccactgcattttagagtgcactctgggcaacagagcaagactcttgtctcatatatatgtatatatgatttaaaaactacattttgggaggccgagacgggcagatcacttaaggtcaggagttcaagaccagcctggccaacacggtgaaaccctgtctccactaaaaataattagccaggtgtgatggcatttgtctgttatcccagctacacaggaggctgaggcaggaaaattgcttgattcgggaagcggaggttgcagtgagccaggatcacactactgcactccagcctgggcgacagagcgagactgtctcaaaaacaaaaaagaaaaaagaaactgtaaatttgtgccatgcagatccttaatcctcagaatttactagagccttaactagcttctcctattttgtgctgagcattttaaagagcatttatgtgtacagtttgaccactagatgtctctcatactgctcacttcacatactagttcttttttctagcccaaacagtttttaaaactggcctggtaaagtgtgggtttagcaaacatgagaatctcggggaaaattttaaaccccgcttatcttaatgtagccaactttttattattaagagtatgtgaaaatatttaacttttaataaaatacacattaagaacaatattcacaattaggtataaatgtccaaagttaaataagggctattgagttaccaagtatacttttactggcagttttctgataatatatcttgctatgtatagtattaaatttaccaagacaagaaaggtgcatggacattctttcagtgactttgccatatgacacatgtcttctcagcactaacttggagttttccaacacctgggaagcttcacgtgagagtccttcaccaccacaacaatgctcctgctcattcctctcatcagacaagggcaattttgtaagagtttcagtgggaaatcattaggcatccactttacagttgtaatttggctctttttgttttctttttgtttcggatcttaaaataccattgaaggacagcctttttcttcagtcaataatgtaaaaaagacagcattgacatggttaaattcccaggacctcagttttttacagataaactaaatggctggtatcatcgcttacaaaagtgtcttgaacttgattgagcttatgttgaaaaataaagtttgtagttttcattaaaaaaaaaaaacttagagttttccttaaacatatacatacaaaacttttatttgctaaacaaggccaacctgtaaacacagaggttccagtgatgattggccttttgcttttaagtatgatctgatagtcagagctcacagacatttgaggaaattctctaacaccaaagagaaagaccaaaacaaatgaagagagagtaaaagaaattggaaggaaacagataaaatgcagagtcactgaaaacataaaaccagttaggatgatcaaagagataaaagaacaatttaaaaaatgctacataaaaggagcagtagaaaaagaaagaaggctgggcacggtggctcaggcctgtattcccagcatttgggaggccgaggcaggaggatcacttgagcccaggagtttgagacaagcctgggcaacatggcaaaaccccatctctacaaaaaatacaaatgttagctgggtgaggtagtttatgactgtagtcccagttacttgggaggctgaggtgggaggatcacctgagcccaggagaacaaggctgcaatgagctgtgatcacaccactgcactccagcctaggtgacagactagagactctgtctcaaaaacaaaaaaaacaagacgagaaagaactcatagaaactaaagatgtggagttcagtgaaaggtagaaaggagaagtaaaatgaatccagggagcctaacatctgacaaagagagaacaaagaaaatctaggagaaggaattatcaaagaaataaactgaagaactgaagaacaaaacttccagattaaaaatagtcagtatcaaaaacagtgaaagaaaaaagacccaaatcaggcatgtcattatgaaatatcagaatacctgggataaagagaagaccctaaaagatttcagaaagaaagaaaaaaagttcagtataaaagacattggaggccaggcacagtggctcatgcctgtaatcccagcactatgggaggctgagatgggtggatcacttgaagtcaagagttcgagactgtcctggccaacacagtgaaaccctgtctctactaaaaaaaaaaaaaaaatacaaaaattagccaggtgtggtggtgcgtgcctgtaatcccagctactcgggagtttgaggtgggaggatcatttgaacctgggaggtggaggttgcagtaagctgagatcatgccactgcactccagcctgggtgacagagtgaagaccctgtctcaaaaaaaaaaaaaacaaaaaaaaaaaacagacagtggaattctcagacgcagtattggatgctaaaagacattgaagcagtggttttagagttgtaaatggaaaggacttttaacatggaagctccatgttaaaactcatactgttggccaagtatgagtgtaaaacagtaattctccaatttcagcatgcatcctaatcaaccagaggacaagcaattgctgagttgtaccccctgaatttctgattcagtaagactgggaggcatgtgaatttacatttctaacaagttctctggtaatgctgatgctgcagggtacatttttgagtaccataatatatgacattttcggaggtacatgcgctcaaaagttttacttctcattgattgtttcttaggaagctacttcaaaatatgctctgtaaaagcaaagtagtaaaccaaggaaaaataaggcatgaggctgggtgccatggctcacgcctgtaatctcagcactttgggaagccaaggctggcggatcacgaggtcaggaaatcgagaccatcctggctaacacagtgaaacactgtctctactaaaaatacaaaaaattagctgggtgtggtggcacgtgcctgtagtcccagctattcaggaggctgaggcaggagaattgcttgaacccaggaggcagaggttgcggtgagccaagattacaccactgcactcctgcctgggcaacaagatgagactctgtctcaacaaaaaaaaaaaaaaaaaaaaaaaggagatcttggaagtgggatctaacttgagagaatggaaacaatttccagagtgatggcaaagactagtttcaggatataacagaacagcgtgtctagagagcaactgccggactggagcagaggtcacgttccaggaaagaagttgctaggagagggaaaaagagagaaaaagagaatactgcaagtttgaccacatgaaaaactattgtgaagtatattttacagtgctgttttatggtatagaaagaccaaatcaagaaatatgttgaatagaagtgatgaggatcttgccctgtttttgatcttgtgagggggaatttgtttctctctacatgcgcacacacacacacacacacacacacacacacacacacacaaaacaaaaaaaaacaaaaaaaaaacacattttcactatatgtatgctattagctataggttgttctaggtgcctttcaccagattgaggaatttctctctattcctagtttgctaagcattgttatcattaaagctcattgatttaacttctattaaccatcaaaatttgttaattttacagaagcagagattgatattcgtttgagagaggaattttctaaaatgtgttttgaaacattactccagttttccttcagtaataaagtcacaacacctcaagaaggctacatctcacgaatggcactctcagtgcttttaaagaggtcccaagatgtactacatcgctatatagaggatgaaagattaagtggtaaatgccctcttccaaggtatatatttcattttattaaagaaataaatgtattgttgtactaattgttgataacaaggaaaactctgaaaagcaagtgtttttgtaagtgatctgaactaagctgaagttgtttataatcttatttatcccatatggtgtaaatattcacaggttttcctgcagatatattaacatgttttgttatggggtgcttttttagatccctcatggagattatgtaacatatgatacataggtaccaaattacctttttgaattaaaaaaaaataaactgaattccaaaatatatcttcttccagagatttctggataagtacttgtggatctctatgagcacatgatattatttctctaaagtgaaaatcataaatcatattttaggaatatcctagtttgttttacagtcatttgcaggtttctctctgtgtcagctagcctgatcttaggtcttcttttcatccaatctgcttagttaagcccatggacctaaactgatttatttctcatctgttcagcctgtgtcagtggaaggtgcactaggcttttctgatcagccaaggctaatcagagttggagtacagaccagaattcaacaaaggatacagtcataaattagggttaggtttgcaaatacttttataatgtggaaattagagtttaaggcataactaatgaagcaaacagaaaataacatgggaaaacaaagttatcaaagtcaggaaagacgaaaatcattgttcccgtctcataaggtaggactggagaggcaaatcaccagtgttaaatctttgtgcacattttaatttacttataataaatttctgaagttggaattgacctgtcaaaaggcacagacattttatagcttttgatatgcattaaccaaatttcccaacagagatttataccaatttacattctcccaggaatgtgtgaatgtccctttcctcaatttttagcatttttaaattatttgccagtttatcatttatctttttctaatttgatgaatgaaaaatagtcatgtggtactttgctttcattttttaattaccaatgcatattagctatttgtatttcttcttttaggatccagtgtattttgaatttctagaacttaaattataactccttatactcaaatttatacacaaaaacactccaaagacagatgttagtaatttggctatgggcatgattgaaaattgatttctgaagtatacttggaaatgtggtaataaggttgttttgagtggaatattgttagaacatatttatatattataaaatattatttgatttcagaagaaaactttcaccttattttttaatgttctaagtctttactttttaactactacctttaaattgagccttatttataattgtcctatgaagttatattgtatcattctgtgtttgttgcagtatcatttaattgttttgtaaaaagctacattgcaacacaataaaatacttcaatgcttacaataggaagtcttgaaatagtatcctgacatggtattagaaagtcttatctgcagaataacacaaatgcacaccaggaatggggagggatgagggcggaccagagaccagaagagctttgtttttatgaggagaaagaagggaatcacgctactcttgttgactctttactccaagttcattcttcattgctaatgtctccaaatagtgctaccttaggattgatttccagaatgtttcttgtttgtattattagaaagttaaataagtaccattgtaattttgaatatactttcaacagcatggtagaatatatgccatgtggtaatagtagtctttgtttccatttaagctttggcaaatctcttttagtactaattagtttaaaaaaaaaaaaacttgtagagaagttttaaaagcatgtattataaaatgttttaagggcagggcacagtggctcatgcctgtaatcccagcactttaggaggccgaggcaggaggatcacttggcagggggatcacttgagcccaggagttcgagaccagcatgggcagcatagcaagcaagaccttgtttctactttaaaaaaaaaaaaaaattagccagacaatgtggcatgcccctgtagtcccagctactcgggaggctaagtgggaggatcacttgagcgcaagtcaaggctgcagtgagctgtgatctcaccattgcactccagtctaagtgacagagcaagaccctgtctcaaaaaatcaataaataaaaataaaacgttttaattttaagtagttatgtgaaatatcttacaaataaatttaatttttcaggagtagattgccccacctctttattaattgataagtcatggcaagaataactacaaatttgatttgcacactgaagtacatataaataaaatgatttttacttttatatgaatttaaaactaacattaaccttgcattgtattgtgttcagtatttttcaaaagttcatctatttgtacaaacttagtttaaaaaacaaacatacctggcaactttaaaatcttaatggaaatgatttcctatctctttttcaggcaacaagtaacagaaattatatttgttttaaaagcagtcagtactcttattgattcacttaagaaaactcagcctgagaatggtaagtgcttagaaacagttattctaaattcgtaacatttatgttctatttgtgatggacttttgtctgttaatttaactgaattataggaacatagcagtcattagacttcttttctccagttctcatgacaacaaagcatcaagtccattaggatgtcaattaagtaaaattaatttgtgatgttttcattttttatgaagcagtctaccttacttttttttttttactatattgttctgaagtcaggttattgcaagaataatccatatttcatatatttttaatgtagaagataattgacttatttggggacaggtggaaaagggctttatcatctattcgtactgatttactttgcagatacaaactgtataaataactttgaatcatttttaccattctttctcatttgtttgccctttctgttgttcattcctgtccagtccattctttacatgatagccggaaatgatttttccatagtagggctttgatcatttatttcctcatcctcccaaagcaaaaaaatatttttcatttaccgtttcctaccaaattgcaaagaatactccagtctgactccattctagtcacactttatttcccacaatagatttcatttcccctactctgcactaaactaaaattctcaatcttcccaaattttttcaaccttttgtttatttcattatccagcttgtatcagcctatttggaataccaccctacttttaaaccttgtttttaatctcttaaaggtaaataatttttcttttcattgaatgcaaagcttttttatgtgtacttgtctcgaagcactctatttgtattacaattatgcatgtacatgactcatctccctttacattgttaagatttttgaggggcttttcagaccatgttttgttctattttgaatcctctacaacattgcttttcaaagtatggtttgttggaccagccattgattggcttcaacagttttgttactggtctgggacaagatagtgagctggcatcagaatataaatcagatgtgtcactaaacacactgcttggttcagctgacttttttttatacaagaagacattggtaaagaagaaaactgtgtgttggtttacattctggcacaagcttcttattttgtagcagattggcaccttaaggagcattacttttaatatccaagaaaaaagtagattcctagtaaattactaatgaatgagttgtaggatatttgttcctgtcaactattatataagtggagtaaatacatatttttcttttgttaaaattcacccattggtactttggcctagaaagggtattatactaaatcttaagaggcagtacacttgtctttattcaacccaaagggatggatggaatttctaagaaaaagcctggggcagtgtcctgaatttatcccattagagttcagatttgggttttcttcaaaaagtgtcctgggctggcacagtggctcacacctgtaatcccaacactttgggagcctgaggtgggaggattgcttgagcctaggagtctgagaccatcctggacagtgtagtcagaccccatctttaaaaaaaaaaaaaaaaaaaagaaccagaatgtgtataaagggagaaaaggaagcaaaaactcagtaactcttttttacaaagccaataggttatatgtataaggcagtgtagtaatagatgatctaactaaatgaatgttaaaaaattgttgaatggagtttgaattatgtctctgggtctatgaagtgaaaatttaaattgaatgtaaacatataagatgatataacattttagaaagctgtggtaagctttattaagaaaaagaatgacttcattatttgttttggggctttttagtgagagaagatgcatttgttagacttatttttgtttggggagattttttggtttttgtcttttttgagacaggctcttgctctgtcgcccaggctagtgtgcagtggtgtgatctgtgcttactgcggcgttgacctcctgggctcaagcgatcctcccgtcttagcctcccaagtagctgggactgcagatacgtgccaccacactctgctaattgttttgtattttcagtagagatagggtcttgccatgttggccaggctggtctgatacttctgagctcaagcagtctgcccaccttggcctccgaaagtgctgggattgcaggcatgaacaaccgccccccagccaagattttgttttcatcattttacttgatctttatttaaaattttaaataggtagtatacatatacatggtccaaaaatccaaaactgtaaaatgatatacaggggaaagttttaatatgatcttttccttattctctatctgcccagttcttactttaccacagacaaccatttttattagtttgtggatccctccagaagtttattatctaaatacaaagtacatattctaatactcccccatcccggttttgtacacaaatgaatatttgtacacaatgaattttgtacacaaatgaatatttagacagagtcttgttctgttgcccaggctggagtgcagtggtgctatctcagctcactgaaacctccgcctcctaggtttaaacgattctccagcctcagcctcccaagtagctgggaccaccacgtctggctaatttttgtatttttagtagagatggggtttcaccatgttggccaggcctgacctcaggtgatccacccgccttggcctcccaaagtgctggaattacaggcgtgagccaccacgccagcctaaaacatattttaatttaagaaatttgagttgcttcctttgagtttaagatgtcatcataacatacttttgtgttttaccgtaataaactgagggttaatttggtcaattgactctccatctgggacaacctagacaggtttcaatctatctaatcttttgttaaatgattagtgtaaagtttcacaggagacaactgaagcagaatttttaaaacttcttagacagtggctttttgacttttgtattctgttaagcagcaaaattctttttacaaatgaaatgtgatgtgaattcccaacatattaaaacagagaaaagcagaacagctccagcctgactcctcaccctcagcaatacccatcagctctattccccatttcttcttatcacacccaccctgaggaagcccctgtttggggaaaaaggttaaattaacagtatagcatttttccaagatatgtactaaggcatgaacattgatgatgtttgatgtcagtaggtattggatggaaaaaaaatccataattaagggaacactgggttaaagttaaatttgttcttttactacaagcccttaataaattgatatgaagaattagtctccaaaaggtgagagatatgaaacatctgccaaactactttatcatgagctttttcctaagaagtaaattgaggaacactagtttgagaaacacatttctttattttacagtggaagaagtaagataaagagcaattaaatgacttgaccagggacacccatcattgccttatttcagaaagaattttaggcaattgacacccagtaaattgtagtgaaaaacagaatcaaagctctctacacatagtatttatttttctttaatactataatgcctcttagatttgagacttgtttcacaaaattttaaaaatacctaaaagtctaaaaaaaatcttgcatattgggtgcccaacattatgcacaatacttataggaaaatataactaattgggatataacacttttgtcctttcagtagcaatagcatttagctgtactatttgttcatgatagtggtgaagaagccagacatggttcctccccactcaagtctacatctaatgatatacattaaagattagcaaacagtaaaagacaagaatggatctgtttgtgacagtttgtaattaaaaggaatatcaaggatattactgggaaaatcattaaacatattttgtatttcaaaagatttctacttttagcagacaactgaaaaagttattttctaattcttgaaatgtacactacatcctctcgcaattatattaaaaatgacaaaggtttggattgttctgaattgctttgttagctttcagagccttcacaaattgaaataccatttaaaatgtactttatcaaatttattgttactgatgactgcacactgagcatatattttttcccataccttattaaatatagcaggaaatctttgaaaaattaaaaagataaaaagatacaagcttgtagaatcttcatgtttcagagttttttctttacatgcagtttaaaggattgtgttcatgttaattgaataatctctatttaattccacccttttgaggttttatacttttgcattacagttgatggaaatacctgggcacaagtaattgccttatacccaactttagtagaatgcatcacctgttcttcttcagaagtctgttctgcacttaaagaggcactagttccttttaaggatttcatgcagccaccagcatccagagttcaaaatggagaatcttgaccggctacaatatatttgaaagcaggaagatagtctaaaaaatgtttgctcctaattgagtcttctgtgagaaggacatttcttactgcaaataattcttggcagctgttgttggcctcctttaaattctacttacctgagttcagtaattcatattacaggcttgcacatcaacaaaggctcctgaatgaacagcagtgtaaggctttaataaattaaactgatgggagggataattaacactacagtatacatgctaccatatctccagttggtgatttaaagtgagcttatgtacagtttgtggtgtatgtgttaatgatgtactttttaaaaagaaagaagagatatttcaattcagtcagatttattagtctggtgtttttgcaccctttttcaagtacaaaatcgtactagaattttatgcaagatggtactgtaacattccatattatctataaccagcctttgttaacaaagggaactgatatacttgtgtgtataataaatggtacagttctgtataaaatagtgcatttatttaaattttaaaagtattgataatgttaaatgcttaaagctctatttattattaatacaaaattgtttgcttacatttttacttataatttgccttcatatgtggcggataagctcaccatatgatcatgcagttagcttcatgcttattttaaatgtattattagtgaccattaaacatctgaccagtaaggtcatgtgaacacagcagcaaatagtttatgatttgctgattttggagctttgaaatataggttcttaatacattgatacatattgtagcactatgacttcatcatacctcatttctttaaacagctctccaagctttcactgaagtctgtctgttttttatattggctgtctggattttaaagacttttcatattttatatttctactgattttgtttcccctaacaacatttgtcactgtctttgaattatgacccaggcaagatgatttcagattttctaaaatcttgcctgtgaggttttgttcatatcagtgcttcattttgtaatgtcttctcaagaaaaatacctatgttaactcacaagtataaaatatgtgtgtattataaaacaatgaaaagtgtatttttggagatagtcaagcatttagaagtgcagtgaacttgctgtcacggagtaaaatgctaattatgtttcactttcctagcctagtgaaaaagaaaagtgctcttgagtacaataccttaattatttcttaaaatactgactttgacctagctcactgtattttttatttaatggattatggattacagtatttttcttctgagttaaattttcataatttatgtgaagacacaaagatgtttaaaacaatgattattcataagaaatcatgatggtctcagtattattttagtgtattggaaggtctttgatcttaatagaatttataaatttcagcttctccagaataatcataaaactgcaaaaagatattataattgagtcatgattgagatacagttttgaggctattataattgtataattatttaatttgcattatctgtaaaatgtagtaaggtctttgaggggatattttttatttacatgaattactgaatttctattttattatttcacctaaaattaaggtaaaatatggcatttcataagttctgctttcagcattttccttaaagttgtaaaaaatcaagctatgtacttattttctatatttaggtgtgttaaattgaggattagaaaaatccacataatcactgataaagcattgaaacagaataacccaagggtagtgtaccgattcagtaacatgttaaaaatattgctatgcatttattcaaaggaaaatggtctgttcttgagaaataaaagatcagttgcaattaggataattaaatagttaaatatgagtcaagtgtatgcaatatacatttatatgaaccaaagcttgctttatcaggaccatgccctacagttcaaaacataaacatagtgaatgtgttaatatcatataataaggtaataaatgccagtcttagtgtgaagcaagtgggtggcccccttggtagtataattggacaggattttcctccagaatatttcctgtcaccctccaagagtcactacagtaattgattgctggcatggaacacattgcccttgtcttgttagtatgaattgggttctccagtgactagaagaactggggtgtgtgaaagtattcgatgccaggagattcaaaaaggaagctctcaaagataagatcattttatggcacaattgagtctataaccagccctttaagcagtagtaaaaatgtcctttgtcatacttactagaaatactatgagttttttttttttttttcatttgagacggagtctcgctctgtcacccaggctggaatgcagtggcacgatcttggctcactgcaacctctgcttcccgggttcaagcagtttcctgcttcagacttccaagtagctgggattacagacatgccaccatgccaggctaatttttttaatatttttagtagagatggggtttcaccattttggccattctagtcttgaactcctgacctcaggtgatctgcccgccttggcctcccaaagtgctgacattacaggcctgagccactgcgcccagccaataccatgagttttaagcctcacatcgtcacttgctgtcactgccagtgcctgttttattcatattgctggacaacagacatatgccaccaattgtatgattaataaagtctttttctggccattttgtccattataaaggaaataaactaattgttaacttgcatagattacttcttagtttcctatgctaccaccactgccaagggagaaaaaaatacatcattttgtaatgtctttagtatttctttataactagtgttaaggttttgttaattttattgtatacatttgtaacatttattaggagccttttaggttccaaaacaaacaaaaggcataaaaaagtctagcttagaaccacttttcacttgctttcatttttaattttattcacttaacagctaacatctttcttgtttcttgttttttccattatatggttatcgattcaactcttgctatattccttaaatttgtatgtatcatcagaagaaagagatgaacaatttagtgtagatattttattctggagaataatattcaattaaattatttctacagcaggccagtaacaactagattatttgtcctttctcagtataattttaaagagcattttgttttattgtcacaatttggtaccactagtcccaggtaaccattgggccaaaggatcagttgagaaacagttaaggatgaattagcataagttatggaacagtgttagaaaacaactcaaaagtatattctttattaatgaggtggtcattattacatttgtgtcaatgaagggcagtgtagttattttaaaatgactaatattttctccccaaatacagaataattcagatgggcaaccaagttttcaagagactgctgtaggtgaagtctgtctagccaaggcagaacacttacaggagtccctaactgtgccacccttggaatgggttagtgtacaggctcagaatattgtggattacagtttttcagagaaaactaccacagatgtagacaaaaatgatctctgaaagcattgccagcagccaggtatgttccttagatttccacttaggtttggcattttggcagataagctaatcttgtataaagcatcacattttactatgcttagtgttcctgggttgtatttatctacattattagagggaatttttattttaaaaaaattgtcattcatgagaagaatgggagttcatgccacatagtattttaccaatttatataaagtgggaaaagtctttaatacttcatgatcacttgaattaaagtttttgtatctctggaaagtagaatagtgctttcatttgaatgaaaagtgtttatagattcagaaagagagatgatatctttgtatcttgatttatatacagaccatttcagaggaagttaaatgtcttacaaatccaatactttctaatgctctaacagtgttggctatttaaaagaacatgtggcaagttctatatgaatattcttggtcatctcgactaattctgaggcaatgatggacagagatgctacttcttatttaactctaggcatgttgacttttcaaagcggtttccttatttctaaacagagatgatgatcaatgagttactaattctttagaggaaaaaatgaataatttgagtgtggagttgattttaatgacagggtaattcaagttgtttgataaatttattactatattgtaagagagatctttgaccatttttcttcctttttcttggacatcactttcttccctccccttctctcttttatgtttttatccttgttaaattttatgtttacgttaccatctttcttatactttcccctgatttttctcttttaattcctctttcattctctgcctcttctctttcagctctttctctaattgtgcctattccttgttcataagaagtggagctgttagtggtagaaccactgctcatggttctaccactacaaagtggaaagtagaaatactttgcactttggccactgttgcgtttttgccaaggtaaagttcccctgccattttgaaatagctgaacaagttaaagtaatatgttccaaaaactggaagtgccataaaaaactaaaaataaaaaaaaattgtgactataactcctactgtctttatgaatacacgggattcagcagccaagatgctcacaaaatgggattgctataaatatgatggattcagcacctaaatttggaataatcatgtcttttctgttatgtgggtagagagattatatatcttttctcaaagtaaagtatttaaaacctgtttaaatgagggttttggctggcgtggtggcccacacctgtaatcccagcactttgggaagccaaggtgggagtatcacttgaggccaggagtttgagactagcctagacaacatagcaagatcctatctctagttcaaaaaaatatttttaattagggttttggttttttatgattttggggggtgggggagatatttgtttttttgaggcagacgtttaaacttttagatttatcccatcttaatattgatttatattgacactgcctacttacaagaataatttgaggcagcatattgcccatgtatttcaactattttcatttttctgttgcaaagcagtctttgatggaagacccggaatcttatagttctcatatctgagtctttctggagtgtatttggtgtctgtgtgattggttcacccagaggtcacccagaggtcaattgaaaccttcctaattatactatggtattgattctatcccctcaagtatgaaaaaattaaattttcagaccattttcagttgctgcgaatgtagttacactaagttttattttaaactaaaattcaataaacagtgcagccagggaagatctgctaaaccatgccgttatttggaaaatcattgcaatatattaacaactgcttccttctatgatgtttactagatggagaaaaatactccatacctatattgcaattttatttttatctagaaaaagaaaatattaggcttcagacccaactgtgcaaatttcatttgctttccatctcttactactacctctgtgtcataatttaacacgtaacatacaactcctgtctcttaaggcagctaccatatggtgtttatgtcagactggatatatttatctaattttgtgaaattattttttagttcccaacacaattcttgaaagtaataccactgttgttactctttctccttacaatttttatgttgttgagatgtatcagttatgtattataatcatgaaattgtattggcctcaaacccaaattttctttgtagtctaggatagatttttcatgaaagctatatagttataactgtgattgtacagattgtttatttgttttacagctaacattaagcatgattccaggtttttaattatgttccagcaacactagtgtttctttataacttaaaatcataaccactttgataatttacctttggatctgaccagtgattcatttttttcttgaatatactttgtgtttgctttctcatccccgttaagtctgaaacattattgacaccccacatcacttactctgtttaaagactttacgagtagtgagtcacatgtttaggatgatcactttgggaaaaaaaaaattatagagtaaaggggaaatgttcttgagagctttattaaaaccattaatatataaaatgaaaaaataataaacagaagacacgaagtgtctctcaatagtttagaaagaaagatttggaactttaagtaaaaatgctaggtcaagtaaaaatcctgatgtagattagattatcttaatcttatgagcatttttttttaatttggtgaagctgttttgaaactgcctgtccatatcaatgccagactatctctctacctctcaaagaaaataatttgcattaaaattcctttttttgttatgtaatgaaagtataaaacaagaatttgtacgttactcagtgtgtactgcagtcagatatagttaaaataatttttctgatgcgtaattttaaccaccatttctggagtacctagtatgtgcaggccaaggctttgcctatattattccctttaatcctcaaagtagccttgcaaagaagttattttcattttacagaagagtcaaggattagggggttgaagtgagctgcctagagtcacatacctaaagtccaggtggatcactatgtcttgctttttcaaaagcagttctttctactacagtacaatagtttcatgttttacagtccattaaaatccaagacttataaaataaactaaaaatactcttgaggcaattactatttctatgatgggcactgggacaaatatacttgaacataacaaagaactaaaaatactgtgaaaaaaagatttgtcttaacgatgaccttgaaagttgcattgggtttttattattggtccaggtttaaaacattttatctatttaaaacatatgttgtgtgttttaagaagttatgttataaataacagcattgtggttaaaagcccagagtctggggccaggcttcttagatgcaaatcccaactctgttattttactaaatgtgtgaccttgggcaagttaattaacctgttttggtgtcctcctctgtgaaatggagttaatcgtggtatttaacagaatttaaaatgtagtgtgttctaaagcgctgtgcctggagcatcatcaccactaggtggttagggaagtaaaacacatttggcacacatcattcaagaatggccagaaaatccatgtcttcccacaatagggaccaattttttgcctttcaccagacaaccactgaatgttaagaatctactgtgtgctaataactgtgtccttgctgtatgacagaagctatttggagcgctctcaagtgcttattacagctagtcaaggaaaccgcatatataaaataatactggatacaagactatacaattaaatactggtgtatcactaacaactgtttagaccctgtttttgcgttaagcattgggttagtctctgtcctcatggagttttcagttttatagggaatacagaccttttaacaagtatgtaaagtacagtaaaagacaagtacagattaaaatgaaatcataaaataggaaccttagcctagtcttctgtggttcaggttaatagtgctgttagtagtcagaaggaagttttttaaagaaatgaaaaagctcagtggttaagatagaaattaaagttagtcttgatggctacctagattttggatgagttcaaaggatatacggagggatttcaggcaagataatgtgagcaaggcatatctgtgaaatagaaaacagtgcattttggtgtattgtgtgaaacaaggttggttgtgaaggattgggtcccttcataaaattccttgaaagccaaggagagtagtttagatttgagatggcagggtctggagtgatttaagaataaattataaaaccaaggaagataaacttgcaatcataagcaggataggatatatacagtatggaaagctaagctagaaagctgttgcaattttcttgctatgaggtgatgataaagaattgattaacggtggtcatattcagaaaggatacttaagattcctgatatgcagggaggggggagaaaaagttgatggtaacagtacattatatgtggatgatgagtatattggtgttagcactgttaaaaacattatggaaaggaatgtaagtgataaagtagtataatgactaaatttagttggaaactactgctgtaacaaatctgtataccatagaccaaacaggtgtttagtggccatttaaaaatctgtgccattatggcaaaggacatttgctttggtacagaataatctgatccactgcgcagtcaatgagcagtgagggttgattcccatggcagtccaatctttgcttatcaaggaaggatggtgtgaagtttctacagactttctggtaagtgattgataggtgagtttatggtttgattgagtttttgctttgagtttatgcttagtgattgataggtgagtttatgctttatcaggtaaagcatttaactgcaaatgtattatgtttacacaaatattcttaattggaaatagtttctgaatatgcacctaaaaatgttcttatgaaatatgtcaggcaggctgatttttaacttgaaaacttctactttaagaaattgtttgggtcccatcgcctataccatgtagaatagaaacaaaaagccagttatttaatttttaatttgcaattaaactcttggccaagaggatctgttgtccaaaattacatcgtgatagcttaagaaaaaaaaaatcttactttgccagaaagggaattatacaaggatatctttatgagttgctgccaaattttgttctagaccacggccctctggcctccatgaaggatcaaagtctgggcaaagacaattctaagttgtaggtaaacatgcttttcatttccctccattccttacttttgtcataagcagtctggattttcaggggtaaaggctgatagggttgccagatacagtcattaaaaattgagaatgtgcagttaaattggaatatcagataaacaattttaaaaatatatgtaacacacatatgccaaaacactggttatctgaaattccaatttaactgggcgtcctgtattttatctgacaagctctaactacttctttaaaataatttgttaacttcctacaaaaaatctctaaatgggaggaaaaaaaaaatcccgtaagttgtctgggccaaaagcagaagtggctccatggcagtcagccttctccctaacttggcttaaaaagaaaaagccaaaaccagaagtcccaaaagcttgcgtttaaagcgggctgtgccgcagctttcccgcctgttttctgcggaatgtagcacggcagccaccccgcgtgggtggggctcgtatggttgtgtccttgctggttgggaaaggaggtgccggaaacttcaaaccacggccagggtacaacgtgtccgcttaggcggcgatatgcgccgccatcttctttgcgggcaaaggccgaaaaaagtttgggactccactcccccccgctgagccgatggagggcatcgcccgctgcctcagcactctggtgacgtggaatcggggtcccctctttcagggctgatttctggtagcacgctgacgcctgccaaggcagggaaaggggacgccgcctctgtcccggatgtaagatggcggcgcggggggcggcctggcggggcggtcacgtggtgaggagtagcgcgcgagcctccttaagtgatctctaaggttcgtccggacgcacaggagcagcggagcgcgagacgggtcttgtgtccgcacgcgtcgagtcgtcgcagtcgccacccgggccatcgccgggcccggtttcactgttaaggggttttcgtttgttccgttttcgcctcctgtagagctgaacgggaattccccgaagggtgctggggaacgggtggcctggggacttcccggctatgccttggctgctgtttggcggagccggcggcagcctctgcgggatgcccgccggcgattatcggcgccgagagcgggccggcggcgggttcgacagcgcggcgcgggtgggggcccgggtaccggactcggccgcagcccagcccccaccggggactcggagcagggaggggcgcgagcggcgcagctcgggacgtggcggcagctcctagcgggcgaagcgcgggagcgctgctcgctgcctctcgggggcagtccagaaccagttggtgtctgactgcgcttttgccgcccatttcctgctttcgagcggctgaggcgacgcgctcccctcgggcagtggagggagcggctctctccgcaggacaccgccgcttttctctcttcagagcggtggctgacgtacagaacgccggctgtatcacccgggcgccggcgccgcctctcatccccgtagctctcggggcgcgccgggagtagccgagccgctgggtgctgggcggggtctccgggcgcggcgcggggggaaggcaaaggaaaagaaggggcggcgggccgacgtcggcggcgaggaaggacggaggagcgccggagccgctttgctgccctccgcgtggtcccgtgcctccccgacaccatggccctggctgaggtagtagtttgtgctgttggtcgggttgtgacattgcccgctgtggagataactgcgcaagctactgccttgctagtgctggtgatgctcagcgccgcggaggacaatggctgggaatcccctttgttttccggggcgctgcctggggacagcccgcgaagcctcggcgcccggccggcgcggccaccacggaaaccgttagtttcacattttcctagaaggaattgaggggagtggggtggaccgcgatgcattttaaaggttgggaaagagctaagccattggattccttttcttgaaggaaggagtggaattgtgtaagataattgatacagataactttttcaccctaaaaaattctaacacttctttcagcagttaaatgccaaatttagtgtgtacctgttttacttcattctttagctgtaggttggagtggtgtgagcgatctgcagaactggcattagaggggcagaagaagtagacctgataattaaagtttatgccttaacattttagatctggtttctgatatgctctcttagtaaatctgagtgtgtctttaaaaacgtaaacccaaagcaatttaaagtttctctttaaactttgcaactcgcgaatgagaagattgaaattatttgtaggtaattgcactattccgattttttaatgtatgaggcaaacaaataaattctatgtacagtgtgctgtgaatggttttgttttttgttttttctttttagtttaaccttggggctcagattctgctggtgtggtgggttggttttttggtttttatggcctttgattctaatgttatgtggtacttacatctttgaggttttgtatgggagaagaggactaggaattgaaagtggtttctagatttgagtttaaaatctactaacactcattttgattcctgagtggccactactcctaataggaaaatacctttgcatagagaaaaaaggtagtttggataactaatgaaaatact

SEQ ID NO: 191 - DNA, 3672 bp, Homo sapiens
gagatttttcaagagcttgggatgttcttcttgaccatatacagtcagcagcactcagcaaaaacaatgaagtatctctggctgctctgaaaagcttccaggaaattttacagattgtgtcccctgtcagagactcagataagcctgagacaccacctgtagttaatgtacctgtgcctgttcttatagggcccatatcaggcatgagcaggccatttgtaagaacagattccattggagaaaaactaggaagatatagtagctctgagccacccattgttactgatgagcttgaagatttgaatctatggtgggctgcgtggaatacctggtatagaattggatctgaaagtactaagcctcctattacttttgataaactaacttttattcctagccagccttttcttacagctttaattcagatatttccagctctctaccaacacataaaaactggtttcaatatggatgacttgcaaaagttgggagtcatattgcacagtgctatttcagtcccaataagttcagatgcatccccttttattcttccatcttataccgaagcagttttgacaagtttacaggaagctgtacttacagctttagatgttctccaaaaggccatttgtgtaggaccagaaaacatgcagataatgtatccagctatatttgaccagttgttggcatttgtagaattttcctgtaaacctccacagtatggacagctggaaacaaagcacattgcaaatgcaaaatataatcaggcggaatgggtagccttgaattatgtgccgtttgctgaaaggtctttagaagtagttgtggatttataccaaaaaacagcgtgtcacaaagcagtggtgaatgagaaagtgctccagaatattattaagactcttagggttcctctcagtttgaagtattcctgcccttctgaaagcacatggaaactagcagtatcctctctcctcagagttctttctattgggctacctgttgcccggcagcatgcttcttctggaaaatttgacagtatgtggccagaactagccaatacttttgaagattttctctttactaaaagcatacctccagataatctctctattcaagagtttcaaagaaatgaaaatattgatgtcgaggtagttcaacttatcagcaatgagatactaccttatgccaattttattcctaaggaatttgttggtcaaataatgacaatgcttaacaagggctcaatacattctcagtcatcttcatttacagaagcagagattgatattcgtttgagagaggaattttctaaaatgtgttttgaaacattactccagttttccttcagtaataaagtcacaacacctcaagaaggctacatctcacgaatggcactctcagtgcttttaaagaggtcccaagatgtactacatcgctatatagaggatgaaagattaagtggtaaatgccctcttccaaggcaacaagtaacagaaattatatttgttttaaaagcagtcagtactcttattgattcacttaagaaaactcagcctgagaatgttgatggaaatacctgggcacaagtaattgccttatacccaactttagtagaatgcatcacctgttcttcttcagaagtctgttctgcacttaaagaggcactagttccttttaaggatttcatgcagccaccagcatccagagttcaaaatggagaatcttgaccggctacaatatatttgaaagcaggaagatagtctaaaaaatgtttgctcctaattgagtcttctgtgagaaggacatttcttactgcaaataattcttggcagctgttgttggcctcctttaaattctacttacctgagttcagtaattcatattacaggcttgcacatcaacaaaggctcctgaatgaacagcagtgtaaggctttaataaattaaactgatgggagggataattaacactacagtatacatgctaccatatctccagttggtgatttaaagtgagcttatgtacagtttgtggtgtatgtgttaatgatgtactttttaaaaagaaagaagagatatttcaattcagtcagatttattagtctggtgtttttgcaccctttttcaagtacaaaatcgtactagaattttatgcaagatggtactgtaacattccatattatctataaccagcctttgttaacaaagggaactgatatacttgtgtgtataataaatggtacagttctgtataaaatagtgcatttatttaaattttaaaagtattgataatgttaaatgcttaaagctctatttattattaatacaaaattgtttgcttacatttttacttataatttgccttcatatgtggcggataagctcaccatatgatcatgcagttagcttcatgcttattttaaatgtattattagtgaccattaaacatctgaccagtaaggtcatgtgaacacagcagcaaatagtttatgatttgctgattttggagctttgaaatataggttcttaatacattgatacatattgtagcactatgacttcatcatacctcatttctttaaacagctctccaagctttcactgaagtctgtctgttttttatattggctgtctggattttaaagacttttcatattttatatttctactgattttgtttcccctaacaacatttgtcactgtctttgaattatgacccaggcaagatgatttcagattttctaaaatcttgcctgtgaggttttgttcatatcagtgcttcattttgtaatgtcttctcaagaaaaatacctatgttaactcacaagtataaaatatgtgtgtattataaaacaatgaaaagtgtatttttggagatagtcaagcatttagaagtgcagtgaacttgctgtcacggagtaaaatgctaattatgtttcactttcctagcctagtgaaaaagaaaagtgctcttgagtacaataccttaattatttcttaaaatactgactttgacctagctcactgtattttttatttaatggattatggattacagtatttttcttctgagttaaattttcataatttatgtgaagacacaaagatgtttaaaacaatgattattcataagaaatcatgatggtctcagtattattttagtgtattggaaggtctttgatcttaatagaatttataaatttcagcttctccagaataatcataaaactgcaaaaagatattataattgagtcatgattgagatacagttttgaggctattataattgtataattatttaatttgcattatctgtaaaatgtagtaaggtctttgaggggatattttttatttacatgaattactgaatttctattttattatttcacctaaaattaaggtaaaatatggcatttcataagttctgctttcagcattttccttaaagttgtaaaaaatcaagctatgtacttattttctatatttaggtgtgttaaattgaggattagaaaaatccacataatcactgataaagcattgaaacagaataacccaagggtagtgtaccgattcagtaacatgttaaaaatattgctatgcatttattcaaaggaaaatggtctgttcttgagaaataaaagatcagttgcaattaggataattaaatagttaa

SEQ ID NO: 192 - protein, 507 aa, Homo sapiens
MSRPFVRTDSIGEKLGRYSSSEPPIVTDELEDLNLWWAAWNTWYRIGSESTKPPITFDKLTFIPSQPFLTALIQIFPALYQHIKTGFNMDDLQKLGVILHSAISVPISSDASPFILPSYTEAVLTSLQEAVLTALDVLQKAICVGPENMQIMYPAIFDQLLAFVEFSCKPPQYGQLETKHIANAKYNQAEWVALNYVPFAERSLEVVVDLYQKTACHKAVVNEKVLQNIIKTLRVPLSLKYSCPSESTWKLAVSSLLRVLSIGLPVARQHASSGKFDSMWPELANTFEDFLFTKSIPPDNLSIQEFQRNENIDVEVVQLISNEILPYANFIPKEFVGQIMTMLNKGSIHSQSSSFTEAEIDIRLREEFSKMCFETLLQFSFSNKVTTPQEGYISRMALSVLLKRSQDVLHRYIEDERLSGKCPLPRQQVTEIIFVLKAVSTLIDSLKKTQPENVDGNTWAQVIALYPTLVECITCSSSEVCSALKEALVPFKDFMQPPASRVQNGES

SEQ ID NO: 193 - DNA, 32372 bp, Mus musculus
  misc_feature (1)...(32372): n = A,T,C or G
aagtctgctgtggacacacagacatgcccactggattccaagtgctgacgctctgtgatgctaacacctgaccttgcccagcttctcatctctgcagggcctagcactctgctttgggcaatgttttaggaagagaccctcaaaatatattcacctgtgagtatcggagaagctggctggatcgctattcctgagctttgagagagaaggtcattaaagtatttggagatgctaagcttaaaaactttctatttcaaaatgtaaaatgcatattagaaagactggaaattctgacaataagaaaagagaagaggagattgtcagctgctctgctgcccagagctgactactacttggattttcttctacttacatagttggggttcatggtaagtccattttgtgccatttccccatttgacactgaagtaaaaacatgtttgctattgatgactacttatgaatatcaaatgaaaagaatgcccatagcaatgtctcttgcaccttccaggagcattcatattccctacttttagatgaacatggaagttacaaagacttcatgtacaagctgagccctatttacaacagtttcagaagaccaaaccaaactttgtgctttaactacagcaaatagagatcaaatgaagataacaaccacgacaatgatgttttcccatggaactgtatatgcatttgaatcttctctttcaaaaggcaaatatgtttactattgcaagctctgtccacaactctggagttggtcctctggggagctgagggaggagcccagggatccacaccacatggttggagccatgattaaaaccaggcaattggatcccagtctactatagaaaaatgtaagcaacggccaggtctgtagctcagttggcagtgtgtctgcctgctatgtaaaaagccttcggctcagtttctgcataaaacataaaacacagccatgctgcacacctgcagtcctggcactcgggaggtggatatgggaaggtcagaagttcaaggtcatcctcagctatatagcaagtttgacacaagaccctatcaaaaaacaacaaaaccaggaaaaaacaaaaacaaaacaagaaaaagaaaaacccaaatcaataaagtaaataaaaacaatattttataagcaatgcatttgcatggacttatgagagcataacaggaaaccaaatacagaacaaaacaaaacaaaacaaaacaaaaaaccccacgtggcatgaactccctccagtgctcaaggaacatcctggaggactgaggtactatggaatgctctttgaccaccgcaccagactaacccacaagctaggtcaattctagcaggcagtacaaactggcttcagtaggttacaaaggaaaggaaagagcaccacggtgagaagggatgcgctgagaggagggtggaggagaaggaactcaggagtgaacatactccagacgcacggcatacgtgtacgcattgccacagagcaaagccccacgtcagcgataagaaaaacaaaagaagcatgaagacagtatctgagcgatcgtaaggaaggccatcaatgcccagaagaactcagcagatgtaggatctcagtatcagactcctgcacactggcaagcttgcaaagcctagactgaaaacctatagccttctgccagcatgggaaccagtacaccagaggttcatcaccaaggactacagatacaaacaaatccacctcctccctagaccttgctttcccaagagttttatttcacaagtcaaaccacaacacttaacaaaagcctgtgtcgacaatcagtcttatgtccattttagagaaagaagctcaggacctaagacccaagttctctttagtagggcagtttctgaggctggctgtgagtctgatgacttgtactgtggacgctcccattggaaaaccttagaaacttgtccacaagctgacagcactggggagaaaggtatatatatagcatgacagagctgaaaattcacccccaaatcacactcatcttccgatcgcaaggccttaggtatgagaaagaagtcgaggacactgtgtctgtttggccttctcagcagctgaaatcctcaagacagcccccagaaagtcccattctgggccctgaactcatctgctcagtgtccagcattctggacgacagaactaagtggtgctggtggatcagcctggaggcttagaggaacgtgttaacagcttctggtgaatcaccccaaagacattaaaccaggccagagagtaggagggagcctaggatacaaggaaggggaatggaggaagggccatttgccctagaaaacgccacagctcttgcacaggcccttaaagaatggtcaggagtacctctttggttcaccttgtatttactgaccacttactatgtatctggctctgcacaagtactggacaatccccacacgaacaaaccacagatccctgacttcatgaagcatatgtgcacatgaagaaagacaagcagatgtatacaaactaagacactgtcttaggacaaaggacaagcctgtggaaacctggccagctccctaggaatctaaactcaagatcagaatgaagcttggagaatctacaagacctggtagctaatccactcccagaaaggattagacagtacataaaagcatgagattctcactggttaaaaccttgcagcactttgcataaaagcagcagcaatttaaggatagaactaggtatttggatggatgggaagaaaaggaggggaaagctgagtggagagaacaagcgtgcagacagatggcacagacagacagatggcatgtagatatgtactgcagtctgagagaagggccaccacagcaacaagcttggattccagtaggtgtcacagtaactcaccaggcatggctgccgttggaaaagtggtttccccttccaggctggcccacctttaccctctccaactctttaccttccttgataacaaagggccctaaatctttgcagcataaagtctcagttctctagtgtggctcataaggcccagtgggatcaagccttagtacttagggtcctagacctcactgaagctctgacagcatgggtcattcacccaacctttcaggaggctctctcaaggcatcctgctgagtctgagtcattccctccactcctacccatccctggcaccctactaacctgaaaataactactcagccttagatcctccaggtctgcatttggaggggttttgctcactaggaatagtcatgtgcctgtgttcccaggctcaatggtagggcaaagtctgaaatactttgagacctacatgaatttagcctttatataggatgtcagctgacctggcaacctctgggagtgagctagtaggcaaggccagggagtaaggcttgagaacgacgtgaattctgggctttagttcatttcagatggcctgtgccccaagttgaaagggaccttctggaactctggcaagcaaaggcaatctgtaacagggactggagtaggatgacacagcatgggtgagagtaacacaagctttaaagagaaaaggagcttcgttcccatttgcatggctaagctgacacagtggtgcccagaacctgctgagaatgagaccagaagaaaggaggcagcttcgtctaactaagcacccgctctctgctatggtgtagctagaacacaccgttcagttacaagagctatccaatagactccaccagctcagaaggcaatttagcaggatcatcacttggaccaagaatcttgacatcatcaagtgactagaattgagacaacaacataacaaccaaggttctatcagtttgtgggcaaatggccccctttccaaatgacatttcagtaacaatcaaaggactctataagtagagattctgctgagggtagacatttgtcagttaatgtcacagccttgttactagtctggcagtgaaccatcaatgatgtgtcatgaataacaacctgactgttccatctgtccccaactaagtgactgaccaaacttggtatgtaaataattcaagtacagcttttcactatttagcaaaaagtgtgtaacagaaaagtttctttccagtttgtaagatggaagtgctgtgaaggaaagaatgccttataagcagtggtagggtatagtgacacagtatgtgatacagacacattatgtctgtaattccagcactcaggagcagagaaagacttgttcccccttacacctctgtgaccctgaagaaagaaatataaaatcaacaactaaagaaccctactctcaattttcttaaaatcttaacctcttattccaccaagactgctacatcaggacaatgatgtcctggagaccagcagggtgatgcatcctgggtctccctgatctagagactgcggcaggagatgcatgaatgcacgctttccctggcttgggtctgttttaaaggatctggggccgtcagtcacttagtaaccgggaaggcgatctgctctgctttacttggctttcctgtttcagtacggaaaatcccatgttctgctccccaacccccaccccagactggacaaacgttaggtgttcattggcccccatgtctgataaagcctctttcttctcacagccttgcttcccatagctatgagttcctacctggattggccataaatctgactatggtgcccctaatgtggctgtgccttatgatgacacttccccatttaggggatctctgatacagtgttgcctcctccagaaagcttctataaaggaattctacagacccctgggaccactagagtcccgagatttgacacactgaagagtcctggctccactgtggtctcctagcagcagctagcagtctcccccaggagttggtactcagaatgcagatgaaggcagcacaagcactggggtaggcactagatgtctgcagccccctttccaagtcaccttggatcttctaggtcttgtgccaatcaatacccaggttcctgaagctgtgaaagggaataaacagagcagcctgaattaaggtgggcaagctctttttcccaggacctctgaagtgaaccagagacattcccagggtatcaggaagggacctgaggtcctttacattaccaggtgtccattgttggccagcaaaaatgtcccattggccatcacatgcagcccagtcaaaagtttcctcaaactaagaagttttatccagaaagacattataacaaagaaaccagaattgaaacttgccttaagctacctggatcctaagtctatctatataggacacaatcaaactcatagacttgtgatgaataaaacaaacaggaaatccttaaccaggcaaagtaacacaataatgggaatttaaaggggctacagtcccaagtgaagtgagagccagcaggtgcttaggctggtaggacacccagcccctcgggacaatcatcctccccttcacagccacttatccacaccccactccctttctgggccatctgccatcccggttaagatttctgaattgctaccaacccccactcttgccctctacctctttcctctccacccccaaatcatccagctcttcacatttggagatttacaaacatttactaaatccttgctccatgacagaaagaagccattctacaccccaacatcaaaggggaagtcccatctaatttttagcttgccaatcttttctagggacccctgtcttcctttctgttgttaccgcactatcttcctgtccccatacaaagcttctggggtcccctctgaaactgccttctccgcccccccttggtacctccacctccagttctctccctggagcctctcatttctctaaggtctctgtcttctaccactctctctttgtagtcccttccaatcctctggcaatataagtgcaaagaaaccaagcaggttctcccgtcttgggagtgtcagtttaacaaaagctagaaaggaagtgaaaataaacagagccacagaagacagcaagggtataatgactggaacttagagacagaaaggaactggaatgggctgggaaggcttgagtgcctctgttagccactcctgtagagcaatcctgaatcaatcacttaacatgctcaacattacccaattcttgtacagttcccagttcccagctggtaatggcaaattggaaggacagagagagaaaatatgaccaaagctacagtcattaagtcaggatttgaacacaggtctaactccaaagctagcctcttctgtgtacttccctgtttccccaggactctgtaagcctcctgtcttctctaaaggtgctactgctgactatccctctagaattccttctgaaaatacttgtgttcttttaatcaatgttctttttagagcacttgtacatgttctgtgcgttttcttcattctcttatccaaccaatcctaaaaataaccacaaaaagtggtactgtcactctattcgttttacagtgaaggaaactgaagcctaaatgcatactgttaactaaaatcgaatccagatctggccgggtcaatggcctcgtaactatgcagtccaagaagtgctaccccaagaagcccagtggccactgtctgtccccgggacatcaagacaactccagcccacaaaacgaaaactcaacgatgcccttacttttcaggttaggtgtctggagactgaaaaatcacgcgacttgtccaaggtcacacacagagccagaagtgaaagagtcagggttcgaagccaggtgccctgactccaaagccttgcggataaccaacatacaaccctcccgcggcacccctgtcttcctcgcacctccgagccccgcaagccaagcccgcgtctgggcgtccgcgcccggccccgcggccttcccgccgcgcgccccgcacactcacttcaggtggtccaaggagtggatgttgcgggaggacttgctgtggcccccgcccacccagctccgtgagcgtccaaacatgtccgcagaccagccctgtcgcctgcctcacggtttcatgtccgagccgcccagcggcccggtgtccgcggcgacatctcaagcccagccagcggcggcgggggcggtggagagactgccaagcaccttgctccccagcccaaagccccgcactgacattcagccggaaccggccgttcgaccgccgcgctttacggccgccgccgcgaggaaatctgggaaatgaagttctccggcgaggctcttgacgacaggactctgcgaacggactacaaggaccggcatgactcgcgcgaccgtccagaggaggcgggacaagaggaaggaagaggctgggcactgtcaaggtgggcggaaacggtttgctgaaatcggagtaagactatctgaccttatttattgttagctttgtgattagaagagtgtctcgaaaccccagctaaaattggagaccacccttggcaatttggcaaggtttagttctcttaaaaagtattacgtgcgcgtgcgcgcgcgcgcgcgcgcacacacacacacacacacacacgcacttagagtctgtaaaactttggaaagcaagttctcgccttccactatttgagatctgagaattgaagtcggatcttcagacttgtcagcatctttgcttaacagctgagccattttgatgggtctaactctttaaaaaaattttttaaaggggtgggaatgtggcttatgcattatggatgcaaccttcaatatcgcaataataagaattaaaaataaaaagcattgagtagtacattatcatttgtcattatcctaagtgattaattatttaattctcacaaccatatgaagtagatgctgttattaaccttattttacaattcaggaaactgagtcacagaggcactttatgtgtgacagacgcaggattcaagcccaggtacccttatttgcttctgttgacaaaaccaatcagtaacattctggtttgtccttacaacctttttcttttgcacattagtcttaaaacattttgtaaagatgtgagcagcattgtaaagctaaccacgatgaactttcagaggtttcctctggtcattattgaaaactcatgccatttcccaactaattcagtaagaaagaaagagaactccaagatctccatgaaaggttacatacacctggacttccttcccagactggaagtgggaacctcggtgggaagcaagattttgtgccccacaccctctcatttattcatttctacatctcatagctatttaacccctgtgacagcccattgactgtcctaggaaaagagttgagtcagggaccaatgttctctccagggcccaggacaagatttgcacatagcacgtttttagatgaatattgatagagtgaatggtttgcattgcttccaagaattagagagatgtagactggcatcaggctaatggtttcccatgtaaaagtcatgaaagaacaagaacatgtctgacctccaaaggaaatgacagagactcagcagcttcgagaatccatttctctggaatttgttttcctcatctgtgaaaagggaatatactacattgccttgtccagctcctataaacctaagtgtgacttagattaaaggcctttgtaagaattgaggatagaccttaatcccagaactcaggagacagaggcagtggaactctacatgttctgggacagcctggtctatagccaatttcagggcacccagaggcttcatggtgagaccctgggttttcagggtttgggttttgttgttgttgttgttgttgttgttgttgttgttgttttcaaaaacagatgtagagctacatctcgtctatatcttgcacacacagaccttggttttgatccctcgcaaactcatcctcctgacgaagcacaaaggtggtctgtaaaccgaagaatctgagcagatatatacttagcattattggttggttggttggttggttttaaacatggactgcaaaataatagaaacaataagcagccttattggcagaagatttgacctgcttgtggtactttccatccgggtgtcatggaaccctataatgcctctgtcaaaggcactcagtaattgatttttttttcttactataccgtgaaaaagaaaacaacaaaagcgctttggggatatctaagattttcagtggaattaccggcattccttttccacccggcatcattttaaagggggtaaactaagttccaaaaaggtgacgctccatacctaagttcgagatgcagtctaaggagtgccaactgcagaagagcaacttagagactggagcacctcccatggggcggagcaaatgagtacccgcccccggacagctcaagccaataaacgtggagcactgagctagccaataaatacgggcgagcatgcgactggccaatgaatgaagagcctctgggtaggcggtgctgggaagcccagagcgacttggcggctgcagcgatgggcagtgagcctgcgggggcgccgaaggtgcctgaggaacgcctcggggagacagcagcggcctcaactctgagctgcggcgggggcgcgcgagcgcagcgtacaaagcgagtcgctggccacttctaggggggtggccctgaggggcgagcggcccgtgtggcccgatcccggggctccgtgacccggccctgagcatctcggggtgtcaaggagcgtcttcggaggccgcccggggcccagcgctgccgccaccgagccccggggcgccccctggatggctgagctgccccctcgccggccgcccgggcgccgcagcggctgaggtcgctgggatcgcccggccgccgcccccatcgccggcccctgcatgcccggcgcccgggtcgcagcccacctggacgctctgggccccctggtctcctacgtgcagccaccgctgctgccctctatgttctacgtgggcctgttcttcgtcaatgtgctgatcctttactacgccttccttatggaatacatcgttctcaatgtgggcctcgtcttcctgcccgaggacttggaccaggcgctggtggacctcggcgtactttcagaccctggctctggcctttacgatgccgactcagagcttgacgtcttcgatggatatttggaataatgtcgtgattactgttccccacttgccttccaccatccgcaactcttggcctggaccagccgcccgtaccatgccgctgccactggttgggggcaccatctggacagggatgggaccccaggaagaggcccgtaagtgcccttgagatgggggtgtatttcggggagagagaaggtagtgtcctcagggcagactaacctccttcctctaagcctctgatttctctggccacctcctctggatctaactcagatgctaggaatagtagtgtttgaagagatttcccccaaagaaatgaacatttggagtaatcatgcagtttaccccatggcttgggtaaaagctttgtacccaaaaccttttgaggtggagctgtcagctcctcccccaagtcttagcctgtcttgttggtgaccttggggtttggggggatgcttacttgtcctgaaagcatagactggtgtcaaaagaggcactggtcacttttgttctgcggcctcttgagggaccagttaaactgaggggcttcaggccaagcctgggagaatggaaaccttcagcaaacaacactgccgcacttccttttggcagtgtttctgctgctgtatttggagtcaggtttcagagatcctgggttgttggtactgcagctcagaaccgcagaggctgtcagtttcttaggctgccgctctgggacaggtaggcagttctgagctggtgctggctttgtctgcagtatttgcaaggcctctcagcaccctagggtcagcagaaggaaccacggggtggtcgtactgaagacgtgcctttgggcttctgccaagaagttttgttatatgttagaaaagataaagtgaatccaagactggctgaagtctcccaacaagggaaagggaacagctggcctgtatgagagaacgtttgtgccaggcaagctgttgggtccgttgaggtgtcacggggcgggcctagccctatagctggggaatgctggggtttggcaggtcatagagcccaagtggcaatgaggaggcacgtggagctggtgggtgggggctccttttagataacagatactgatgtcaccccaaggaagcattcacgcctcctctcccgtgttacctgattgccaacattgccataagtgggtgtcttagattggggtactgtgccagaaaaccatggctcaaacaacaagcatttcatcctcatagttttctaaagggcactaatcccactagagggctccacccttgtgacctaatcacccctaacaccatcactgcaggaacaggctttcaacagtggaattggggacacatcgtctgtctgttgtggaaataatgcatggtaagagggaaattcttgggaacaaggcgtgatatctttgaaggagtctttagtaagtctagtggtatccacacaggtgccaagttcgaggcagggcatgcaccagctcttcacgttcctgccagcccgacatccactctttcattgaacagatacctatttgttgagttctcggtgagcaaaggcagatggaacctggcatgcaggccttccaggaggaacacacgtgggtacctagaaacctagtgaggaatgggaagtttagaggctgtattgatgcgttcgctactgtttgtccagcaaccggcctctggcagatggtctgtacgaaatgaccatgagaggagaataggcacaggctgctctaactagagagtgggagaaggtctctctgaagggatggcagatatgagctgaggccagaattgatagaaggagccagacagatacctctggagcaaagcagtctgggttgagggatttgtcagtacccatacctcgggctgggaaaggcatggctcattcagcagccgaagggaggctggagataggacttggaaaagaggtcagtggcggaccatagatgacatagccaaaagcagttagcatccagtgatggtcccaggcagggcatgacacagtccagctcatgttactgtcagatgactggcagccgtgaacagaatgggctaaataaaagggtaggaggagggaggccagtgaggatgttgttagttgtctagccagaggtgacaggtgactggacaaggccacactgggaacacctaacagagatagaatcccctgggacccattcagaacctgtgtagagaccacagaccagtcctgcttttaagccttctgaatgttctcacgtagtcatacaacaagcactgtccctccttcttctcacagcgtctaggttcggcccctgtgatcccatgttacatttctgtctttgagccaagtagactctcaggcagtataacttggtgaaaatgtcttattttatcttcttaccatatcagcagaaacattcctgcttccaactgaaaacattggcatattctaagctcaaaaccagagcccaaatgctttgacatgctgtacaacaactgctgtgtgagcagaaacaccaagaagcgttcctttgggacactcttggctgaccttggggggtagggaaggtaagggatggagactgatgaagcccacacaccacactacctgtccccccatccaagatagaagactttggtcccagggccagaaaggcaagtcccagaggatgcaggagggatgactgatacaaacctagaatgaagtgaccaaccttgcctcttgaccctttccaaacacaggagccctgggccaggcatgcttgctcccagtcatgttttaacaagccagaccaggacacacgaggtcgtgggggctggggtgaatcacggcaagaacaaggacctccacttttgctcctcacctctggtgtctaacttattatacatttactgagcacctatttgaggagtcaatccagcttcagagcagtaactctaaactcagattttttaattcaaattgcaggtctagccacagtcttgggaatgccatttaactctacatattggtggcctcttttataaagcaggaataatgaaaatttgcctcgttgagaggacaaagaattggaccttcttgcatggtaactggtccatgaatatcaactgctgttatagacaggtcggtgcagtctggaattatctgccctcacctgccttgtgcattaatattcatgtctcatgactaacaaaaggaccagagactaacaaaatgggctcagacaacatgcccattggtgtacacactccacacacacccctacctctgtcttcctattctcatgcccataatccccagggcactggttctagagctctggaaagtggcctctgtggtttctgtagagtgttcattgtggcctgggggagtaggggatggaactccttgcttgctgggggagaggtgattgggtacatggccttggagccttaggggtgtgtgtgtgtgtgtgtgtgtgtgtgtgtgtgtgtgtgtgtgtgtgagagagagagagagagagagagagagagagagagagagaaagagagagagagagagaattggggtggggattgctgacagcccatctgctaggttagagaaacaccttagcctggttaattactttagagtcgtgtaacaggtgagggtgcccactggacctcccttgacatatgaggtactgtagaagagacacagtctctcgcctgggaatggggatgatgccaccagagtctgtgtggtctggtacagtgtggctgtgcaataagggtgaccgaataaggcttactctcaggcctcagatggctcacttgaggaccatgactactttcttagcctttcttgtcagactatagcctgcagtgtcaacagaacacccagcagagcatggtattgcccagctgggatgcccactacttctatggagacagccatatattcagatttcagttgtgggagacctactggtagcctgtggacccggatcagggtgagggaagatgcagaacaacaggaaggaagctaaggctagagggtctagaggtgtgggggcaggtacatgctttgctctcactcaagagacacacagagggggccctggtcacagtgcttcagtagtcctggccatccctttgggaagaaaaggtctccaggccagctgagatgccaatggcctcatggctgtggctctgaattagcccagcctggagattccagccagaaaagttgggcctccatatcacactctcctcccagccctgggatctgtttagctgaatgaaaaacaggagggcttcagtcagctattactgctgccttcatcctggaacttctgagaacaccagctgcatttgggaaatcaaaatcacattgaaagacacagactttttattttttgagacaggatctcactgtgtggctccaactggcctcaaattcaggatcttcttgcccctgcctcttgactgctgaggtaactcagcattgcaagtaaagaaactgaagactagaaagtgaggggtccagagaccaaagccaaattagatggctgtgtctcctgcacagcacagtggccaccagggagcagaagagccttccatgaccccatgaccggccatctcccatgcccacttccagcaccagtcatggcctcaccaggcccattcatctacatgcttgctcctttaatcctgaattcctcataaaaaaaatcttttagaaaaattttagagttccacactttcagcaaagttacaagaaaagtataaagaactcccatgctcccctcagcagagcctgcctggcagccagcatttctgctcatttgctaagagcaagctcactttctcctctgtgcatacctatgcatgcatgtgaacacacacatacacatgtggatggtcatgttctaaaccatttgagagtgcattgcagacatgatgttcctctggtcctgaatattttggtctgtattttcctaaaagaaggatctacttggtatctgtagtgtccttgtcaaagccagcaagatgtcattgtttttagagatggagtcttctataatcaagactggcctagaactccggatcctcctgctctgtctcccaagtgctggattacagttgggtgccaccacacctggctgaaatcagcagctggacagggataggatttaggagcactttgctctctggctttattcacagcttttgatgtcccagaaatgtccttcaatgataagtgtgtaagctttgaggtcactgctttctttattctggaccaaatgctcagtctgtctatgtctgggtgtgacattggcaatgtgcaagaggctggtgtggcgtttgccagctgtctctgcctggggttgtcaggtgtccgtctgagctcaggattccattcaggtgatgtgatcttggcaggaaaatgtgtgtcctcagtacagaattctgaaagccacacgccccctgtaccatgctggccctgtgagctttggtgatatgtgtcaggtctctctactgcgagttactgcttttccttttagagtttaaggtaaataatgcttttccttagagttttagtgctccttggtttaaaaaaaaaaaaaaaaaaaaaggtcggcacatctttaacctcagcactctggaggcagaggcaggatctctgagttcaaggccaggctggtgtacagattgagttccaggtcagccagggttacacatagaaaccctgtctcaaaaacaacaacaacagcaacaacaaaacaaacaaacaaacaaaaaacccaccaccaacaacaaaacaaatccaaacaaacaaactaaagaacagcagcaacaaaaagcgtcctttctcatgtggactttgtttggccctgtacttcctgtctagctgccgtggctttgggcttcctctcctgctgcctccacctctcaaatgctggggctgtagtctcgggtcactgtgcctgctttatgggtgtagatgtgtcccacagtgccagtgtaggtggatagaaaccagcgcttcgtgaacactaggaaagcactctgccaactaaactctggccccaggccctcttgactgtattttactgttttttaggtttttctgaggatccagcccagtacctcacacatcctaaacacatatcctactactgaggcgcacgcctagactgcatggatctatttttaagtgaatgctatgtcaccacaagaagaagccagctaatggtgagggctgggaactgctttatgtgttgagctagtgctgctagatgaaagttcccagcaccaacctagaactctctctgagaagtagtaaggcctgaccaagagcaacagagcaatctgtgtttggtatggatgtatgattgcttcagccagctcacgtgacccctaaaatggtttcctaaagtttttatagtcacacacatttggggtttaaaccccagttctaccaacactttggatgtgttagaccaagggacccctaccccaggacccccctttattggggttccttgctcttctggggccagtaactagaagagagcatcactgtggactgcctgtgaagcagactgggcttggtgatgcttggtacccactgagagtcagctgagatgcgcttgcagctgtcatccctcatccctaaaggaaggcctcctcctcaggcttcctgccgggaagggagcttggctgagaggctagaactgggtgcctctggcacagagcttccctgcatcaccttgggatggtcacttggagggaaactgaggcttggggcagttcagtgacccgtgttagatgcccagctatgagccatccacagtacccagagtttctgaagtgaggtgctaggctgcaggaatcccggggagggagcggaggagtcaggctcacggcaccttgaccttcctgctttttcctttctctggctataggtgtcctcttcactgtctccttgacattaccccattacctttttaaaattacaagtgctgggttattttttcatagttagacagaggcaagaagattatgaatttgaggccagctaatagttgtagtaagactgtacatcaaaacagtaataaaaatacttttgaattgggccaggtaaagtggccagcacctctgatttcagcacgggggaggctgaggcagaagcatcagagctgtagtccagcccaggctacagagtgaaactgtctcagagagggaaaaaaaaagttgcagaaaactacattgttggagcttgcgagatggctcagcaggtaaaaagctcttgctgccaagcttaatgacctgagctagagccccaggacacacccggggggagaccagtctcatgaaagctgtcctccgacctccatattcatgtcctggcgggtagatggaatctactttagacttgcttcagttcctccaggcattcattactgtgctccaatatcatagaagccaaaacactctggaccaggtattggagataggggcactcagcctgtttgatgagtaatgtccaggtgctatgtgacagcttcaggagctcctgggccggcatgtagggaattgtggacagctgcagacacactagatggcccctagtgagagccagcctgggtgtggactccaggcccgagatgccagcgctaatccagtgtggggaagcttctttcctccggtcccttgctgccagggaggtggccagattgtcatcactcccttggccccgagccaggtggggcctgctacacggtctgcctctagcacagaggtctcagatgtctgcagagctgggcaagccatgcattttgggtatgtggaggaagaggggtgtgccgtgagtttctagaaggctgtctagaagagaagcactaagtccgtgccccgagaaggctgctttctgctccccaccgaccaccttcaccttctttcttttattacatttatttatgtatgcaagggtgggcatgggtatgccatggtacacatgtagatatcagagagaaacttgtaaaagttggtttctttccttctactgtgtggatcctgggatcaaactaaggaagtcaggcttggcagcaagtacctatatcagctaagccgcattgatggcccctgaattgttttttacataatttcctttaaatcaacttttaaaaaaattatttattttatgcatcctatgtgagtccatgtgcatgtaggggaccgtggaggtcagatgaggccgttggagtccctagaactggagttataggtaattcgaaaccaccatgtgggtgctgggaacagaacctgggtcccctgcaagagcagtggatgctcttagccactgaacatatcttcagttcttaaatcggcttttaagatggaaaaaaaagctttaaaggagaggaacttgagtaaacaggcacctggcatcattggctgtcactaacagacttggcaaatgagttggaaatcagcagcacctactgaaacctaggtcaaggtgcgggcacagggacagggctcctaggtcaaaaggctcagtcagaccagcagctgctgggccacttgtgtagtcagaggactggcaggaaatgaggcctccttggtgattcctaccccatccctaccctgggctggggcatctctgcagtaggcaccccggagggggaatctcagtaaattattctgctgcaggcttctgaacatgaaggctttcaagacttccctgtctcccccaaggttcgttggaagagcagccacaagtaggctctggtgtgatgggacaagagtctcagaaagcctttctggaagccccaatgtagctacagcccctacttcccacaggttctctgggcaggcaggaggggacaaaagggtggatggaggaccctgtctggtggtagggggtggggggaattgtcagtgggaaccagagaaggttcctgacatggtagagtgtattcccagttggccttcagcagataagtctgatagacgatgggagaaatttcagcatatagctccaaccactccatgctcagaactacaggagatggctatgcctattctccccgtggggtgcctttcctgtgcagcccagccctgtgtggatctccagcggtgctcacaccacgtcccatctttgggagggttgcttcaagctaaagttgctcacaacttggcacagtgcctgacccctgtcttctagcttggggcccagcatgtaaaacattgacgtgcaaaatgggcacaggaactggtggtacacagcacttgttctgtttgtggaaacaggttcatactagatggtccagcttgtcctcaaactcagtcttaccctatagcccaggctggcctctaacctgctattctctgaccctagcttcctagtgctggaaacacagggccagggcaccatggctaggcagctttcagtacttgtgagctgagcacctttcagtgagtaacttgtgctttctgagctttgatgtctttatctgtccaacagacataacagcatcaactcacgggctggtaaggagggtgaagatatccacgaccccttgggtttctttgggaggagatctcagaaactccatgtggatggagagtgggaagtgaggccagcaagatagaccaggtgggcactaagcagactaccactataatctggggctcagtcctgctcagaagccccaggagccggaatggggtgctttgatgtcaccccaggtaccagtgagggggctggggcgttggtacactaccttcccggcagtcactggtgggaagcagcttactgtggaactctttaactctcttgttctcatagctgggggccagtcatgctctggaaaacggacagaggtctcaggatcacggtactcagggctggggaaggcaggcagaaggaagagtcatgttgcacgacaagagcaccgggtgcagtggcaaccctgattgtgattgtccccatttgttgccagtgcagtgccagccctgcctgcagtacttgtgcaactgcaggcaactcaccctgcttttctaagcctttgttttgcaacctgtaaaatgtgaagaggcacagttcctggtggaaatggtcatgcctgcttagtgactcttggaaataggtggggacagttttaacagccacggttgcctggaggtgctgccagcttttgctggttgggggccagagctactgctaaatctttgatgccgatgatctttgacacacacccctgcatgtcatgcagcaggacacactgcacgtctcacgtctcagggtgctcagtggtgtttggagagggaagagtctgaggtgggctaaaaggagggggacctgggtaccccagtgctacagagatgctgatgacagctaaacatgggatagaggcgactggaggagacaacctgacatcgggccaggacttacgggtgatgctgcgtcatgggaggaagagccgagtggggacaccttcctgtaagcaccatgctcttcctgtgagatgtgaggcactgcccactccttggagcttactcagctgccctcttatggctgagatccttctctgaccttggcatcttttgccttgccttgcgcacctggccagccctccttcaccatggaaaactgccgtgggtctccagaatcatagagtgaagcagattccttcataagaactggaaacacgcaccctcgggatcaggatgcagctcagtcggcagaacacttgctcagcttgtattccacccgaccccgagttccgagttccatttccagcagtgcagaaggtcccggctcttgtggcagggaatcagaaggtgaaggctatcctgggctacctacatgagaccctgcctcaaaaacaaaatccagcaggaaatgacaggcaatagggtgggagaggaggctcgagcagaccttgcgctagctaaggtgcccttggtggttagtgagttcatggctgctggtggagtgggagtccttttcctcagtttcctgtgttcctgccaatgactcctcaactgtgttcatgcaggcatccccagttccactcagtcagtcaccatcaaaagagacgttaaagtgaaaagcaagaggagagggtggaggaaagacagtatgaaagaaatgaggaagaaatgtcctgctgcactatatacatacatgaacttgtcaaagaattaaaacttgctcttagggatggagagatggcttggcagttaagagcactaactgctctcccagaacacctgggctaattcccagcccccacacggcagcttatgtctatcggtaactacaagatctgacaccctcacacaaacaaacatgcagacaaaacaccaaagcacataaaataaaaaatagataattttttaaaacatagataaatttaaaaacaatgagaaattatttttaaaaggaaggaaggacgatagaggaaaagcttccccagcctgagcgcggggctctggagagtctagaacctaagggtgagagcagggcttccgagccccacccaagccccgggggggttggggggggacagccctggccagaggtgccttggccctgttgatgactgtcctttgtcttcttgattaggcctgctcatgccaacaacagggttcctgccccaacccaggtgtctgccaggagaaatgaggactcggcgcagggacagggagtgtccaggccctccgaaggccccgctcgcctgccacccggctctccactgtcctgggtctggttgtgactcgccacctttgtgatggatgtttacaggcacccaaccagacgtcacctctctgcacttcatccccagctgcacctgcctcccccacttaacctctgggaaggacatggagagctgaagtgacaaatgggctcattctcaggccactctgtcggcattgcttgatgccggttgaccttaagctgggaagactgcagacccaagactgttgatcgtagtttcagggagtcactctgaggagggctatgccagggccaggcaggggttaacctctccaggttgacagaactgagatactgcactgggaaggccatgcttccctggctagaaatctatttttggaagtgtgagtggtgcgcatagtgtgaatggtgtagatccttgatttccataaacctgtaaaagcaatacttagaggctgacttatttcattaaaaaaatgtaagcaactccaatttcctttgccttgtctgttgctggtgtgtgtgtgtgtgttttggagatggggcatcatggttgacagtttgctggagatgcagtcagagactagggaactcactctagaaaggctgccttctctcgccttctgaaagcccctgggtctgagtctcatagaagtgactgcgtgctgtcccacacagagagcctaggatacacctccattaaggaggagggaaggagtgggcgtagtggcgcacacattcaatcccagtgctcaggaagcagaggcgggcagatctctaaccttgcctgccccacacgcctaaccaggtcttaaaagtgagttccaagccagcaagggctatataatgacaccttaaaataaagaatggggaagaggctgggaatataattcatttgatagaatgcttaccaggcttgcacaaagctctaggccccagcatcatataaaacaggcacagtggtttatgtcaatatcccagcattccagaggcagagacaaaagaatcagaagttcaaggtcatcctcagctatgtgtccagttaggtgccagcctgggctacattggatcctgtctctaaaaaccacaaaaaatgaagtcctcttccctagtctaacctagtttagaatacggttgtagccccgccccaaagccgtgtgcaattagggcagcattgcctacaacaggtgtgagtgcttgaggactcatgggaggagcctgtggccctccttgcctccatgacgggatgagctttttgcaacagggaattttgaattttgtgcagctgaatttcccaagatggcagggttttttggctccaaggacagccacacataacaggaaaagagtcatccttggagaaaggcctggaagaaagtcagggcctgaggagagacttagattgaaagtgtattacatgggcagactgccgatccccccagaattttacgcatcacaagtggggcctggtaacctattctagcatgtcatgcccatacccacagagatccttcacaggggtcacagcaaagctaatacattggcattccccatgaatgccaactttctaacttggaacccacaacttaacctacccccgagatggcaccatgctaattaccaaaaggttctctaaattgctgctgttctactccaggccccactctggtgcaaccctagtgtgtccactgcccaggagcctttgtgcagtgcacagcctggccagtcacacccagcagctcacttaagtttgctaagatgcaagatttccagcacaggaacctagaacatcttgttcacgtgtgtggatcctgtctctaaaaaccacaaaaaatggagtcctcttccctagtctaacctagtttagaatacagttgtagccccgccccaaagctgtgtgcaattagggcagcattgcctacaacaggtgtgtaggaatacctaacatgaggctgtgcaaaggattaaccatccttctcacatttactgtgcacctactatggacaaggctcctgactgggtgtagagcgaccagggatgatcaaagcagacagatcccttgcttccctagagctcacatcctacacagacaaaagtttgaaaaagaaaatattgaggtggggttggagagtgaggcacagagggacaagagacagagctgcaggagggtccgtcccacagagtcctgcaggaagtcagccgcatagagtctgggaagggacattccagggagaggcaggaataaaccacagggtgaaagaaaggctgagaactcctgcattgagctgtgtgttggagttttatttgttaagacagggcctccctgtgtaacatagaccaggctggccttgaattcacagagatctgcctacctctgctttctaagtgctggggttaaaggtgtatgccaccacacatgacctttatgtattcaagatttatttgtatgcctgtgcactgagcccacacagtgcccgtggagtccacaagaggctgtcagaacccctgtgccaggcattggcttcaactcgttttttttttgtttttgttttttgttttttgttttttaaatgggctagagaaatggctcagtgattgagagcacttgctgccttctcaggggacctgagttctcttcccagcaccaacacagaggctcacaaccaccgtagctccagtacatacgcagtgcacagaaacttccagaggggaacttgttagttctcccttccgtagtgtggtcctgggaaccaagctcgggtcaccaggcttgctttattccctcagccattttgctgacccattttattaatattgtttccacattgagcctttacataacccaggagagaagatactgtgactctgcccattttacagataaggaagctaaggcacagaagaaacttgccttgtgtatatgtcaaaatggagcatgaaaccaggcagctcagccaggagttggtgttttgcagttttggaagcatcttaggcccttgatgcttccaagggcctaagatgcaggccaaagggcctaagacgcttcccagcacacaggatcaagaatcagtgatgtccccagcactatagtgagtgccttacctaatcagctcattaaaagatggcagccatcatcaacacagagtaatgagagacattttttggcatttccagacagaccaaaggcagcgagcgatacagatctgcctttctcctgacaggtacagcagatgcctgccttggagagtgcctcagtgctgtccctggtggccacagaaatgggacttccatgtgccaccctgagcccaaggtcctaacagttcataatgtaagcctgagctgcagctggacctgtctctttaagaatcgcccccagcagccatgcagaccaccccggccccaggccctctagcccagctcccacttcctaggatgtgccagtcctgctggcatcagggctggcatggtggagccacacagctccctctgccaagacaagaaagcaagctgtcactgtctcgatggagggatgggtggtgcctgagctcaaagggggtgtcccagaggaaacaggagcagcggcactggtgctgccaagcccttttgggctagctgtagccaaggctgaccaatgtggctatacagaactgctcccaggatgcagcagggcagtaggagagagcactccactctgtacagtggtcactgcttcagtcctcgggtgcaggagtaagaacttttcactgcatctttggaagctacaaagatctttgcagtgaagacaggatctaggcagtggtgggctgtatggtgggcacacgggcgcatgcagagtgttgtagaaacaatactgtgtggctttgagccctgctctgagcagtctacagactgtctctgctggccgggctcctcactttctcctctctgggtgtcccccctataacataactataatgctacggggagggcaagccccagccagctgtcccattaaggactcagggctcccagacagcaacttgtgtcacatgctagacccacactcaagatgattccagcctgacttctgggttggtgggcactgctgagcctgcctggccagcggagtgtggattgtttcaagttattatagttcggctggtttggtttggttttgttttgttttgttttgttttgttttgttttgttttgtttcgttttgttttgttttgcattagatggggcagaagatgtccccagatgggacttgtgggataaaccaagccccagagcttcagtgaacgtagctgatgcattttaagtgtagtgaccgtgaaggtgaagccagaagaactccccgccacagccccgaagcagaccactccctgccttttggttcacacccagggtctgggccaggcccgactcagctttgacctaaagtttatggaaacagtgccacaagtagaaagagctaccataggctccctgtcacatctagagatttgcaggccagtgttgcccttagcgtcttcagagcctctaggtggccctgttgggagcagcaggaagacatgctttctcaccaggctggccctggtctggacaagcaggcacttggatgcttctgttcctcgttctgtcctggagtgtcgaagagaaggcctttgtcctcccgggtgaacccacggaaggcagccccagttctgtctaccagcgctcacggccgcagagtggggctgtctttgtacctggtgctgtaagggccttgagctggtcttggggccttcagaagagcaagacttgtgtcctttcctcgtgtaggcagggcccaactctgagcctgcaggggcagggtgatgggatgttgactcttatgggctatggcccacagaaaagctgagtccacagtacccagttcaaggtccagcatggtcagtgttcccagagtacattctgtgggagatcaggagaggcaggtgactcagtgagcttccagagaagcagccttgacagaagagtaggggctgtcacaatgtgggggactgaagaaggggctgaaggacaactacaacataggccaggggagagggtggacagacacacggtgaggggacaattgtcttcatgttgctggcaggaaatatattaatttcctatgaagatgaaacagcagcaaggaagacataaagcttcaaaggaaggacttcctaatgccaaggatggggattgtaggagactggctcagcctgtttttcctggtctttaagtctgacctcagggaggttccttggcctaagtccccacagtctgaagaacacctgccaatttggagacaggatagctccagatgacacatggatctaggacacccaaccagccttgctcgatgcccttagtcaccccttcacaaggacaatgacctagatgaccctcctggagtccaacatggttaccttgtccagagtacagcagggtcatctcagactgatcctggcatccagctgctgcaggtgttcctgaaccccaaaggggatagtgggtgtccacattctgtagatgggaccacagggccaggttagaggaaacatagcaggacaccgagggcaagctgctcacaagccctgccccccactctgtctagagccttaaccacatcctatctggcaggatacagaccagcatggggagaacagaatgttagaacccccccccttcagtcccagtttgctgtgtgaccttgaaaacatctcctctgccctattctcgttcactgtaaggtggaccctgctgtggtttcagttcggtctgtcccccataggcttgtgctttgaatgctttctccctggatgggacaaagcttgaggctgtggcatctttaggaggcgggacctggctggcagaaataggtcactgtggatctttgaaggtaacagcctggccagctcagcagctaaactgctccccgccagcatgtgagcaactgcaaacaggtacaataaatggtacccctgtgactatgagtgcagctgtgccttccctctttcttttgcctctgttatggtcaccatgagaaaagaatggagagaccccaccgtctgtctgagaaggccaggcacaactgtgcagatgaaagtcatctgaacagtagaaggtgctggacaacaaacatcgctgcagcttaataagaataagtttaaagttgggcgcagcacacactcgggaggctgaggcagggggatcatgagttcaagtacaattctgtttcaaaaacaaacaaaagatgactttgctattgttttatattctaagaatgactggatttggcaatttcatatgattcatcctgatgaaatattcattgagtgctttgtgtggcaacgttgtcctaaaagtttagggtggggatatggctcaggtggtggcctgcttgcctagcactaagtcctgactttggtctccgttgccacatgaaattggatgtggcagtgcatgcttataattccagcacttgggagacagtcatcttcatgagacccccacccccaccaaaaaaaaaagttttactaacataacaagtcttgtctgcaggtattgccatcctcatctctgaggccagcaggcaaatcacttgacatcccaggatcaggtactagttggcaggggtaggatttgacttctaaagacactcacatactccagccctgggggcgatgtgacttacgccagtgtttccacctgagggcacttctgaaggctggaggccagttgctgggcaccggcagccgtgaacttgttgaactggacactgaagagagagacccatcctgaggcatgacaactcccacctcaacccttctcacgatgtgggtgggagatcctctgcctccacagacaccacccagcccctacactcactccatcacacgcagggacaccatgtccggaagtacttgtgccaggctcttggctcctttgtcacagatgcagttattgtacaagctgccggcaacagaggaagaaagagggttggggtgctgggccagttcaggccaggtgatagccactcaactgagattactacttctatctatctatctatctatctatctatctatctatctatctatctatctatctatctaaagacaaggtcccatgtatccccatactggcctggaacttggtatgtagtcaaagatgacctttaacttctgattctcctgcctctacctcttgagtactaggattacaatgcaccacatccagtttatgcagtgctggggatggaatgaatccagggcctcatacatgctaggcaagcactctaacaactgagtcacatccccaggcaggccctactgtcccattttacagatggactaattgaggcccagaatgttgaggccactacttatttgtagttccacagtgagttcaagatacaacagcatgggcagtaagttgtacactgggcttggtggttcaggcctgtaattccagctacttaggaaactgaggcagagggattacaaattaggccagcctagaatacatgagaccctgtctcaaattagaacttaaaaaatgtttattatatgtgtgcatggatgtttgtttattatatgtgtgtgtgtgtgtggggggggagtgctttgccttcatggatggctgtgcttcataggtgcagtgcccaaggaagccagaagagggcatcagattcccctgggactggagttcacagatggttgtgagctaccaagtgagtgttagaaatggaattcaagttctctgcaagagcaaccagtgttcttaactgtggagccatctccacagcccctcaaaaacagaaagttaagaaggctggggttatagctcagtagtagaatgcttgtccggtatatatgaaacagctctgggcttcatactcagtaacacacacacacacacacacacacacacacacacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccctccttccttccttccctccctccttccttccttccttccttccttccttccttcctcccttccttaggttgtctttgtttggtatctggtctcagcaacaatagtagttagtatgccttcctggcccacaggcacctgcccgtatgacctagactttcctgacctccaacccccgacccccaagacacccatgttagggaatcctatacacttagcacaacctagtttaggtaacgagtacacacattatgaattttgcagggcacaaagaggacctgcttggaaggctgtaggagtggctgcctcagtagaggtgcatagcagacacctctcctagacttggggaaggaaatcctttcctatatggctagccaagagctgctactgctgagctgaatggctggggctctgggccaaattcagttccctctcaggccccttagtaccaaagacttgctgaaaggaatttagaagttggagctgctacaccaaggtcttccagaaggtggcagtgtgagaactagctggaatagtggtggacagcccagaagccagcactgcagggctttccagtgggctcttccttgggtaaagggcaaccatctactactgctcactagggatagcgctggagtatgacacatgatccattgacatggttcatattttacagatgaagaaatagagacttggaactagtaagcgacttgccccaaggctgtggtgatgtgccacaaagagcagcaaaagggggtcctatacccccctcannnnnnnnnnnnnnnnnnnnccagccccaccccacccccatctccccagcccattcagtggggggtacctcactcacctcagccttaggagggacttggctagggctggcagagcttctgcaagcttgcaggcacccacatcagtgatgttgttttgggacaagctaaggagacacagggaggagaaggtccaggacctaagtggaaggctctcccttcctcaccggctggaaactcgctgcttcacaggggactgtagccacacagccatgatagccagccctgggaagggtcatgggtaatgaggatgaacctacagaaaccactcaccaatatgaagggtttgttacagagagagtgggctggcaggggaggggagaggtgggagcagagagagaggtcctctcctccacctgctgtctaatttgatagtgccttttcccctagggctatcttccagctctacatacagtaggtacttaataaatgctcatgtgtccgggaatagaaaggaaggaagggggagggagggagggagggagggagggagggagggaggagctgtgtgagggaggactgagaggagggggcgccatgatcaggatgtaaagtaaataaacaaattaatatttttttaaaaaaggtcagaaggagagtggagaagggagggaaatctatccttgtggtatacctggaccattgtaaattatagagacattacacatcaggaaatgtacacatgaatccttgggtattttcaggcttcttaaccttgtttataagatggagtgttgacagattttttaaaaaatggtttatttgttttgttgtgggaattgaacctagggccttgtgtgtcctagataagtgctttatcatcactatgttctcagtgcttctatattattattattattattattattattattattattattattatattgtgaattagaattcctagaaagactctgtgtcgcagagactgattgaaagattgtggagaggtcgggagaggcccaagaacagccagtccttacccacctctgtgtcagaagtgtggctggtggataaaac

SEQ ID NO: 194 - DNA, 932 bp, Mus musculus
tctatgttctacgtgggcctgttcttcgtcaatgtgctgatcctttactacgccttccttatggaatacatcgttctcaatgtgggcctcgtcttcctgcccgaggacttggaccaggcgctggtggacctcggcgtactttcagaccctggctctggcctttacgatgccgactcagagcttgacgtcttcgatggatatttggaataatgtcgtgattactgttccccacttgccttccaccatccgcaactcttggcctggaccagccgcccgtaccatgccgctgccactggttgggggcaccatctggacagggatgggaccccaggaagaggcccgcctgctcatgccaacaacagggttcctgccccaacccaggtgtctgccaggagaaatgaggactcggcgcagggacagggagtgtccaggccctccgaaggccccgctcgcctgccacccggctctccactgtcctgggtctggttgtgactcgccacctttgtgatggatgtttacaggcacccaaccagacgtcacctctctgcacttcatccccagctgcacctgcctcccccacttaacctctgggaaggacatggagagctgaagtgacaaatgggctcattctcaggccactctgtcggcattgcttgatgccggttgaccttaagctgggaagactgcagacccaagactgttgatcgtagtttcagggagtcactctgaggagggctatgccagggccaggcaggggttaacctctccaggttgacagaactgagatactgcactgggaaggccatgcttccctggctagaaatctatttttggaagtgtgagtggtgcgcatagtgtgaatggtgtagatccttgatttccataaacctgtaaaagcaatacttagaggctgacttatttcattaaaaaaa

SEQ ID NO: 195 - protein, 155 aa, Mus musculus
SFTTPSLWNTSFSMWASSSCPRTWTRRWWTSAYFQTLALAFTMPTQSLTSSMDIWNNVVITVPHLPSTIRNSWPGPAARTMPLPLVGGTIWTGMGPQEEARLLMPTTGFLPQPRCLPGEMRTRRRDRECPGPPKAPLACHPALHCPGSGCDSPPL

SEQ ID NO: 196 - DNA, 20669 bp, Homo sapiens
  misc_feature (1)...(20669): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtgccggacatagagctgcccaggtcagaaacccaaaccttccacagggcacacagtcagatttgagttatgggagatcccacagccaggggtcagggcggatgcaggaaaccaggccaggaagctgtggctgtcatctaagcaagagacagacaatggtgacacagggaggcaagtatacccccaggcctggccacctctccagctctgctcctgacatgaggctcacccagaaggtccttggccatagggtacattggtgccagctgcgtcttcagacaggagaaaaccccagtatgtgtctcaagacagtgagatgtcaagagtcctgctctcttagccctgaattatacaaactggagatttcagccaagaaacaggcagggtctgccccacttacagctcatgtgtctgttttgctgaactaagaaagtgagggcttctctcaatttggatattcatatttctggtttatctgctagctttcctcccagaacttctgaaagcatactctgcttttgggaaacctaagatcacaataaaagtggcagacctctttatccctgtctcacaaataaatggaggcacagaatggggaagtggaggccgagggaacaaagccaactaagactgccagcccggttccctggccacagcactgagggtttgaggggtgcctccagtgagggctccccatccccgaccttggaacaccagctcatagtttctgccaggcctatttcatacgcactcttccaactttttcctgaattaaaaacaaacaaacaaacaaaaacctctgttatgaagtaatttcacacttacagaaaagttgcaagagcacaaacaatgcccgcccaaactcaccagttgcaccagttagcactttgctcatgtacacgtgcatgctcttccctctgtttgtatatgcatgcctgtgtatatgcacacatgtgtatatgtgtaattttcataagcatttgaaaatgggttcattatgcacctttactcctaaataattcagtatttatttccttagaacaaggacaaatttgcataaccacagtagggttgtcaaaatcagcaaatctaatattgatacactatacaatcctatgaccaatctcatctacaactttattcaaattttatagaggctgaggtggaaggatcacttgagtttgaaaccagcctgggcaacatagtgagaccccgtctctacaaaaagtaggaaaaaaaaaatagcgaggtgttgtggtacacgcccatagtcccagttactcggaaggctcaggcaggaggattgcttgagtccgggagttcaaggctgcagtgagttattattccaccactgcactccagcctgggtgactgagcgagaccctgtctcaaaacgaaaaaaaaaaaaaaattgtcccagtagtgtcccttaacaataaaaaggggagagttgaggtccaagatgcaatcccagatcagcttttgcattaatctcgagccttcttcagtctggatcagctcttcagtctgtctttctctcttgtgacattgacatattaagcagagtacaaggctggtgttttgtaaactgtctctcaatttgggtttgtctgatggttatactcgagattagattcagatgaggcattcttggcaggaatattgcagaagtgagtgtgtgtcttcagtgcatcttatcgagaggcacatgccatctgtcccctttctggcgatgttaactttgatcagttggtgaaggtggtgtctgccaggtctctccactgtcaagttactattattccctttataatttgcagtttaagatgaaatgcactagttttagtgcttcatctgtaaaactacttttttatgtgaatttattttttaaaaaatgtctgtcactaaagagaaaatcatcatcgcttggcatggataaaaacactaactgccaaagtcattaacttttggccaaataccaaagccagctaaagtcacagggccttggcctgtattctttgttaaaaagagattaacaactgtcgggtgataaacataagatataccagcaccaaactgaactttctcctctaaataatcataaggattgaccaaaaactgaaaagcaaattgcttgctcactatatgtgattccttgttacttagggtcacctccgtataccctctaaaattgttacttacatgctttgcagttggacatattttggtttaaatcccagctccaccaacacctcagacttcatctcctaagcctcggtttccttctctgtaaaacagggataatagtagcacctgcctaagggcttgtgcaaattagattgggatagtgaatgatgtatagttggtgcttgcttaatgaatgacgtggtcagtgtcaatggcgtgtcagaccctgaaggggctctagcccaggaagccttccccctttccttgggtgcccttcctcctgaggactggttaccaaggagggtgtgtctgtgtgggcagcctttgaagtagcccaagggcggtgataattggtacccagcgagtccccagatggtgctggtgccctcacagctgccatcccaggccccaagcttggagtggcggggaactccctcaagggtaaggcttcatttctgggagtccctcctggcaaggggcttggctgggtggttaaaaataactgcctctcccacatctccatcacctgccccaagcatcaccctgtgaagccgccaaggagggttccattagaccagggaggaaactgaggcttgcagaagttcgatgactcatctcagatacccatctatgaggtggcagcattgggctcctggccacgctgtcctgatgtttcccccagtgaggtggtctgctggaggcgtcccagggcggtagtgaatacgcagcagcggatcagatcagctttcagggccccgacaccccctgagcacctactgctttgcccttttaactggcacaaggctcagttatacaggccaagggtatcaagctagacttcctggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagttaagacatgagttcgagtagtacaaggtgaacacaaagtaaatgcttcataacacaagtgttgtcacgattttcatttagcgtttgccaaggctgccattgcaagacacaggagcgaaggggttgatctctaatagccaaagtgtgtgacaaatgagaattgaactgtgtcccagaacatcctcccgccctacacatagaaacctggggtcacctccctgtcctcgactcactgtgtgacttcaggcagaggtcaccaccctctctgggccctttcattctctgctatggactgagtgggaccagcttggatcaaaatcctcaaacctcatacaacactgtcagcagcttttcctgtatctgcctgttacctgaactattaacagttttctttaaattggctccttttaaagtaaaatgttttgaaaagagaaacttttgtgtttttttgagacagagtctcactctgtcacctaggctatagtgcagtggcgtgatctcggctcactgcaacctctgcctccctagctcaagcgattcttctgcctcagcctcccgagtagctgggacctcaggcacctgccaccatgcccagcgaattttgtatttttgtttgtttgtttttagtagagacgcggtttcgccatgttggccaggctagtcttgacctcatttcgccatgttggccaggctggtctcaaactcctgatctcaactgatccacccaccttagcctcccaaagtgttgggattacaggtgtgagcgacttggaaaagaaaaactatattactaccagaaatggaaacttggcatcacttgctataaatagaaggtaaccctacagataaacacaatgaaaaccggagtgttagtaaattccacgtgtagcccattcagactggagatctgcacacaagagggcagctacagccagactagcgcctggctgggactgtcggggatgcggtttgtggtcacaggactgggagaggagtgaggtcctcaccgagtgattccatcttctcttttttttgagacagggtctctgtcacccaggctgggtgcaggggcacagtcatagttcactgcagccttgaactgctgggctcacgcaatcctcctgcctcagccttccaagtagctgagactacactatgcctggctaatttttaaattttttatagagacagagtctcactgtgttgcccaggctggtctcaaactcctggcctcaagtgatcctcccaccccagcctcccaaagtgctgggattacaagcatgaaccactctatccagctgattccatgttctctaacaccctatccacacaaatctgagatgggctcaaggatgaccacaggccttggagatctctgcagtgagcatctgtgcggctgaatctgagtaaaggattctgcttcaggctgctggccagcaggtgtctcaggagcaggctggtggagggcagctatggagagacattagctctgcctgcacttacagcctgaggaccaagcaggctctggaggcagagaaaggcctcagcaaagaagggcaggtcgacctgcaaggaagagtgagtggagggaatggggcggggcacccacagcctctgctaaggtctcatggcacttagcagggtcctcagcgtctgctaagagctcaggaaatggtacctgctctcattcagaccgtttccatcgttattaccaagccagtgccagctttgcctctcatagctgtgcatctttaggcaggttacttggcttctctgaacctcaatttcttatcctattaaatgataagaacctcagtttcttatcctatacgatgcatgggtctcaatggaaacagttccgcccccttaggtcgaccttggaaatagggtaggagggcatttttagttgttccagtggccaggggtgctactggcatttagtggcctggagccagagatgctgctaaatgctcagtgcccagaacagccaccccacctccaagaattgtcctaccccaaatgtcaatagcaccctgtcaaacaacaatacatgtcacatgtttaacatacaagttctgcgagatgttcagtgaaatttgcggaaaggatagtgagctgggagatgaggcttggaatcagagcagggcttgagggggctgcagaggggttgggcatgggaacacgaggtgctacagagacactggcacccggctaggcacacagagaaggcagtgggaaacggggacgtgccagggggccaggccatggagatgatgctgcatcctgggagaaagagccaagtggggctgctgagtaacttggctgtggctagtgccttcctgtaggttgcaaagcatttttccgggcaaggtgggaggtgttgccaagccctgcccactacccagcgctggctcagctggcccagagctgcaagtcagccctcagaccctgggtgactcctgagcaggctgcaccagcatccccctcctccctcccaataaacaggacagtccttcctctcccgtgtgacattgcactggttctccagcccagggtctctgagaaattaggcaaattcattaaaaagagttttatatttgcagaaagacattttcagcctgagtctggggctcccagtggttccctaaatttgagggatggaggaagacttccctgccccaccccaagcctcccgagcctggtggattggtccctgtccccagccaacctggtggcagggtggggcttccgtgctaataacccccctttttccttcttgttagacctgctcccctcaaaagcttcgtgccaacagagaggttcctgtttgaacccaggagagtggaagagagattgggactgagtgctgaggttgggaaggcacctgctcccacagaagggggaacgcaagaggcatcccaagacctcatctgcctgcagtgtcaaatcgatggcctggccttggcttctgattatttgcagctgcgatggatgtttacaggaacccagccagagtttgcctccctgcacttcatcccggagcgcacctgcttcccccacttcaccttcggagaggacacttcaaactgcggacacacgcaaaagcgactcccagctccgtttgatgtgagttgagccttcaggccagctgggtttagcccgaggctggtcttagatgcagcgactgtttcaggggtgactcagaagaaaaagaagctgaggaagctgttggggggctgagggtgggattctcgctccttcatttcaggttactcgttcttcagcaagttggcaaaacagacatcatgctggtgagtgccacgttactcccctggctggaaatgcttttctgaaagtatgagtgttgtgcctacttaattctgataaacctgtctaagcaatacttaggaggcttacttctttggattaaaaaaaaatgtatgcaactccaacccctggggccctgcctttttttttaactttgagattcgggaaaggagttctaggcagaaccttgtggctgacaaacagcagaagatccagtggggttgagagagtctgccccagtcgggctggcgtgaaagtcccaggctggccccctgccccactccacaagccagggacagcatttggggtgtggtgggaaaagcctgaaggccaagctggaaaccaggcctgaatcccatagaagtgggggtgggtatcccctgtgtcaggcacatggtagaccttcattaaagataggggggaagggcttggcatggtggctcatgcctgtaatcccagcactttggaaggccgaggcgggcagatcacttgaggttaggagttcgagaccagcctggccaccacggtgaaaccccatctctactaaaaatacaaaaaaattagccaggcatagtggcgcacacttatagtcccagctactcgggaggctgaggcaggagaattgcttgaaaccagggaggcagaggttgcagtgagttgagatcatgccactgcattccagcctgggcaacagagcaagagagggattaaatgagtggaattgggagcttgtagtttcacggaatacaagcagtaattctctccagtttgcagagcacttgatttcaaagcaccttcacatacacaccaagtgaagcagggttcaaacgattgacccctttctacaggcgaggagactgaggtgtgggagagtacaggcggcagaactctggggggagacagttggagcaccacttgccctcaagtgatgctaaagaaagaaaagctacgaaatctgaaaagaagacatttgagagccccagggaaaaaggtgagcgtcaggagggagacatttgtatgcagagagaggcctgcgaggaagagtgaccatttggaaggtgcgtggacttacaatccactggacatggaattgcactatcatgccctgattcctccgagcagcgctttaccacctgacaaatggggttcaggggcacttccggcacactgtgcctgtccctgcagagaggtcctccaaagaagtcagaagtccattcctttataggagtgtgactataagtatcacttagatctgtgacacggagacagtaatttatccacatcttacgatgactgtgcgttaactacgaaaagatgcccctctgggttaaaaggctccacaccaggactcccagtttggcaagcagaacccagactggtttgcagcccccatgttcccccttgtcccaggtgcctttgtgcagtgtacagactggccaacctcacctggcagccctgtccaaagagtttttttaatttgctaaaatataagactcaccagggcaggaacatcttattcatgactgtgctgtcagtatgtatttgtagaatgaatgaaaccgttaggtgaggattatttgttcattttatgttattgagcacctattatacacaggcgccttgctgggtacagagggcacagcagtgtacaaagcgagatgtttcccgccctcctggagctcatgtcctaggacaagagcagactgcataaataagtgaaaaagataaaactagtgatggggttggagaatggggcaagtcccgaaggatgagaaatcagccatatggagagctgggaagaacattcccagccagaggcaagaatgaaacacagatatatgtaataatgacagccaacatgttattgagctccaattcttaacgtattagctcaccacaccttcacataatcctataaagaaggtgctgtggttatgcccattttacaaatgaggagactgaggcacagagaactagcttgcataagtaagtggtgaggtgggcgttgagcccaggcaatctcgttctagagtctctgccacctgcccctagactcttatccctcttgagtaggagtttagcacagtgtctggcacacagtcatcacttattgagctaatactttctgagcgctttgaatttcccttgcactgtgataagggctttgcatgtatctgctcattaaataaacagtagtggccgggtgcggtggctcacccctgtaatcccagcactttgggaggccaaggcaggcagattaccagcctggccaacatggtgaaactccatctctactaaaaatacaaaaattagccaggcgtggtggtgcatgcctgtaatcccagctacttgggaggctgaggtgggagaattgcttgaacccaggaggcagaggttgcagtgagccgagatcatgccgctgcactccagcgtgggcaataagagtgaaaactctgtctcaaaaaaattaaataaaataataaacagtagctatcattaacaaatcgttagtgttaataactgcaggctctgacctcatttcatcatcacacagaccaaaagcagtgggtcagaccaaaaacctggcacatggcacagtggatgatcagagcacacctcagtgctcactcctgtagccgcacacacaggaggcccatggcctctgtagagtctgcaagtgcagggatcccttgcagggtgacacctgagctatttacaagctgaacctggatggcagcacctgataccctttgcagccagttcgaggcaggaggtgcttgcctgtctgcaaagatcatcaaccacgcagccgggtctggattcctcagaccctcttgacacccagctctcacttgctggggagaggagcagagcttgggaatcagactgatcctgtgggcactggggctggtgagctggagctgaacaggcagctcccactgccaccaggagtaagctaagatgtcttgaattggggcttctgagcagactatgcccgagtgaaaagcaacagtcgtgccggcagctcgctgggtagaaagcggagcttccaagtccctttcggactccctgcagccaaggtgggactccgtctccgctaaaaaccagctcactcccaggacagagctgtgtgtcagaggcagaggcaaacattccccttggtaagcttttggtgcttcaacctttctcatccccaaacaattaattttccactgaattttaggaagccacaaagaaaagtcctctcagaaaagaggacttgagccaaggtgggctctggtgtgtgcacgcgtgtgtgtgtatgtgtgtgtacgtgcacacacgtgcatgtgcacatgtggtgaaaggagggtgggtaggacagtagcaatccttgtcacactggccaacagaatatggcagaagtgggctgggtgtggtggttcacacctgtaatcccagcactttgggaggctgaggcaggagaatcacttgaggccaggagttcaagacctgcctgggcaacatagtgagaccctggctctacaaaaataaaactaaagattaactgggcttggtgactcacacctgtagtcccagctattcgggaggctgaggtgggaggatcacttagcccaggaggttgaggctgcagtgagccgtgatcataccactgcattccagactgggcgacagagtgagaccctgcctcttaaaacatatatatgtagcagaagtaatactgtgtgacttctaaggctaggttatgaaaagtggtctctctctatcccctcctttctttttgggacaccctccaacccagccaccatactatgaggaagcccaactagcccacatggaggggtcctagccaactattccgtagtggcactgaggcccccagccaacagccagcattgcctgtcagacgtacagaagaatgagtcttcaggtgacaccagcccaaccctcaagctgccccacctgacacagagtaggacagaaggagctgtccccgctgagccctgctcaaatgacagatatgtgagcagaataaatgtgagtgttgttttaagccactatgatttggggtggcttgttacatattagataaccagagcagtgggtaccccaaaatggtaacagggtatgaactcaaaccctggacctgcctgtgacattaaagagacatttataatgtagtgaaaaaagacacaggaaatgaagctgtgcttccagtctgttcccctctcaccgccccattagtgtcccgttagctgtttccctgctaagggctggtgcatctggccaggcctagctttggctttggccaacaatgtcagtgcattgagtcccatagacaaaagcagctgccactgaagcccagcctgttgcaatctggggaattagcaggctgggggttgcccatcagtgtcttctgagtgcccggtgtgccctgtcaaggtgtctggtcggagagcagggtggagaagtactttctctgtggcccggtgcagtggctcacgcttgtaatcccagcactttgggaggctgaggtgggtggatcacctgaggtcaagagtttgagaccagcctggccaacatggcaaaaccctgtctctactaaaaatgaaaaattagccagacatgatggtgggtgcctgtagtcccagctactcgggaggctgaagcagaagaatcgcttgaacccaagaggcggaggttgcagtgaacccagatcgcaccactgcacgccagcctgggcaacagtgagactctgtctaaaaataaaaaaaaagaagtactttctccccagggtggcaggggcctgggcaggcagaatggggctgcctctgtcactccctctggcctggccgtggctgtccgcaatgtccttcagagaaggcctcggggctcctgggtggaccgcagctgccaccaggcatccacccaactgggcgctaaaggagcctggagccgggcctgtgtctgtcagcagagcaagatgtggttcattccgcagccgggcaggggccaaccctgaaccagcaggggccgggtgccaggatgctgaggctcatgggatacagcctggagaagagctgtgtccacaagtacccagttcaaggtccagcgtggttagtgtcctcagagaacatgctgtagcgggaggagccaggagagggggtttaggcaggacactctaggaggggcagcttgacacctgggaagggtgctatcaagatggggggatgggaggggcagtggaatggaggtggacgtgcagcacagtgcggggagcacagggctgggggacagtgatcttcatagtgaggagcaggagacttgtcaagcaagttcatctgagacaaacccggagcatcagggcagccaccaagccgaaacagcagctgggaaggcttggagtccccaaaggaagctcttccaagcactgaggctgtgggatgtggatggccaactttcctgtcccctgatctctaagcctgaccacagggaccaagctcgcaaagcctggaggacagctccaccgagcccagggtggagatgaggggatgtctctgatgacgcatgcgtccaagggtggtggcctagccccacctgtgtcccgcccacattttttgaatgccaccttcacaaggacactgcccccaacccactgcggctctcccctcccaagcccaccctggttaccctgtccagagcacagctgggatcatctcaggctgatccgtgaatcctgttgttgcaggtgttcctggacactgaatgggatggtgggcgtccacatcctgcaaggggggatgggactcagagctaggttagaggagagagggcggcctggggccccagtgacagctgcccccaaatccctccttccacccagcctagaacgttggggacttttcccctggcaagataccgaccggtgtgggtcatggggaaaaggagaagcctaggaggcccgagattcctttatggttctgcagctgacttgctgtgtgaccccagaaaggttagttaactgctctgtgctttattttcctcatctgtaaaatgggtcttgtaagacccaccctgtgcgtcttagaagaggtgagtgattgtggagataaaagtgctttgaaagaatataaagtaaccagtattggacatcatggtgacttaataaaagataaacctgaaccatatgaaattgccaattttacaggtcaaaaatgggtggatgtcagcaatttcatatggttcagcctaatatagcatttattggcatttttgtgtgccagctactgttgttataagagctttgtagggcttgattagtttaagcctcacaaaacctcttgggtggatattattactgtccccactttacagatgaagaagctgaagccagagggggaagtgtctgctcacccagggttgcagattggtgaagggaagagcatgatttgagctccggggtcacactgggccacacgcctggggagtgagttgttctccacccaccagggttgcctggacttacgccagcgtctccacatgaggacacctccgaaggctggcagcgagctgctgggccccggcagccgtgaacttgttgtactggacgctggcaagagaaactcaccttggggcctggcccttgggactccccagctccagaccaaggccacccccacatccagctcttccaggacaccagggagagacttcagtgtctcccaccccgggctgagccacccaccgcccagactcccacactcactccatcacccggagggacaccatgtccggaagcacacgagccaagctctcggctcccacgtcgcagatgcagttattgtacaagctgtcggaaacagaggccagggggagggattggaggcctgtgcatggtcagccttccagaagccaccatccctagattccagaaaaagcctggtcccactatccctgggggaaggaaccaatatttattgcacaacagagcctggcattgtgccaagtacttacataggccattgggatggttcccattttctagatatgaaaatagaggctaggaatgaataagtgacttgctcaaagtttctgtccccaggtcccactagttctcttgttcagggctgtggtgattgcttctaggatctcagtgtcccctgcagcctggaggtcagccccgtgggagtcaccacctactgggattactgccccattttaaagacaggcaaaccaagacccagagagttgagaccacttctctgtggtcaaacagtgagcccaggaaaacagcaggactaaaaggaagtcatttcttgccttactgtgtggaaactgtcagaacaacttcccaagttcaaatcccagctatgcctcttactgcctatgtgaccttgggcaagctactcaactcttctgagactcagtttgcccatctgtaaaatgggcatgatagagtcattgtggggaggagtaaatgaatcaatgctgatataacatttagaatatgccttggtgcctagaatgaactaaatgttagctatggttctgactacatcacaggaacattggtgagggtcgcatgagttaacatagagggtgtgaccagcactgggggcaggaagagaaaaagccagtcactggaccagctccagtttctgcagcatattcacaaccagcattagtagcagtgaaaatagcatgatgagtgtcactgatgccaacttcagctgtttactcgacaccaagcagccttttaacaggtcaggtgctgctgcgggtatgatttcagggccatgactttgccatgattcagcctcagaactcccttgcagggctgcatataaaagcagcaggtgcagtggctcacgcctgtaatcctaacactttggaggccgaggcgggtggatcacctaaggtcgggagtttgagaccagcctgaccaacatggagaaaccccgtctctactaaaaatacaaaattagccgggtgtgatggcacatgcctatactcccagctacttgagaggctgaggcaggagaattgcttgaactcgggaggcggagttgcagtgaactgagactgcactccagccttggcaacaagagcgaaactctgtctcgaaaaaaaaagaaaaaaataaataaatgcagcaggtttacactgctgccaagtggattcaggctaaatcaactcacatcacgggtcggccggtaccagtgcagaaactagatgggggttttgcaatctctgaaccctggagacccttcctccaccccacagggagagtaatctgaccatatttcatcgatgccaagacatatatgtcaccatttgaatatcattgagatcaggatgtgtcttataaccaatagcgtgtcacagtttgcattttggcctcatattggggtcttacaatggatggcatcttagattccatgaaatatgatgtttcttaaagggtaaatcaggctgggcatggtggctcacacccgtaatcccagcactttggaaggctgaggtgggtggatcgcttgggcccaggatttcaagaccagtctgggccacatggcgaagccctgtctctactgaaaacacaaaaatagcctggtgtggtggcgggcatctgtaatcccagctacttgggaggctgaggcatgagaatcacttgaacccaggaggcagtgcttgcagtgagctgagatcatgccactgcaccttagcctgggcaataaagtgagacttggtctcaaaaagaaaagaaaagaaaaaagaaaagtgtaaatcagatcaagtgtcgccttcccaggcccacctacttttccattcacactgaaaaactgcaaatacctcttgtgacccacaagggcctccctgtgtgatctggattcccctgacctcccctacttccaccattgcccagcctctgtccctcattcactacacacagccacagtggcccttctgacccttaaaacacagccccttttcccacttagggcctttgcacctgctgttctttcttcctagagtccttttcccctagagcttcccacggaagaatcatctccccagaagtcctgtaccctcctggggcttgttagtttccttcccagcatgaatcactgttttacaatattttatttatgtatgtgcctaattcctactacgcaaagaaactcaaaagcaagaacgacatctctctagttcatacttgtatctctagtttttagcacaattatgaaccagacagattctatttttgcttctgagtttctttgcatagcaagaagtaagcacctacataaataaaatattgtaaaacagtgatcatgctgggaagaaattaacaaggctcaggagggtataggacccagctacttggaaggctgaggtgggaggttcgcttcagtccaggtagtcgaggctgtagtgagccatcattgcacccctgcactacaacctgggtgagaccccatctccaaataaataaataaataaataaataaataagttggccgggcatggtggctcacgcctgtaatcctagtactcactttgggaggccgaggcaggtggatcacctgagatcaggagtttgagaccagcctggccaacatggcgaaaccctgtctctactaaaaatataaaaactagctggacgtggtggtgggcgcctataatcccagctactcggagcactgaggcaggcgaatagcttgaacctggggggcagaagttgcagtgagctgagatcacaccacttcactccagcctgggtgacagagcgagactccatctcaaaaacagaaattaaaaaaattaaaaataaataaataataagggaccaaatgccatctttcctgggaatctgactctggttgtcctcagtaagtgaagagctctggcgaagaggagagcagtttctctcagtctggcgagtaagaagagctggtaatgctgagttggatgactggggctctggtccaagctcagtccgctcattacctctgggaccacaccagggcctggatggaagtcactcaaaagcaagaggtgctatgccaaggcctaccagaaggtggcagtgaaacactgaccggcatgtaagtgacaaggccggca

SEQ ID NO: 197 - DNA, 669 bp, Homo sapiens
acctgctcccctcaaaagcttcgtgccaacagagaggttcctgtttgaacccaggagagtggaagagagattgggactgagtgctgaggttgggaaggcacctgctcccacagaagggggaacgcaagaggcatcccaagacctcatctgcctgcagtgtcaaatcgatggcctggccttggcttctgattatttgcagctgcgatggatgtttacaggaacccagccagagtttgcctccctgcacttcatcccggagcgcacctgcttcccccacttcaccttcggagaggacacttcaaactgcggacacacgcaaaagcgactcccagctccgtttgatgtgagttgagccttcaggccagctgggtttagcccgaggctggtcttagatgcagcgactgtttcaggggtgactcagaagaaaaagaagctgaggaagctgttggggggctgagggtgggattctcgctccttcatttcaggttactcgttcttcagcaagttggcaaaacagacatcatgctggtgagtgccacgttactcccctggctggaaatgcttttctgaaagtatgagtgttgtgcctacttaattctgataaacctgtctaagcaatacttaggaggcttacttctttggattaaaaaaaaatgtatgcaactccaa

SEQ ID NO: 198 - protein, 116 aa, Homo sapiens
PAPLKSFVPTERFLFEPRRVEERLGLSAEVGKAPAPTEGGTQEASQDLICLQCQIDGLALASDYLQLRWMFTGTQPEFASLHFIPERTCFPHFTFGEDTSNCGHTQKRLPAPFDVS

SEQ ID NO: 199 - DNA, 26392 bp, Mus musculus
  misc_feature (1)...(26392): n = A,T,C or G
gacctcagtccccttcctgttttgggatgcacagtgaacacactggtaagctgctgcaggagttaattcaggggctgcaaaggcaacttgggttgggccttgcacagaccaggcaggtataatatcacacctgtcatcccagcacttggaaagttaaagcaagagggttgtggcaaattccaggctagcctgggctacagagcgaaatgagaccaaaagataaaactcccagggctggccctaccactcagtgggcagagctcacccagctgcgtaagccctgagttccatcccagcaccgcagaaaccagatggggtggcacacagctgccgtccctgacttgggaagtagaggcagaaagcaggcatgcaaggtcatccttggctgtaaccagttggaggccagcctgggctacatgagaccctctcaaaagagaatctgtaaatatctttgtgactccccatcgtgtccccatcctgttctctccaacggccactattgccccaccgtggacggtgtgtgaactgtactgtaaggcctgggggctcctccaaggctgaagaggtgccctctccggcccacttctgttctcctcaagccatcccagcaagtcccctgtccagccccacatcaacctcagtgcaatatgccctccccgtggggtcccttggcacggtactgtctgcagccccttgtctctcacccctagctccactctccggtggttaaaaatcgcatcgcacatcctccccccaatcctgtttttattgttgaatccattctgtaaactacaaacctcgtgtgtcttactcatcaggacttgggatccctcgtcctcagcctatgtggtctggtgtttgacaatccaagcacagtgtcctcttggcaccaaccagaggggcctgtccctccagcgcagccggcaaatgtatgcagtccaggtccccgccccacctgtcacagcccctctttttgagatctgtaataaatctctaataagaaacagctcctctccggtgacttatgcgtgcgtgcgatgggagagcaggcgaagggtgggcaccacgtgttttgtctcccccgctctaaaccctccctggatcccacatgatgaatcccaattcgcagatgacttcctttctccaagcctaaacttccctatccatagattagccacaagttgagcgcagtacgcaagctggcgggcgtagtagtactcagactcgtcctggagtcagccagagactgtctgttcatgtcctgttgttttattagctcggaaccggttgctacaaggctaccctagaaaccgaggactcccgcgagcgcttgggtctccgggtttcaatttttagaagtacaccgggccctgcaggtttaagttccgcccactctagccacgcccctttgacgtccttttccaagcccagcaagacccctaagcgcagtttctgggttcattggccccgccctcagatccaatgtgtccatctcgcccccaaggtcccgcccaccgccgctctacttcctcccactcctcagtcggccactctcgactacatatcctgcccgtacccattcacagttcgtagttacagatgtcaatcttgcctcaatcagcccctcttccaccctctcaaatcctgatatgcactcctccgcccattggtctacgcctgtcaatctagtttaccagaccccgcccaccccggctcccgtaaccgccattcttgcgttccttctcaggccacgcccagcgcaggtccccggccgggtctcccgatctacagttgtcgatctccgtaagccccgcctaacccagccctattctttccccataagctcctctactaggctccgcccctagggcactgcccatgcaagtgcaggctccgcccactaggcgcctcttccgccctggaacaaccgcctcgtagctccgcctccctaagcacgctactcgccggtcacctagggcgcgagggagggcccacctaggtcagtctccttcactgcatgaatggagcgtcaatccgctagttctaacggcgtcccgttaggaatctactatgtgttcccagcttgagaactccggagaaatctcgggttatgttgtccctggagtcccggttagagggagtaagtcattccctgtgatcaggcgcactttggacagtccttagagcgccgcgccaaaggaaagcccccggcgccaagcttcctggttgtttacgcgcgcgcatgcgcggcgcgggccgccaaatgggtcgggactatcgctcgcgctcacggtctgtgggtcgcaggggtcggaagcagcggagtcgaagccggggccggagccgcagccggagtcggagtcggagtcggagtcggagtcggagccggagccggagccggagccatgggcggagcagccgaaggcgacgggaacacgagcggcggcgcgaacgcaagcggcgcagccgagggcgcaggtgagcgtcctgggggctgctcgggcctgggagccgagggacaggcggggcagtatccgagatgccgggctgcgccggggcaaaggagacttccggggaccgcgggccatgagcataggggaccgaatgactccactcgccacctctgcattcatagacattgtcttgtcccgggctggcctcctgcgtcagcctctggaatgctcgggattacaagccattgcctcacagttaaggttttttgcatttcctcatagttaattctgctcagttgacagcccttcttctcaactggcagtacttctaacaagttgaccaaagcctaatcaggacaccgttcatacagcactggagatacaagcccgaacagccacatctatcttttactgtgggtactggggattcgaactcatgtcctcaaaatactacctggtggtattcctctttcgtggttcctgggctgtcagagagtccatctattgggcctctcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcgcacgcacgcacacttgcatgggagctcacatcctcttctggaggctggatgtgcctggacacacgcctctcaccatggtggctccctgtgttgctgtccaggtcaaacagctgcggctagagcgggaacgggagaaagccatgagggagcaggagctggagttgctgcagcgggagaaggaggcagaacactttaagacgtgggaggagcaagaggacagcttccacttgcggcaggccaagcttcggtgcgctcctccctggccttctattggaaactacaatctcatgccaatctctgccaggcgtggcgtgtgaactcatgagacaaatccccggggagtcccgttaagacagtgatggggatatgggatccattgtccagagtatctccgcctcactgaaggaacctgagcacagacctggtcagatgtattgaggaccccagctcaaccctattgtcccaccttggggagggccaggctcacagggccatctgacactcctatcagtctgaacctgtttggctggttggggctgagggtcagctgtgccagcggaactctggccctgaccctgccaccctatttcctcctgcagctccaagatccgaatccgagatgggcgagctaagcccatcgacctcctggccaagtacatcagcgcagaggatgacgacctggcggtggagatgcacgagccctacaccttcctcaacggcctcactgtggcggacatggaggacctactagaagacatccaggtgctgcacatacttcggtctgggtagctgtacctggctctgccctgccctaccctgccctatattgcctcagccctcctccccacacccctccttcaggccccaccgctcacagccctgccccacaggtgtacatggaactagagcagggcaagaatgtggacttctggcgggacatgacgaccatcacagaggatgagattgccaagctccgcaagctggaggcctctggcaagggcccaggtaagcagtgtgggacatcttcccagctcctctgaggcctctgcagggcatggcagcgcctgaatgctggacaatagaatgtgtctcctaaggagcctcagggaatggccgcagcccgagacagctgctatccctgtctgcagagcctcagccttcaccagggcaagcagagtctaaattggtgtgctgcccagctactccctaccaggcaggcctgttcctgagccccgggtggggagctgggaacctcaggccatgctcaacaacctgacctacaggtgagcgccgtgagggagtcaatgcctcagtcagctccgatgtgcagtcggtgttcaagggaaagacgtacaaccagctgcaggtcatcttccagggcatcgagggcaagatccgggccgggggccccaacctggacatgggctattgggagagcctgctgcagcagttgcgtgcacacatggccagggccaggtgaggctttcacagggccttggcacctgtgtcctccctgaccagtgcttctttagtgattgtcacctcagcaccgggctgcctatcccgctgcttcacccaggcccctcctcctccctacccttatacacatttctttttcctccctctgtcccctcccaatctggcaagagaattgtatatagattctgtgcatgtttggcagtggtggctgctggatgtccccatgccccatggatggcaactgttggcttgccttggttcctctggatgtcccccatccaagtagaccaagcacctcagccagttggggccacactgtgtgaatgtgccctaccaagggactgagatagtgacaccctcctttttccaggctccgtgagcgccaccaagatgttcttagacagaagctgttcaagctgaagcaggagcagggtgtggagagcgagccgctgttccccatcctcaagtcggagccctcggccgcccacaggtgagcagcgtgacccggcaggtggggcacccttaggtgggtgaagaactggtacaagcctagcaggatgggcctcacctcttccttcaccacccgtacagccccgaacctgaggagcgaccccccagccccgggacttcagtggacccagtggagcctgtggaacctgaggaggccacagcaccaggagaagcagagggggaggcagaaggggaggcagtgctgatggaggaagacctgatccagcagagcctggcggactatgacgccggccgctacagcccacggctgctcacggcacacgagctgcctctggacgcacacgtgctggagcctcacgaggacctgcagcgcctgcagctgtctcgccagcagcttcaggctacaggtaggggctggcccagactggggaccttgtcatggcgggggcagggatgggtgtgggcagccccaggtgacccctctgccctcacaggtgatgcgagtgagagcgctgaggacatcttcttccggcgtgcgagggagggcatggggcaggatgaggcacagttcagcgtggagatgccactgggcggccgggcctatctgtgggccgacaagtaccggccgcgaaaacctcgcttcttcaaccgcgtgcacacgggcttcgagtggaacaaatataaccagacgcattatgacttcgacaaccctccacccaagattgtgcagggctacaaattcaacatcttctacccagacctcatccgtaagcgcgccacacctgagtacttcctggaggcttgtgcagacaaccgggactttgccattctgcgcttccatgcgggaccgccctacgaggacatcgccttcaagatcgtcagtcgtgagtgggagtattcgcaccgccatggcttccgctgccagttcgccaatggaatcttccagctctggttccacttcaagcgctaccgctaccgtcggtgacacctgtgggctgcctgcccctgtcaggctggcccctggacagctcccaggtgggaaggccaagaggaccaggaggcctccttcagaagccgtaggaatctgtggacttcagtcaccagcactgtgctggccgcagcccctctggcagatccctgcctgtcctgaaaggatttttaactgttcttgggaagactgcttggggtggcagaaaggtcttgtttccatggacttgttcaaccggggaaccccgtgtggttttgatacatttaatagaaagcttattctaaactggcttctgatctgagtcacagggcagataccacacccagatggctcagggaattggggtcaggactcagggtcttctctaacaagaccactgccgtctggggagacatggctgtcaccactggggtgggtcattgtttgcacccagtggaggccaaggataccaagtgtcacccattggcgaggctgagaggccaccctgtcatcccagcccctaaccccatggaatgtagcaagacacacacctgtccagataggactatactgcagcccaaaagtagccctgtcctgttagcccagggaggtgtgactaatggcctctgccgtggacactcactcatccccaaaagtcccaccaggacagagctgggacatctgagcttaggagatacttgtatgccttacacagcacatagcatgttgggcctccgtttctttacctgggctacaaggggtccatcccctcccccactacactatgaagtctccggcctgttggcttctcctgtgtgcagggtcccagcttgcaaagaggcagaactggggaaggggatgggggcatgcagctaagggcatcctgaggtgcccagcgttggagagcaggccccgccctccggaagggggtccagccatcccagggcactgaggagccataggtggtgaggcgggcatggatgcagacccttgctcagacctctcccaatgcacacaggactctaaagtcccggaaactgcctccagctcccacgccagttgtttccttcctttggctgtgtccatggctaagaataggccccatagcctggcccccagcctcggcggaagccacagccacagggggtacatcctgagcctcagctcccacaccaacccagcatccttgagcccaactcctgtccttgactgtggttgggagccttagcaggaaactgcagctccgggcctcacctgatggtcttgtgtgggctctacatcacactatgtttctgcctaagtttcaccatgcattctgagctctgtcacctccacacaacaaagatgagtgtccttcagccattacctgattctccagaccaaacatatccttatctcaggtcaagggacagaggaagaacatacaaccacctctctgtttcatccaccccaacccatccacatcaagagcagcctcagatcctcttcccaccacagctcctcaccctcaccaccaaacattcctgccaggacacctaggcagggtttctctgtgtagccctggctgtcctggaactcactctgtagaccaggctggcctcgaattcagaaattcaccagcctctgcctcccaagtgctggggttaaaggtgtgtgccaccacgcccggcttttttttttttcttttaagatttatttattattataaataagtacactgtagctgtcttcagacgcaccagaagaggccatcagatctcattatgggtggttatgagccaccatgtggttgctgggaattgaactcaggaccttcagaagagcagtcagtgcttttaccggctgagccatctcaccagcccccgaaaaaacccaatcttcataccccttacacccacagtattgatacctagccaaatgttgagaaggtaaagacatttgttttgcctcagcagcctgagatcagaaacgtgggatgatctgtgtccatttctgtccctagcttatgggatggatagacagggcaggcccagctaggaaatcagaggaactacaaacttcacgggggtagaggccagtcagggtcaggacctagtgttgggatgggtgggaaggcaggaagggtgggggtggtgcagcaggcaaggggcttcctgctgctgacaagagtctggctgaccctgggcagactatggaactgggaggttgaggtcacagccaggccaggcatctcaatccccaccaggacctgtcagggccaaagagacccaaggtcacctcctccacgcaggcccccctcctccagctactaggcacaggactaacacccctgcctggctcagtcatcctgggcaactgtcagggcttcaggcagtgagtctgcaggggagggttccccaagactgctccatctctagaggacagcctggtctccgaccttacacctcccctaccccagccctctccttcccctccagctcttggtccctgcagtcaggctggagctggccttgctgacccaatatccctggaaggctcctggacagccttggcgaaggttagttgctgctgtgtcaggaccagccccatttggcctcccagctcttcccacatggcctccctctgggtccctgacctttcaacaactgatgtctctctctactctgtcacccttgtgccctgcttggttcccaccctagcggctgagaggcgaggccagcgccagcgcagggggtggggctgacgagagtcggcagaaagacagatggagacagggcgggacgggaaacagcctcacagtcccatccctccagccctggacgcctgagggtctccagtgctcccctgtacccacggccccagggcttctgttggggcctcccctcaaccaacgtgacttggtttccccagggaactcccctacctgctctctctgcctggcctggaacaccacagaggacacctaggtacaaacagcacaggtgagtcccttgcctccctactgtgactataccactgtacccaggtaagcctctgcatagatcctggggaacccagatccactaacaaccctgctgtggcctgcctacaggggggaatgatagcaaccaggtgccaaagttccctgaaggggatcctgtggtgtgacatttactccggtggtctagcctgggcaagtgcagtttccctggtggtacgtgggtacactggtttcctgtgtctgggtgaggccagtccaagatgctgtggcagtgatgaagttgggggtgggatggaatggagctgggagctacagtgtgtggcttggagctgggcatggtgattgtactcacataggctcagctcagaacctgggtcacatctcgatggcacatgtcctacccagagaggggcatccatccaacatgccagaaaacaggcctcggggcccctcccccagcccactgccacaggatgacacctgcaccctggaactgtggcacaaacaggaagcaggcagtggggggaacagcatgcggtgaaggtgaacctgagtctgtggggttgtgggcatgcacactgggtatttggggtgctggcagaacagcccactgggcacagctgcggccaaggctcagcctcaggagctcataagcagaaagtcaccagggaaggcaaattcgttacacggggaaaactgaggctgtgtagcgtggctatgggtgatggaggtgtggggagcccaggctgctctgaggcctggtgggggaggcttgttgcagatggaggagttgggagaaggaggaggggcctagcctgcagagcccagccacacaccacattccaccaaggctggaactcagccacccagcctgggcctcaaggaatgagctctagcgtcccagggcacacatatacaaggatgaggccccatcctagacagaataccactgccttccacccccaacggtgggaacatggctcaggaacgcaggaccatcccacatcccagggactcagggtgggagggttccagaatccttctgcttcctggtgtccaaagctggggtgtggtggcctgtgcctgtcaccccaacagaagctggaggcagatggagctcagtgagttccaggccagcctggtctacacagagtctgcatgaggacaaacagaattcctgagccttgaaattcccaggcccaaagctccctgctccaaagctgtggaacctgatggggcgcagagacgccaagtaagtctcctgagaccacacagcatgggctgctggccagcgtgggaggctgccaggtctgcctcaagtctcgcctaggcaacttgagctcaccattatcacttgaaccccaggggaggaaggaaggggctggaaaagccatccctccttgatgcttgtctccaaagagctggcttgtgagggacctggtggccttggtgaggctgggtcaaggactggacagagcagggggctgaccaccaatgacgcccaccttgagaaagggagcatatgagtcctggcactgaaactcagagataggcagagcacctcagaggcagggctatgccatccaccaggccgcccaccctgacctcatccctgagcctcaggttcatccctggatcttcctctggatggtgcaggcccagccaggcagtggtctgtagtaaggcctcctaaggggatcgtggaagcagcacctactaggctgcttatacctgcatggagcattctgggttgcataaattaaacacctactgtgtgccagatgtaggtgccagaaataattgttctcagcatcagctgtctttaccagaagaaaaactgaggctctctgtggggatctgggggcaagaacagatgatgcatcccaaaccttgagtggccaactgttaaaaccctggagctcaatgggagggaagaagggtctggaggtggggagggagaaagagaaagccaagggctagctatgtggctcagtgggtaaaggtgattgcagccaagcctgacagtctgagttcagtctcccaagacccacgtggtgaaaggtgagaactaatacccactaagtgtcctctgacacacacacacacacacacacacacacacacacacacactggactgtgcatgtgcccttgcacacccccacacgtaaatgaatgatgtgaattaaaaacaaaacaacaacaacaaaaaaaaaaaaaaaaaaaaacaaaaaattaagaaaaaagggcaaacatggttcacaccaagaatctgaggcagggaggatcagcatgaattgccagcctgggctgcacaggaacactgggtgactgtcagacttaggctactgcctgtctctggtctctggccttggacttgtctggttttctttccttttctttccttttcttttcttttcttttcttttctcttttctttcctttccttttctttcctttccttttttttcttttcctttcttttctctctccttccttacctccctccctccctccctccctcccttccttccttccttccttccttccttccttccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtgggagtgtccgggcaggtaccaaacccctggccataacgagtgtccccacaacctcacaggctagatggatgacagatagggaaactgaggccacacagtgagtacaaggactggaactccaacctggagtgcagggtgtcagaacacatctttgtcatttcagctcctcagaaggttgaggcaggactacttaagagttccaggctgagctgggcgtggtgtcgcacgcctttaatcccagcaactcgggaggcagaggcaggtggatttctgagttcgaggccagcttggtctacaaagtgagttccaggacagctagggctatagagaaaccctgtctcaaaaaaaaaaaaaaaaaaaaaagagttccaggctggctgggccacttcatggggtcagaagcagtcgcaggaccaacagtgatccggcagttgaaggctgcctcaaagaaagggtattttgttcctgaggcattgaagtctctgtaggagttctccataggcgctcgagtcccactgagcagcccaccttgtcttccaggtgcgctggaatcagcgccagcccaacgtccctgccattggtgtctgatggggtgctgaccccctcgccgcgtcaggcttaggagccatgtggcccaatggcacctcgctgggggcctgctttcgcccggtgaacatcacgctgcaggagcgacgtgccatcgcgtcgccatggttcgctgcgtccttttgcgcgctgggcctggggtccaacctgctggcactgagtgtgctggctggggcgcggcccggcgcgggaccccgctcctccttcctcgctctgctgtgcggccttgttctcaccgacttcctggggctgctagtcaccggcgccatcgtggcgtcgcaacacgctgccttgttggactggcgagccactgaccccagctgccgcctgtgctacttcatgggggtagctatggtgttcttcgggctgtgtcccctgctcctgggggccgccatggcctctgagcgcttcgtgggcatcacacggcccttctcacgacccacggccacatcgcgccgcgcctgggctactgtcgggctggtgtgggtggcggccggggcactcgggctgctgccactactggggcttggccgctacagtgtgcagtaccccggctcttggtgcttcctgacactcgggacacagcgcggtgacgtggtcttcgggctcatattcgcactcctgggcagcgcgtccgtggggctgtccctcctgctcaacaccgttagtgtggccacactctgccgggtctaccacacgcgcgaggccacacagcgcccacgggactgcgaggtggagatgatggttcagctcgtgggcatcatggtggtggccacggtgtgttggatgcccttgctggtgagtcgtccccgccctgcccccgccatcccctcccccacgccccccagcaacatgaggaccttctttagttgtatctcaggagaagggcaatcctggggttcaggtctttggggctttaggaatctgcaggatgtaacaggaaagactttcaggtgttgtgtgttctaaagtagggctttgaaggatgaataggagttcacctgctagacaatgttggggaaagcattctggccggaatggctggatagtccactcaatattgctgtgttccctggcaccacatagactccaggcttgtatagatgtcctcctgggaggttagagcccagctgataggactttaacgtgggcacaggtttttgttttgtctttgccttgttccgccagcaaacatttattgtgtaccatctgtatccaggctcccctagcacaaaggcgactttcctctgggagagaggaggtgtgtggttcccaggctccaaggtctgtcccaagctgctggggcaatttgactagaccctatctaaaataaaatgtagccaggcgtggtggcgcatgcctttaatcccagcacttgggaggcagaggcaggcagatttctgagttcgaggccatcctggtctacaaagtgagttccaggacagccagggctatacagagaaaccctgtctcgaaaaaacaaataataataataataaatgtaaaccgggcatggggggcacacacctttaatcccagcactcgggaggcaggggcaggcagatctctgtgagtttaaggccaggctggtctacacagtaatatcctgtctcaagaaacaaaagaatcaataagaaggagcagttgttggagactggcttagggtagattcctgcctcagtaagtccaagtttgctttttttgttttgttttgtttttttgagacaaggtttctctgtgtagtcctggctatcctggaacttactctatagaccaggctggcctcaaactcagaaattggcctgcctctgcctcccaagtgctgggattaaaggcgtgcgccactatgtccggctcgtccaagtttgctttctaaacctcagtccaagtaggacgtgatgagctcaaagcctgtgctcattcctggacccagctgtagcagcagctcagaggttgccccactgctccagggtcacacagtacaaccctctgctcctgcaggtcttcatcatgcagactttgttgcagacaccacctgtcatgagcttctctgggcagctgttgcgggccacagagcaccagctgctcatctacctgcgtgtggccacctggaaccagatcttggacccctgggtctatatcctctttcgccggtctgtgctccggcgcctgcatccgcggttcagttcacagctccaggctgtgtccttgcgccggcctccagcccaggccatgctcagtggaccctgaaggacagtgccacttaaacctggggtccttggtgactgccattgacctgtgccctgccccaggagcctgagtgcttggtggactaaggacggagctacgacatggggctgactcctgtgaactgcaaagatacctcctctatgctagagaggtcctccctgaccctctccccggactactccctgtcagccaggaggctgggggcacatgtgggaggccccctggcaggaatctaggattccacagggaaaacctgggatgctggaggtgtcttcccccttgccagcatctgagtctgagacacagggcttcacattcctccaggctcacaggtcaccagccttgggtgttggaagcacccactctgttccctgtagctgggttcaccaacctctccagtgtttcctgagcccccttgctccatggctgcctaacacacatgctcaataaatggttgaatgtccagattctggagcactcccctaagcatccctgtgtccattcgcctccctcccccgcagctccaagaaaaccacagtcaagaggagactggcggctgtggaggtgcgggctcctttattgcccaccaagatctcctaggagcctcccacccctatgccttctatggctgggtcctcttacaggggctttggggttcgtagccaggtccctgaaacccaagcttcagtttctaccatcctgtaatcctgctgggatgagtcaagtcacaggctggggtgggggagggacccagacccaggggaggggctaggagtgatgcatatggtgggggggttgggcttctggcatcccagctggggcttgggcaaaagggctggcttctggggagtgtctgggcctggtgacccagggcccaggagagagagtgaggggcctggcctggggcccgctgtggcctgggttccatcttgaggccaaggcccagcgaccttgctcggggcaggggtgggggctcttggggtcagtgggcttggagactgaggtcgggtcaggggcttaggctcctttataggctgaaggccaggggtctgtgggcggcgactgtctctaaagctgagggggcgggctactgtgctgggctgacttccagaagtgtcggggctggggctggggctggggctggggctggggctggggctggggctggggctggggctggggctggggctggggctggggctggggctggggctggagtctagccgggttctggaactggaatccttcccagcgctgggctgggctccagtgcgtgatggaacctgaagactgacttgggttctcgaggctgagtgggctgcagagccaagccactgccctgtgttctgctgggggacacagctggctccagttgtcaccgagtgctgttttctgcctccagaactagagagggacctggagctgggctccttctctgtcaatgactgtagctgggaccttcgatgtctggcccaacctacgtaggctccggagctaggccaggcctggaagtcggtctgggtcccagagtcggactgtgtcctggagcctgcatgccatcttctgggtggagtggggtcagcactctgagacaaccctaagctgggcctcgatttgggagtgcatggcatttgggggtggggctctgctgtcagagccttcctgctcctgcccctgggctgagcctcagagtcagactcatcactggggctagcttggggttcagggctttgggaggcactggtaggtagctgtgctggggaacaaggctgaggtttgagtttggactgggtagcagtatggctctgagtgcctgcactaggcaggggtgtggaagatggctggctactggagcctacttgggtttcatcagtcagcggctcgctggaccttgcttggggtcccaagcaagcccttcttcctaaaccactccaagtctcagggaagggccaggccatggtggtggctgtctcatacctgggctggctctcagaacctggcttctgagactggctgctggggtggtgctctgagcccagctgtctcctaacatttgtctggattccggagtgtggctgtgggacggggcttggctgcattctggaaggctgagggtcagccatgacctgggctgcagcatcagggttggtcccaatgtctggctgggctctagagcatggtttcctatctgggtggatctgtgttctagaaccaagcccactctcagagcctgactgtgttctggaagtggacttggtctccaagcagaagttgacctgagggctggcttgggttctaagtcgggcatgagtgtcagaatttccctgggctccagaatggggtgtggcctcaaagcctggctggacctcaggagccaggctgggttctagggatgggttggcagtcaggttcaagatgagttttagaacaaggctcaggcctggggctgctctgggttccaaagccagcctgagcctcggaagctgacctgtgttctggagtcagactgtaccccaggactaggctgggatctaaaggctggctggacttcagaaacaagggttacagaaccaagctgggccttggggtgggcctgggtcacagaactgggttgggttctagagttatcctgggcttcaattttggttttagagcaggactggaattcagggccgaccagggattccagctgggtctcagagctgagctgggtgctagaatcaggctgggccttgggatgggcctgggtcacagaactggctcgggttctagagctgggcaagacatcaactttggttctagagcaggagctggccttggggctaacctgggttccagaaccagcctggaattctgactgggtgctagaaccaagctgagtctcagggtgggcctgggtcaaagaactgggtcgggttctagagctgggctggacttcagtattggttctagagctggtctggccctcggagctaacctgggttccagaacagggatggggttctggctggctcttagagctgaactgggtgctagaaccaggctgggcctcagggtggacctgggtctcagaactgggttgggttctggtggcgggccttgtctcagggctgtcctgggatctggagtggcgttggggcaaggggctgggcccaggactggagactcccacacacgctagccacaagcgtcgtgggcctcgccgatagctgcccacacctccaccacgaactcgtctggaaaggcgaactcgcccagaacggcgtccaggccgcgtgcgaaagcctgggctcccgccgagctccgagcagtctccaccaccgcggccgctgcgggaccagacagacagagggacaggatgcacaagcaaaagagatggaagggcagacggaaggacagggaggacagacagactgactgtgagctccggcgcatgcttccacctaccaccctcccgcgccggggaccccgcgcttacccgcgccgcttacccagctcggggtctcggatgcccatgtagctctccagcaggtcgtccaccctgcgcgccgctgccgcttccacatcgctgggctgcggataggtgaatggcccagtggatgagtgacaggctggagggcccgccccaagattgatagactattagtggttcctaggggtagggggtgcggaaccccgcttctgagaattgacagagttgtggttgctggaggtgacgccttcccgattgatagtggggagggcctgggtgactcgcccccaggagtgataactaaagggataggagacactttcttcagtggtgtagtggatggtctgtgccctgacacaaaccatgtgtcattatgaagaggtgagaggaggagacagaggtctgggtggaagaggtaaggagatgagagattgggtgatggatgtacctgaacacacttgaagaatcagacaagacacacattacctagtccagttaatacacagaattccacctctcaaggcgctccgagcgcttcgtgagactctcgtctcacaggcatgaggaactgggtttgagctctagaaggctctaaaggtggaagtgagaactgctccccacatgtcctctgacctccaccctcctgtccacgcactttccaaacacgtgcacacacaaagtacacaagcaaaatataataaaacaataaagaaatgccatttaaagatttaaaagctgggcatggtggcgcacgcctttaatcccagcactcgggaggcagaggcaggcggatttctgagttccaggccagcttggtctacagagagagttccaggacagccagcgctataacagaaaaatcctgtctcaaaaaacaaaacaaaagatttaaagttggagctggacatagttgcacagcacacctttaatcccatcacttgggaggcagaggcaggtggatttctgagttcaaggccagcctagtctacaaagtgagttccaggacagccagggctacacagagaaacactctctcgaaaaaacaaaaattaaaaaaatgataataaattaaaataataaaataaaagaaataaaaaaagatttagggctggtgagatggctcagtgggtaagagtacccgactgctcttccgaaggtcaggagttcaaatcccagcaaccacatggtggctcacaaccatccgtaacgagatctgactccctcttctggagtgtctgaggacagctacagtgtacttacacataataaataaataaataaataaataaataaataattcttattaaaaaaaaaaagatttaaagttgggctggagagatggctcagtggttaagagcactggctgctcttctgaaggtcctgagttcaaatcccagcaaccacatggtggtggctcacagccattcgtaatgagatctgacgccctcttctggtgcgtgtgaagacagctacagtgtacttacatataataataaataaatctttaaaaaaaattaaagttgaagccggcagtggtggtacacacctttagtcccagcatttgggaggcagaggcaggcgggtttctgagttcgaggccagcctggtctacagagtgagttccaggacagccagggctacacagagaaaccctgtcttgaaaaacaaaacaaaacaaaacaaaacaaaacaaaacaaaacaaaaattaaagttggggagtaagaaagacacagatattgacctttgacctctgtatgcatacacacagtgcaaaaaaataaccaataataataagttagaggtcacgatggtccctcccgctccttcgccaggaacaggtggcacccattggactctgtgatcggagctgttcctgttgtcctattctccaaccggtacccactgcacaagctgaaaaactgcggctctgagaacagggtctattcataggttcaggctagccttgaacttgtgaccatcctcctgcctcatcctcctgaatgctgggatgaccagccttatcaccattagcactgtgggcttgacaagagggtgtcaattgctgccatcccaacagtcactcaccgcctcctccacagtggcagccccccctgagcgcaggcgtaatgtttccctcccgctgctcactttagcttccacaggacacttgctgctcctgctcctctggccaatcatatctgagggggcaaagcggtgacagatgtgtcctgttttgtgtggactgtttttcatgtttattttcttttgtcaatagggtcttcttctgtgacccaggctgaccttgaactcaaggttggcatgccttaatctcctgagggctgttgaaggactatggggctacgggtgtggtcagggggtaaagtcccatctaaaaccccccagtgagggacttggggcgtggtcagggtggagcccctcctagaatcctccaatgaggagataggggcgtggtcaggcatagagcccccacctagagtcccctattgatgggttgtgggtgtggtcagggtggagctccgcctagaacttctgtgaaggagctgcgggcgggcgtggtggtggaggttcaggtcctcccctcccttaggatcctccagtgaagggcttggggtgtggtcagggttggagtcctggaggtttatattattctttccctaagagaccctgctgagtgatgtctggggacatgtctggctatcctcccctgaggagctcctgacaaagagtaaggaacactgctcagcaccctgaagagcccgggacactacacagaaagcaccccaaaacggtgcggtgctcacatcgccaagtttgaataacttttctagaagcaaccctcctttctcgaagtcattgcaaagcaggcccaaggtcatctttgggtacatattgagtttgatggcagcttgggctatgaaaatatgagtcagaataccatttcctgcttctcattgccctggggcaagcctggggcccatcaatccttaccaaaagctctccggggctgcactagacgcagggtgaagggctgagacttgggcagctcccggagcattttagccacctcgtagtgccggcagcccacaatagagtggtcattgatggcctcaatgctatcccccacgcacacagcctcaatccggttgataatgctgccttccttgattctctatgggaaatgacaatcactcgtgactagtctgcccggggccaccctccctggggtccccagagtcttcttaggactcgacaaggccattgatcacccagttcacacacacccacaggcaccttgatgaaggcgtatccggctccgttgtctgtgatggtcagtcctagagcatcctccgttttggtgacctccacttctttggtctctccacgcacatgtgcaaagatgaagtcttccagcccaatctgtccccccagcaacttttgcatgtccactttgtgactgttgagggtgcagaataggatctgttcggataagagagggacccagattgagccatggacaaaagtcgattctgtgcacatccttctgcgggcgccccctggaggccagatgcacccgtggcccgcaggaaacagcagctgcccccagcctctaactgctcaccggtgaccaagtgggctggcaagactgtgggtgtgctttaggtctgtctgttcctaagcaggaacttaggaagctgaggcagaaggatgactgagagtctcaggcttcccaaaaataaaaaataaaaaagccaagcatcctgaatcgggagtgtaagcccagaagtcgggaagccaaggcaagggaaatgctggaagttagaagccagcttgggttacagaatgaatttcaggccagcctgagctacaaagcgaaatattatcttaattagacgaacaagcaatggaatgaaaacggacaagagggctagagctcagcggttaagagcaccatctgcttttctgaaggtcctgagttcaaatcccagcaaccacatggtggctcacaaccatctgtaacaagatctgatgccctcttctaaagtgtctgagacagctacacagtgtccttacgtataataaataactaaatctttaaaaaaagaaaagaaaagaaaatggacaagaaggctggagtcaggagggagggagggagtgggaggggcttgtggccagtctgccaagtcctgaacctgtttgattctcaagggctgcatgtggaaggagagtactaaccccttgcaaactgttgcccaacctccaccgtggtgcccactctggtgcccctacatataataaatcaaacccacactaagtgggtggcccacacctttaatcccagctctctagaggctgcagcaggtagatttctgtgaatttgaaatcagactggtctacagagctagttccagaccggccagggctacatgatgagactgcctgtcttagaaaaacaaaattaaaagaaagaaaacaaacaactgaaagggaatagtagaaataattgagttgaaaaaaattaaaagtgattttattttatataaggcctcatgtagctcaggctgaccctctagtttcctatgtatctgaggatgaccagcttaactctcaatcctcctgcctccaccttcccagaatcggaataacagactttacatcactacacctgctttatcctgtgtcggggatggaaactggctttccaaaccctaggtgactgctctacccactgagctgattgccacccattagccattcatgggctcctgacacctgggtcgggtcctcggcggctatgggaaccccactcccagggtctgatcctgtctttcgcgtggagtgcagacaggatcctgggtggtgtccgcggtccaccctcacctcggtaggagcgatgccgaaggcctcggcgatcttggcgtaaagctcgcggacattggtgaagccctcgatcctgccggtcggactgccgtgcgccagctgcgtgcggaacactaggcgcgggcgcgcgcgggcggggggctcggtggccccgggctcgcggggcgcagcactgtccatggtgcgtggggtccgccgcgtcctgagcctcccgccggaggtcccgcgacagcggagccgggcgtaagcggatccgggaacccgagccgcccgggggaaaggtgaaaccgcccgccggggccagccgcgccctcccccgggactcgcgaacaacaggggggaggccccgggctgtgggtgctgcgtccagtcttggcctcccggggagccccgcccgtcctccccttctccctcctccgctccgcacacagcccaccgtccatgtcagcggtcttcccgcagcccccgaccctgtctgtgaactccgtgccttgtccctctgtctatctggcctcgcgtgcctccttccttgccctacctcagggtccaccctgcctcagggctcttgcacaagctgggctctcctctggggctcagtccccagagctcccagtgagttcctgctcacctgtttattttaaagaccacctgcggcccctacctccaaatctctcccttaataatttttgttttgtttttgagacagaatctcatgtagcccaggttggcctggaactcactatgtacccaagggtgaccctaacctcctcctgatcctctggcgtcagactccccaatgatggaattaaagttgtgtgcactacccctggaaaaataattgtcgatagccaggcagtgagagtgcacacctttagtccaagcactgggaaggtagaggcaggtggctctctgagttcaaggctagcctggtctacagagcgagttccaggacagctagggctatacagagaatcctctctcaactcagcccactctcctggcaaaaagaatttttgttaagaaatgaagaccagggctggagagatggcccagcggttaagagcactgactgctcttccagaggtcctgagttcaattcccagcaatcgcatggtggctcacaaccatctgtaatgagatctgacgccctcttctggtgtgtttctctgaagagagcaacagtgtactcacatatgtaaaataaataaataaataaataaataaataaataaatctagaaagaaagaaagaaagaaagaaagaaagaaagaaagaaagaaagaaagaaagaaagaaagaaaggaaggaaggatgaccaaaccactataaaatgctactttttcagggatccccaggtatgtggtgggtgaagtggggtgtgcaggggtcaatgaacatctgaggctgtttgtgtcttctagattcccacgacagagtgtcacaacgtaggtgacttaaaagaggaccaacaacggaaactggagggatggttcagtggttaaaagcactggccagtaactcacctccaactataattggatctgatgccctcttctggcatgcaggtgtacatacagagagagtattcagagagagagagagatctgggcataaggacacccctacctggggacgtggaggatcaaggtcatccttgacacacagtgaattccaggctagccttggctacatgagacattgtcacaaaacaaaactcagatgaacttaatccttcctcagttgataagtggaggtgctcccctctctcccggggctgtgggaggctgtcttcgactctggcagtccttgactggccttggcccacaggcctgttgtgcagtttctgcctctgttgtcactaagcccgctcctaggcctgtgttaactttcctgttctcaaaatgatactcgctgctggcatagtgcccactctaccccaacatgacctcactcaagttaatctcactgttttcctcctgattcccaataaggccatgcctgggggttctggggtgaggacaggagcacatttggggggatacaattccttggcacagcatatgtgtgctggattgggaagttttacaagata

SEQ ID NO: 200 - DNA, 1670 bp, Mus musculus
caacgtgacttggtttccccagggaactcccctacctgctctctctgcctggcctggaacaccacagaggacacctaggtacaaacagcacaggtgcgctggaatcagcgccagcccaacgtccctgccattggtgtctgatggggtgctgaccccctcgccgcgtcaggcttaggagccatgtggcccaatggcacctcgctgggggcctgctttcgcccggtgaacatcacgctgcaggagcgacgtgccatcgcgtcgccatggttcgctgcgtccttttgcgcgctgggcctggggtccaacctgctggcactgagtgtgctggctggggcgcggcccggcgcgggaccccgctcctccttcctcgctctgctgtgcggccttgttctcaccgacttcctggggctgctagtcaccggcgccatcgtggcgtcgcaacacgctgccttgttggactggcgagccactgaccccagctgccgcctgtgctacttcatgggggtagctatggtgttcttcgggctgtgtcccctgctcctgggggccgccatggcctctgagcgcttcgtgggcatcacacggcccttctcacgacccacggccacatcgcgccgcgcctgggctactgtcgggctggtgtgggtggcggccggggcactcgggctgctgccactactggggcttggccgctacagtgtgcagtaccccggctcttggtgcttcctgacactcgggacacagcgcggtgacgtggtcttcgggctcatattcgcactcctgggcagcgcgtccgtggggctgtccctcctgctcaacaccgttagtgtggccacactctgccgggtctaccacacgcgcgaggccacacagcgcccacgggactgcgaggtggagatgatggttcagctcgtgggcatcatggtggtggccacggtgtgttggatgcccttgctggtcttcatcatgcagactttgttgcagacaccacctgtcatgagcttctctgggcagctgttgcgggccacagagcaccagctgctcatctacctgcgtgtggccacctggaaccagatcttggacccctgggtctatatcctctttcgccggtctgtgctccggcgcctgcatccgcggttcagttcacagctccaggctgtgtccttgcgccggcctccagcccaggccatgctcagtggaccctgaaggacagtgccacttaaacctggggtccttggtgactgccattgacctgtgccctgccccaggagcctgagtgcttggtggactaaggacggagctacgacatggggctgactcctgtgaactgcaaagatacctcctctatgctagagaggtcctccctgaccctctccccggactactccctgtcagccaggaggctgggggcacatgtgggaggccccctggcaggaatctaggattccacagggaaaacctgggatgctggaggtgtcttcccccttgccagcatctgagtctgagacacagggcttcacattcctccaggctcacaggtcaccagccttgggtgttggaagcacccactctgttccctgtagctgggttcaccaacctctccagtgtttcctgagcccccttgctccatggctgcctaacacacatgctcaataaatggttgaatgtcc

SEQ ID NO: 201 - protein, 354 aa, Mus musculus
WGADPLAASGLGAMWPNGTSLGACFRPVNITLQERRAIASPWFAASFCALGLGSNLLALSVLAGARPGAGPRSSFLALLCGLVLTDFLGLLVTGAIVASQHAALLDWRATDPSCRLCYFMGVAMVFFGLCPLLLGAAMASERFVGITRPFSRPTATSRRAWATVGLVWVAAGALGLLPLLGLGRYSVQYPGSWCFLTLGTQRGDVVFGLIFALLGSASVGLSLLLNTVSVATLCRVYHTREATQRPRDCEVEMMVQLVGIMVVATVCWMPLLVFIMQTLLQTPPVMSFSGQLLRATEHQLLIYLRVATWNQILDPWVYILFRRSVLRRLHPRFSSQLQAVSLRRPPAQAMLSGP

SEQ ID NO: 202 - DNA, 24898 bp, Homo sapiens
gcagaaatgcagagagtgtaacgtgtccgacgccccacacccgctgccctagttgctgctggcatttgtgacacagcgcatttgtcccaagggaagagcctgggaaacaacacggcacccaactggggcccggtggtcccttgggagctgtgttagtgcccggatctgtctttgccccccacccctctgccttgcctcccacagtgggggtgacagtccatttcccagacgacaggagggagggtacaagggtggacacagctgctggcctgggcccaggctctcatgggggcagcgcttggccatgcctgggggcattcgtggtggtcccaccttggggctgctcctggcgtggagtgagtggaggccagggatgctgcccaatgtgcttcagtgcccaggatgagcctccccaaatgtcctcactgcagtaggcagaggtgcaaggcagatcctgcactcccctggggcactggtcacctcccagcccccacctctaacaggatcccggaagtctgtggcacagggcttgggaactggccagggaagtgcatctgatcagcgtccgctctccacaccgcagaccctggcccaccctgaccagcctactccagaatcccaaatcgcattgcagcacacacaacactgccatccccagcccagccttcagcagacatcacaagttgatggcagatggccagagccatcttagaatcctctgggcagcctcttgcctgggttcctggccagctccaccgccgatcaggacaggctgctggggcagggctgagtccgggctggactcggggggcactttttatttttttgagacaggctggagtgcagtgggcgtgatcacagctttctacatcctcaacaccagaaggcacttttgagcccagagtggtgtttgggacaggccgggttctgtagtcacagcccaggttgtgtgtgcgtggctggcgcagcccagcctgtactgggcctaacccagacctcccaccagctctatgtgacagtatttacttccatttggctgctcgggaaactgaggctcacaaaagcccacgttgttgagcccagaaagtggcagggccagtattagaagctgggtttctctaccctggagaatcccaatcccagaccaccaccccgtccctgcctcagtttccccacctgcccctgcagagattcccccagccccagcatcctgcttcctcctcctcacgttccttttgcaccccaagggagatggctgtcctccaactggcaagacacatggtttgccaggggccccagtctggagggagcagagctggggccctgggacccctgaagggtcacgggcactgagcctgggaagacgggctgctggccgagaagggtgacggctgccttgcagaggacagggcagcaggtgtgcccagggcagggggcacacagggctcaggccaagctaaggagccagatcctaggggagctgggcaccagggagctacggagggcgcgtgagctggggagggcctccgagctgggtgtcgagaccctgcaggcagactggaggtgggggccaggggtaggctctgcacaccacccccccatctaccccatgactctccaccatggcccgaggtccacctggtgtcctggaagctgcccccgcccccacccagcttcctgactttggctgtgtccagagctaagaatagacgctccctgcccggcccccgccggaaaccgcagccacgggggtacatcctgagcctggcctctgttcccaccatctgccccccagcccctcacaactcctcccaccagagcctcctgtgctcccattgaacccgaagtgctggcggggggtggggggcggggggcgggccaagaccgggagaccagcaaccagccccagatgacagggaagcccagtgctcatgttccaatcccacacatgggcgtggcattgttccccctttgtgcctcagtttccccatctctaaaatttaagagtatctttaccccctgccttgcagagatgtggtgaggcttaagctaaatgcaagtgtccttctctgaactctgcccaggctgtttcccagaagagtcattgtccttgttatctcagggccgaggacagaggaagtggggacaggacagccttcctccgtctctcactgccccctcatctggagccccagccccacatcctcctcccccaacatctgccctccttgcagttagtgtagcaagggcctcatgctctctcttgcctccaaagctttatacatgcaattcctgtcactgccacgtagcccagacctggggagctcctattcatcctacaaaaccccacttcccatgccctctcctcacaagatgtcttcctagctcacctctgggcttccctaggccctgtctcttcctttggcccagccctgaccccagggggctggaacagcctgtgtccagttcattctccagcctagggcatcctgaagggcaggcctggtttcaggtctcacttggagctcataattgtcccactgtataagctgaacacagagaggggttggggagagtaagacttggagattaggtcggcttcacgggaaagcagccttggagccagggttttgccacatccataggagttggatagcctccttgccaggaaagagagaagttgtgttaaatggctggtgacttaatgggatagagctttgggagggaggttgggtgtggccgaaggccaggaggaggaaggatagtgggcggggtagccggggaaggggcttccggactgggctgacgagagggccgggccaggctgggaatacccctcactcacagcctggactagcagccctcccgggcccaggggacggggtggggtgcagtcagggcaaggtcagcttgtccggtcccactccaggtccctaactcaaggttctgtccggctcgggtgtacaaacaaggccaaggaagcccaaggtcccccctctgcaaagagacggtcccagtccctgcgtccggcaccttctcagccattcctgttgggctccatccctccttccccagcccgagctggggggtggccaggaaagagtgcccatcccccactgcagcctcccggctccagactgttcctcctctggctccaaagccacctccgagcctcctcaagagaccctcccatgcgatgccatcaccccagccctcccggctcacctgctctgggaccacctttctcagtctggctgtgtcgtctggtgcaccccccatccctctgtcctcccaccccacccctggaaggggcctcaaatatgtcctgtatgtattaagcagggcatactactactgtgtgccgcgttccagcgcacccagtgaatttggagccctggagtctgggcgacccccgggagccgatccgcctggacctgccccgccccctccaggccttgggtgctgcccagatggtgaataatgcgggcctggcggcgggagcgccgggaagaggcctggcagggcgctgggcggctggaggggctgaggctcccgaggaagcgcccctgccacccctacgcgggccattgcatccctgccaccggtggcctgggggtcccaagggcgccgccttccccagaaggctgtagggtgtcccggcgtgcggggggcacccactgactccaagtcagccaggcccgggcccgaggggcgtggccagcgcagggtgggcggggctgatgagagacagcgggagacagagactggacggagagagcgagccgcgggctgccagcggcccccacccgtcccagctcggcttagcccccgcggacccctccaggccgcgaccccagggcgtcctgtgccgccacgccctccatctgtgtgggtcctctgctgggcccgcccctggtcacagccagactgactcagtttccctgggaggtcccgctcgagcccgtccttcccctccctctgcccgcccccagccctcgccccaccctcggcgcccgcacatctgcctgctcagctccagacggcgcccggacccccgggcgcgggatccagccaggtgggagccccgcagatgaggtctctgaaggtgaggtcgccccgctggcttagggcgggatgcactgctctggtgtgagcccgggctgctgggcgcatccggcgctggccctgccctgctgtgggtgtgtcgcaaagcccgcggtgacagcggccaggtgccaggtgtcccctgtgtggcccggcgggtggcatggtgccctgaggcctgccctgggcgcccaggcggctgggtctgggtgcggcccaggctgattctgtccggggggctctctggtctctgtggggccacatggctgtgaatgggggtcccagactcagggggctgcagccggggagggggcccaggccctgggtgtggcagggatcgagtgtggttgtgcggctgtgtgtgtgatcttgtctctgggagtgaaccatgcatggccctggttgtgtgtctgtgtctgtgcgtgtgtggtggttttgtgtgtgtgaccgtgtgtttgtttctgccgagagtctgtgactgttaaatactgtgtgttcttctgtgtgtctttctgtgtctgtctgtatctatgtacctgttgtgtttctgcctgtgtgtctgtgtttttctgtctgtgtctgtcacatttctgcctgtgtgcctatgtgtgtatctgtgtgtgtctatgtctgtcgtgtttctgcctgtatgtgtctgtgtgtggctgtgtgtctgttgtgtttctgcttgtgtgtgtctatctgcgtgtgtctgtgtgtctgttgtgtttctgcttgtgtgtgtctgtgtctgtcatgtttccatctgtgtgtgtctatctgtatgtgtctatgtatttgccatgtttctgtatgtgtgtctgtgcatgcctgtgcgtctgtctactgtgtttctgtctgtcacatttctgcctgtgtgtctgtcatgtttctgtctgggtgtgtctgtggtgtttctgtgtgtgtctatctgtgtgtgtctgtgtatctgccatgtttctgtatgtgtgtctgtgcatgtctgtgcatctgtctgctgtgtttctgtcacatttctgcctgtgtgtctgtcatgtttctatctgtgtgtgtgtctgtgtgtctgccatgtttctgtgtgtgtgtctgtgcacgtctgtgcgtctgcctgctgtgtttctgtctgtcacatttctgcctgtgtgtctgctgtgtttctgcctgtgtgtgtctggctgtgtctgtgtgtctcgagtgtgcacacacggtggtggcctgaggtgcatgttggtggaatcactgtaacttgtggtccaccattaaccaccagctgcacctcccgggtcccgccccctggtccctgctggcccctgtgtgacggagctccgtacatgctccctggggagcccccactagagagatggggaaagcgaggctcacagggggccatgtgacttagggccccaacaaggctggccggagtctggctggctgggggagtccccgccctgcactgtgtgggctggggaccctgttggtgtcacaaacaggaaatgttctcggaaatggagctttgcgatgaggggaggtgggcccatcagggtgtggagtgtgtctgcctccgctaccatgtgggggtccacgcccatgagcgttcagatctacagcaggcatgggagggtctggccggtccctgaagtttcagtcccaaaagggccctgtgggtccaaggtccaaggccgacaggggtgacacggagcctcagggctccctgctggctgcccgggcaccttgtagggagttgagctgtgagtacagccaggagccctgcagaggtgagagccagggaggcctgagcttagcacccgcaggcatggagatcagaagctcacccccattgcacagagcggggaaactgaggctcggcaaggtggagccccagcctggccacggcagatcagggactagagcctccaagcctgtctgggggaggtggggtgggctcaggccgtgacaggcaggcggggcgggcagggtggggtgctgaggagaggggacttgttgagaaatggatggatgatgaggtgacgtgctccagggagtgggggagggggcacgaggatggaacatggggcggaggagaggcctgctgtttgggaaccaaggatcacattccactggcaaccaggcttggggcagccaggcctggtgcccacgcccagcccagcgcccgggcctctggaaacagcgccggacagagccctccgagtcacacgacctgcaagccggataccctgtcaggggtggcatcggatgagggagaactcactgtccgccttccagaaagaagccaggaattaagacagagatttctggaacccgggacccaggcagattcccatcaaagttgcaggacctcagcctcttgggagttgcaggacctcagcctcttgggattctagaattgtgaggccttctgcgtcccaggactggaagcgtgttagaattccacaaccctgaacccgctgagggcaaacgtctgctctcagactgcaaaattctggagttattcaacatcgaaaagcgatcttgggtccacacctctccccagacacagggagggacagtaattttcccaagagccgcagtgctgctctactgccccaccgcgtgggggcccctgctacccctcctggccaatgcaggagggaagggaggccctgcccggtccccccattggcatccttgcctggagaacttgagatggctgccatcgcctgaagccagggtggggagtggaggtggggggattggaaacagccagctgtggccagaaggactcagtgccagtttccaggctcccctgggccaagggctctgggccatgcatttgctcccagccaccggaggtgtgagggagttccgggtgtgtgacccccggtgagtggagtggagtgtggtcgaggagaccctgagacccaggagggactggaagttgctccaggcagaggtcgggtcagtggccgcagggacagccgagtcccaaggaatgtccagaaacagcacataccagctctcgagggaggaacgccttgtcccaggggaaatcccagtgcaggaatccaaaccccaggcgccaaagcagcccggagtggagggcaacgatcgccagaggccgcgaggaaccccccaccgcatctgctctccaggcctcagtttctcctctggaagccctgcctcccaccacggtggcagtggccttagctgtcttcccaggaagggagttcagtgccgctgtcaggagctggataatttatgaggctggatacagcgtagccaaggccagaagccaggccaaagcgtcacaagtgagatggggagtgagggccacagtcacccatttgaccgccctggaatgcgttagctgctgcgaccccacagcccaggccctgcctcagggccagcatgcattgagtgcccgctgtgctgtgctgagtgctgcgcgtggatcccttcactcccgtcatcagcaaccccgactttttttttttttttgagatggagtctcgctctgtcgcccaggctggagggcagtggcgcgatctcagctcactgcaagctccacctcccgggttcacaccattctcctgcctcagcctcccaagtagctgggactacgggcgcccgccaccacgcctggctaattttttgtatttttagtagagacggggtttcaccgtgttagccaggatggtctcgatctcctgacctcgtgatccgcccacctgggcctccctcttttcttttctttttcttttttttttttttttgagacggagttttgctcttgttgctcaggttggttcagtggcacgatcttggctctggggccctgtttccggcccacaaacatcacttcccctgtcgggttcaagcgattctcctgcctcagcctcccgagtagctgggattacaggtatgcaccaccacacccggctaatttttgtatttttattagttgagatgcggtttcaccatgttggtccggctggtctcaaactcctgacttcaggtgatccgccctccttggcttcccaaagtgctgggattacaggcgtgagccaccacgcctgaccgtaataggaccttttgagccttaactgcctggcacctccatctcgcacacagtcccattcgcccacctttgcccacccagtccctccaggtgacttgggggtgtgtcagggcaagaggcaggagacccgggttccatcctagcctcctgggtgactttacaaccagccacaaccctctggactttgacatgacccatggggtatggggagctggttttgttttgttttgttttttagacggagtctcgctctgtcacccaggctgcagtgcagtggcacgatctcagctcactgcaagctcctcctcccaggttcacgctattctcctgcctcagcctcccgagtagctgggactacaggctcccgccaccacgcccggctaattttttgtatttttagtagagacagggtttcactgtgttagccaggatggtctcgatctcctgacctcgtgatccgcccgcctcggcctcccaaagtgctgggattacaggcgtgagccaccgcacctggccgttttgttttcttgagatggagtctcgctctgttgtccaggctggagtgcagtagtgcgatctcggctcactgcaacctctgcctcccgggttcaagcatttcttctgcctcagtctcttgagtagctgggattacaggcgcccgccaccatgcctggctactttttgtatttttagtgaagatggggtttcaccatgttggctaggctggtttcgaactcctgacctcagatgatccacccacctcaacctcccaaagtgctgggattacaggcattagccactgcacccagccagaagctggtttttgaaccatctcattttatttttacttcactcatcacacctggccccatttttttgttttttggggtttttagcgtttttgtttgttggttggttggtttttttttttttgagacagggtctcactgttgcccaggccggagtgcagtggcacaattgtagctcactgcagcctcaacatctggggctcaagcaatcctccaacctcagcctcccaagtagcagggattacaggtgcataccactacacccagatatatatatattttaagagatagggtctcgctatgttggccaggatggtcttgaactcctgacctcaagtgatccgcccactttggcctcccaaagtgctgggataagaggcgtgagccactgcgcctggcttggctccgattttgttgtgcattgtggctgagcgttagccccacacagagtaacaggtccccgcctgctgctctctaccaaccatccctggggaacctgccattccgaagaagtgttttttgttcccaaaatagaactggatttcagggtttatttcttattataaaaccgacaccatgaaaatggaggaaaaggccgggcacggtggctcacgcctgtaatcccagcactttgggaggccgaggcgggaggactacttactacagggtatgtgcctgtagtcccagctatttgggaggctgagatggggggatcacttgggtccagaaggtcgaggctgcagtgagccttgattgcatcactgcactccagcctgggtgacagagcaagactctgtctcaaaaaaaaaaaaaaaaaaaaccggagaggatatttgagctggggcattgaaggttgtgtaggagttcaccagagctacttacactgaaatgcagaattaatcacaagcaaatcttctctcgcctcccaggtgtgcctgaaccagtgccagcctgccctgtctgcagcatcggcctgatggggtggtgactgatccctcagggctccggagccatgtggcccaacggcagttccctggggccctgtttccggcccacaaacattaccctggaggagagacggctgatcgcctcgccctggttcgccgcctccttctgcgtggtgggcctggcctccaacctgctggccctgagcgtgctggcgggcgcgcggcaggggggttcgcacacgcgctcctccttcctcaccttcctctgcggcctcgtcctcaccgacttcctggggctgctggtgaccggtaccatcgtggtgtcccagcacgccgcgctcttcgagtggcacgccgtggaccctggctgccgtctctgtcgcttcatgggcgtcgtcatgatcttcttcggcctgtccccgctgctgctgggggccgccatggcctcagagcgctacctgggtatcacccggcccttctcgcgcccggcggtcgcctcgcagcgccgcgcctgggccaccgtggggctggtgtgggcggccgcgctggcgctgggcctgctgcccctgctgggcgtgggtcgctacaccgtgcaatacccggggtcctggtgcttcctgacgctgggcgccgagtccggggacgtggccttcgggctgctcttctccatgctgggcggcctctcggtcgggctgtccttcctgctgaacacggtcagcgtggccaccctgtgccacgtctaccacgggcaggaggcggcccagcagcgtccccgggactccgaggtggagatgatggctcagctcctggggatcatggtggtggccagcgtgtgttggctgccccttctggtgagtaggggctctgcggggtcctgctaccctcctgactggacctctggtcacccagggtggatttagatcctgatggtgggaccgggcgcggtggctcacgccggtaatcccagaactctgggaggctgaggcgggaggatcgcttgaggccaggagtccgagaccagcctggccaacatggtgaaaccctgtctctactaaaaatacaaaaattaaggccaggcgtggtggctcacgcctgtaatcccagcactttgggaggccgaggcgggcggatcatgaggtcaggagatcgagaccattctggccaacacggtgaaacactgtctctactaaaaatgcaaaaaaattagccaggcgtggtggcaggcacctgtagtcccagctactctggaggctgaggcaggagaatggcatgaacccaggaggcggagcttgcagtgagcagagattgcgccactgcactccagcctgggcgacagagcgagactccgtctcaaaaaaaaaaataaaaaataaaaaaattagccagacatggtggcatgtgcctgcaatcccagcactttgagaggtcaaggcaggaggattgctggagcctgggaggttgaggctgcagtgagctatgattgcaccactgcactccagcctaggtgacagagtgagaccctgcctccaaattaaaaaaaaagaaaaaaaatagaaagcagccgtagaaaacacataaatgagtaggcgtggctgtggccaataaaactactgatggatagatgatgaaatttgaatttcatgtcatttttatgtcactcaatttttgcctctattttgttttcctctaaccatttaaacatggaaagaaattcttagtaaaaaacaaaacaggccgggcgtagtggctcatgcctgaaatcccagcactttgtgaggcagaggcgggcagatcatgaggtcaagagatggagaccatgctggccaacatggtgaaaccccgtctctactaaaaatacaaaaaattagccgggcgtggtggcgcacgcctgtagtcccagctacttgggaggctgaggcaagagaatcgcttgaacccaggaggcggaagttgcagtgagccgagatcacgtcactgcactccagcctgggtgacagagcgagactccgcctcaaacaaaaacaaaaacaaacaaacaaacaaaaacaggccagccacggtggctcatgtctgtaatcccagcgctttgagaggccgagacaggcggatcacctgaggtcaggagttcaagaccagcctggcctacatgttgaaaccccatctctactaaaactaaaaaaaattaactaaccatgatggcacactcctgtagtcccagctactcaggaggctgaggcatgagaattgcttgagcccaggaggtggaggttgcagtgagccaagattgtgccactgcactccagcctgggtgacagagcaagactctgtctcaaaaaaaaaaaaaaaaaagaaaagaaaagaaagaaagaaagaaaagaaaagaaaaaaaacccaaagcaagtggcaggccagatttggcccatgggtcaacccttgctctaaaccctcccatggctccctgttgccctcagaagaaagttctcacaggcacttcctgcagacgcaccttgcccactcccatttgcccttcagtgacttccctaggccaggtcaggcacctcttctgggctctgacattgcttcctcctcacagctttgcccaccccatgctgtaactccccggacccagtttccgtctcccgactggactgtgagcctatgagggtgcgccctgggagttcctcagctgctgttgctgcttcattcagcctacaggacctactgctcaggaaatgatttgattgattgattgatttaatttatttagagatggagtctcgcactgttgcccgggctggagtgcagtggtgcgatctcagctcactgcaagctccgcctcccaggttcaagcgattcacctgcctcagcctcccgagtagctgggattacaggcgcccgccaccatgcccggctaattttttttgtatttttagtagagacggggtttcatcgtgttagccaggatggtctcaatctcctgacctcgtgatctgcccgcttcagcctcccaaagtgctgggagtataggtgtgagccaccgcacccggccaaattattttattttattttaagatggagtttcgatgtgtcacccaggctggagtgcagtggcgcaattttagctcactgcaacctctgcctcctgggttcaagggatcctcccacttcagcctccggagtagctgggactacaggtgtgcaccaccacacccggctaattttgtatgttttagtagagatggtgtttgaccatgttggtcaggctgatctcaaacaaagtattttaatataatgtaacatttaattataatataattgtatgatatatgatatatatcaattataggccacattataattatgaataattatcatataattgattattatatattatatactaatttgtagataacattcttattttaaatatttttaaatatagtttaaaaatttcctgccaggcgcggtggctcatgcctgtaatcccagcactttgggaagctaaggcgggtggatcacctcaggtcgggagttcaaggctagcctgaccaacatggagaaaccccgtctctactaaaaatacaaaaaaatcagccagatgtggtggtgcatgcctgtaatcccagctactcgggaggctgaggcaggagaatcgcttgaacccaggaggcggaggttgtggtaagccgagaacctgccattgcactccagcctgggcaacaagagtgaaactccgtctcaaaaaaaaaaaaaaatttcccatcaatcctgacctatagataaatataatttttattatttaaatattttatttatggccaggtgtggtggctcacacctgtaatcccagcactttgggaggccgaggagggcagatcacaaggtcaggagatcgagaccatcctggctgacacagtgaaaccctgtctctactaaaaatacaaaaaattagccggatgtggtggtgggcgcctgtagtcccagctactcgggaggctgaggcaggagaatggcgtaaacccaggaggcggagactccgtctcaaaaaaaaaaaaaaggtatttatttatttattttgagacaggatcttgctctgtcacccaggctggagtgcaaccatgcctgggtaacttttctatttattttaactttttgtagacatgaggtctcactatgttccccaggctggtcttgaactcctgggctcaagtgattctctcctatttacctcccaaagtgctgagatcacaggcgtgagccactgcctggctaagagtgcgctaatttatgaacccatcaaaaggagctcagagcggttagtcaactctcctgaggtcacccagcaatgcagtaacagagtggacactggccgggcgcagtggctcactcctgtaattccagcactctgggaggctgaggctggtggatcacctgaggtcaggagttcgagaccagcctggccaacatggtgaaacccccatctctacgaaaaatacaaaaattagccaggtgtggtggcagccacctgtaatcccagctacttggaaggctgagggaggagaattgcttgaacccgggaggcagaggttgcaatgagctgagatcgcaccactgcactccagcctggacgacagagtgagaccctgtctcaaaaataaaattaaaaaacggagtggaccctggatctcaagggaccccgggcagggaccggggcgggcggggctggaggcgggggcccaggctgacagctctcccctttgcaggtcttcatcgcccagacagtgctgcgaaacccgcctgccatgagccccgccgggcagctgtcccgcaccacggagaaggagctgctcatctacttgcgcgtggccacctggaaccagatcctggacccctgggtgtatatcctgttccgccgcgccgtgctccggcgtctccagcctcgcctcagcacccggcccaggtcgctgtccctccagccccagctcacgcagcgctccgggctgcagtaggaagtggacagagcgcccctcccgcgcctttccgcggagcccttggcccctcggacagcccatctgcctgttctgaggattcaggggctgggggtgctggatggacagtgggcatcagcagcagggttttgggttgaccccaatccaacccggggacccccaactcctccctgatccttttaccaagcactctcccttcctcggcccctttttcccatccagagctcccaccccttctctgcgtccctcccaaccccaggaagggcatgcagacattggaagagggtcttgcattgctatttttttttttagacggagtcttgctctgtcccccaggctggagtgcagtggcgcaatctcagctcactgcaacctccacctcccgggttcaagcgattctcctgcctcagcctcctgagtagctgggactataggcgcgcgccaccacgcccggctaatttttgtatttttagtagagacggggtttcaccgtgttggccaggctggtcttgaactcctgacctcaggtgattcaccagcctcagcctcccaaagtgctgggatcacaggcatgaaccaccacacctggccatttttttttttttttttagacggagtctcactctgtggcccagcctggagtacagtggcacgatctcggctcactgcaacctccgcctcccgggttcaagcgattctcgtgcctcagcctcccgagcagctgggattacaggcgtaagccactgcgcccggccttgcatgctctttgaccctgaatttgacctacttgctggggtacagttgcttccttttgaacctccaacagggaaggctctgtccagaaaggattgaatgtgaacgggggcacccccttttcttgccaaaatatatctctgcctttggttttattttcctttgggtccagaagttttcaatctctggagtttgtgcattgggcctcacccggagcagacgagggcagggctgggaaggatggggagggacatagaggattcggttcctcccccaccttgtttcttgagtgtttcctaatcacttgatgggtggtaccacctagaattcttccagcagcctgtaatgggagggctacaggttagccctggaacctgcaatcaaaccacctttgaatctgtgtgtcattaaaagtagatataaatgggccgggcgcgattgttcatgcctgtaatcccagcattttgggaggccgaagcgggagggtcacttgaggccagaagttcgagaccagcctggccaacatggtgaacccctgtctctactaaaaatacaaaaattgcagggcgcggtggctcacgcctgtagtctcagcactttgggaggtcgagacgggcagatcacctgaggtcgggagttagagaccagcctgaccaacatggagaaaccccgtctctactaaaaatacacaaaaaaattagccgggcgtggtggcgcatgtctgtaatcccagctacgcgggaggctgaagcaagagaatagcttgaacccgggaggtggaggttgcagtgagccgagatcacgtcattgcactccagcctgggcaacaagagcaaaactctgtctcaaaaaacaaacaaacaaacaaacaaacaaacaaaaaattagccaggcatggtggcgggcgcctgtaatgccagctactcagaaggctgaggcaggagaattggttgaacccaggaggcagaggttgcagtgagccgagatcatgccactgcactccagcctgggcgacagagtaagactccatctgtaaataagtaaataaataaaacagagaaagagagagagagatgcaaaagcgtggagtgatgcccgtttcctccactgttcacttgttcacccagcaacctttcaaacaccacagtgttctgtacagcaccttgcacatagtacgtgctcaataaatattggtagaaaggaccagtggctgggtcttcgtggagcacctgtcgcctgcaggcacgtaagctcatgcctgtgcggtgcttaatgaagtgcctggtacacagtaggtgctcaagaggtattcagtgttgccacagtttcagccagccccccagccccacatctctgcattcccccaaacttcccccaaaatgacacaccaggctgcagagatggaaggtgcctttattcaccatgagccctcagggtacatgcggtgcaacccgtctcctgccctccttttccctccaaggacctggatctgagccaggaccggtgaagcccctgttttcaccaccgcacactccctaccaccgcctgctggagaaataaggtcacttgctgcttctgggggccccaggctggaagggacaggagaggacgagaaccacatgaaccagggctaagtcacagccaagctacggccccccgcggtaagggcgggctcctggctcccccagagtggggcaaagggctggcgccaaagctggggactcagacagctgggaactcaggagggctgccctaggggcaggactaggagtgacagatatggtgggtggggtggacttctggggtcccacccggggcttgggagagacggctggcttctggggggttgaggagacctgtgactgtggggccaggtaggaggcttggggtaagcctgggatggggccaaggctggcctggatgccacatacctgatcatggggctgaggcagaggctgggggtctttgctaggggctggggtggggtctctgggggatgggcctgggggctgaggttgggctggggcaggggcctcaagctggattctagggtcaaggccaggggtctgtgggcagattccatttccagggctcagccagattcttgaactggtgtgagttctggaactggattgggttccagaaacaggctgggttccagaactaaggtgggctccagggctgggctgaattcttgagccggtctgggtttcagagctgagcccggtctcagagctggactgggttctggaactaagttgggctccagagtcgggctgaattcttgagccggtctgggtttcagagccaaactgaatcccagaactgaactgggttccagagctggactgagcctcagagctgagcctggtctcaggactggactgggttctggagctaagatgagctccagggctgagctgaattcttgcagtggtctgggtcccggagctgagctggtttccagaactagtctgagttctggagctgggttgggctccggaaatcagctgggttcccgaactaagctgacttccagagctggcttgaattcttgagcttatctgggtcccagagctgggctgagttccaaagctaagctgactttcagaactgctctgcttcccaaagtccagttgaataccagagctgtctggggctgtggtctggagctggtatctagaacctggcagggttttagaggcgaattgagtcccagaggctggtcgagctcctgggcagcgctgggtcctggagctgggcctgctgtcggaactagacagggctgtggagcttaattctattgctgcgatggcctgggtcccaggactagattggactccagagcttagctggattctggaacttggctgggtctcagctgctgtctgtgttttggagctggctgggatttcagaaccagcctgtgctccagaactgagctgagttccagagctgggtgcggtgcttgggctggattgagctctggagcttggccaggccttgaaattggtctgggtcctggaagtaaactgcattctagagctgagctgcattgtgcaaggagagtggggcttggcaccaagctgtgtgctggagctgggtcttgcttccaagatggatggggttccagagctggtctgaatcctggagttgggcctggttgtagcactaggcgaggttctagagctgggctcagtctcagagctggaatcatcactggagctggactgggctgcaggatggggatgggcacttggatgcaactggggttgggatctggactgggcagccgtgtggacctgggtttctgagctggtctgagttcttgaataggatttgatttgggagctgtctctgaatcctgagctgactggggttccagagctgggctgcttcatgaatctcacatgggttccaaaattaactggggttccggagctagaccgagtgtccaggtgtggctgcatcgtggagctgtccagagttccagagtcagcttgagttttccagcagggcttggtctccgagctagcctggattctggaactgggattggtctccaagctggtctgggtcttaaaatgtgtctgggttccagagtttggcttgttgtcagggctcagctggattctagagatgtgcttcgtctcagagctggcctgggcttcagagcagggcttggtctcagatcttatctgggttctagagctgggtttggcctcagaggtggcctgagttctagaacagggcttggtctcaatgctgggattggtttcagagcttatctgggttctagagctgggcttggtctcagggctgacctgagttctagagctgggcttggcttcagatgtggcctgaattctagaacacggcttggtctctatgctgggcttggtttcagagcttatctgggttctagagctgggcttggtctcggagctggcctggactctagaacagggcttggtctcaatactgggctctgtctcagagctcatctgagttctagagctgggcatggtctcagagctcatctgggttctagagctgggcttggtctcggagcccatctgagttctagagctgggcatggtctcagagcccatctgagttctagagctgggctcggtctcagagcccatctgagttctagagctgggctcggtctcagagcccatctgagttctagagctgggcatggtctcagagcccatctgagttttagagctgggctcggtctcagagcccatctgagttctagagctgggctcggtctcagagcccatctgagttctagagctgggcatggtctcagagcccatctgagttctagagctgggcatggtctcagagctcatctgggttctagagctgggcttggcctcagagcaggcctgagttctagaacagggcttggtctcagtgctgggcatggtctcaaagctcatctgagttctagagctgggcttggtctcagggctggcctgagttttagaacagagcttattctcaatgctgggcttggtctcagagctggcctgggctctagcacatagcttggcctcagatctgggctggattctagagaagggttgggttctggagttgggctggggctccaaattggattgggttctagagaggaacttgtcctccgatctgggctgggttctggagcagggccggggcagggggctgggctccgggctggggctgtgctgggcccccccagggcaaactagccacaggcctctctggcctcgccgatggcggcccacacttccaccacaaactcgtcggggaaggcgaactcgcccaagacggagtctaaacagcgtgcaaactcctgggcgctcgctgtcttcttggacgtctccaccatggtggacgctgcgggccgtgccagaggggatgtcagtgagggcactccccgcgcccaacttcccgctgggacccctgcctcctcccgtaggcttccctccccccagggccccctggcttaccctggccccttacccagctcggggtcccgaatgcccatgtagctttccagcaggtcatcaaccttccgagatgcctcctcctcaaactcactgggctgggggcacacgggagggaagtcaggggtgaaaagctttggagccctccagcccagccccctcccgacccccacccctaagggaagagtagactggaccctcacacgagtcagtagtgctggtaccaacatcattgccccacttttcaatgaggacccattttgcaggcagagaaactgaggctccgaggagaagttcttacccaagaccgcactgactcagtggaggagctgaaggtgcagaagcctggggagagcccctccccttcactcaccgcttcctccactgtggcagcccccccagaacgaagccgcagggtctccctcccgctggtcactttcgcctctactggacatttgctggaccgacttctctggccaatcatatctggagggaacagagtgagggatggccatgggttctgggtggagccacatctttgtaaaccctgggaggccaacagccgagcctttctagaatcttcctccccttcaaagtcctccttacatctgtacggcaagtctccagagacctattcgagattccacacttcgcatccccagcaaactaaatcacaagtccagaatgaggtgttgtaatggagcaggtttagaactaacatcccagttccatgccctcactctccctcttctagcgactttctctagaagggactgcttgggaccctccttgtggtaggatcctcaatctagatatgttcttgtctgggttccagaacccggcttagtgtcaggactgaggtgctagaaacacacttagtctcagagctggcctgggcttaagagcagggcttggtctgagagctggcctgggctctagagctgggtttagtctcagactaagcttgatttttttttttttttttgagatgttgtcttgctctgtcacccaggctagagtgcaatggcacgatctcggcttactgcagcctccacctcccaggttcaagcgattctcctgcctcagcctctcgagtagctgggattacaggcacctgccaccatgcccagctaattttttgtatttttagtagagacagggtttcaccatattggccaggctggtctcgaactcctgacctcgtgatgcacccgccttggccttccaaagtactgggattacaggcttgagccactgcacccagccaggtttttttttttttttttttgatacgatggatcacctgacctcaggtgatccacctgccttggcctctcaaagtgctgggattacaggtgtgagccaccacgcccggcctaaactctatttttaggcatggcttttggagttcacagccacggcagggcagattctagaaccccatacagctcactctccctgggacgtctctccatgtgtgctggggcacttctagaatctctgtctctgttctatagaacaacgctatccaaagggccaacccatggctacatgaggagaatgtgctagtgtgtaaatcaatacactgttttcttcattgagaaagtctagttatgaaaaaaaatgggcagggtgcagtggctcatgcctgtaattccagcactttcggaggccgaggcgggcagatcacctgaggtcgggagttcgagaccagcctgccaacatggagaaaccccatctctactaaaaatacaaaattagccaggcatggtggcacatgcctgtaatcccagctagttgggaggctgaggcaggagaatcacttgaacctgggaggcagaggttgtggtgagccgagatcacaccattgcactccagcctgggcaacaagagcaaaactccgtctcaaaaaaagaaaaaaattaaaaattagctggcacggccaggcgcggtggctcacacctgtaatcgcagcactttgggaggccgaggtgggcggatcacgaggtcaggagatcgagaccgtcctggctaacacggtaaaacctcatctctactaaaatacaaaaaattagccgggtgtggtggcgggcgcctgtagtcccagctactcgggaggctgaggcaggagaatggtgtgaacccgggaggcggagcttgcagtgagctgaaatctagccactgcactgcagtctgggcgacagagctagactccgtctcaaaaaaaaaaaaagaaaagaaaagaaaaaagaaaagaaaagaaaaaagaaaggaaaaaaaaaagaaaagaaagaaaacttttttctcatattctcattctctacaatccaccatgacctcaaagcactgctttaaaagttcccaggctgcgcgcggtggctcacgcctataatcctagcattttgggagactgaggcgggtggagcacttgaggtcagaagttcgagaccagactggtcaagatggtgaaaccccgtctctactaaaaatacaaaaattagccaggcgcaatggtgggtgcctgtagtcccagctactcgggaggctgaggcaggagaatcgcttgaacccgggaggtggagattgcagtgagctgagatcgcgccattgcactccagcccaggcaacagagtgagactccgtctcaaaaacaaacaaacaaacaaacaaacaaaaacaagtctcccagcctggctccaaagtggttctggacgcgtcctcctccaactccactttacccagtctctcccccacccctcccccacaggctgactccataacaatctattaatagaaactacctacgagtttctgataccctgccaggagctccttggcacgcagcgggtgcacctagaaccttccagcccgtcccatccccgaccctcctccaccccaggcatccgtagaacgcacttcgggaagagctcccgccagcccacccgcctcaccgaaggccctcttgggctgcaccaggcgcagggtgaagggctgggacttgggcagctcccggagcatcttggccacctcgtagtggcggcagcccacaatggagtggtcgttgatggcttcgatgctgtcacccacgcacactgcctcgatccggttgatgatactgccttccttgattctctgcagggatccagcgtcgctggcagggcaaccccagccacccgcctccaatccgcagaacccacgtcgacccagagtggggggggcagttgctggaccccaggaagccacccgcccaccccctcccgggcaccttgatgaaggcgtagccagccccgttgtccgtgatggtcagccccagagcatcctctgtcttagtgacctccacctccttggtctcgcctcgcacgtgggcaaagatgaagtcctccaggcctatctgaccccccaggagcttctgcatgtccactttgtggctgttgagggtgcagaataaaatcttcccgggggagaaggagcctagagttagccagggcatgcatccccccacgcagccaccctgtctgcgcaggcccctgcccccagcgaccaggatcccagcccatgggaaagggcagggcgtgggacccccagaacagagagaggagggagaaggagacttccagcaggtggagacccctctccataccccgggacctccagcccccagacctccaggtttaatctgctggcgccccctgggggctgcaaaccaaacgaacccggattggaaaaacgcccaggaaccccccaaccccacggcggcctcaaacttcccatccctaagggggccatctggaaccccagaccccagctacgcccaggaagcacagaggcgcttccccgagggctggggtccgctccaagctaggtctgcgcagaggattttctggaatatctaggggtccgctagtcctaagacctgcccatcttttgcgcagagcgtgcaaagggggcccctgggagtgtggcaccccgggatctgagggctgggtctctgagatccggcgattaggcggccaccccgacgtctgggatccggggatctggggtctcccgtccagggtccaagctccctacccctcaccccatcaggcgggtggtcttgggcgccggtgtccgggctccttacctcggtgggcgcgatcccgaaggcttcggcgatcttggcgtacagctcgcggacgttggtgaagccctc

SEQ ID NO: 203 - DNA, 983 bp, Homo sapiens
atgtggcccaacggcagttccctggggccctgtttccggcccacaaacattaccctggaggagagacggctgatcgcctcgccctggttcgccgcctccttctgcgtggtgggcctggcctccaacctgctggccctgagcgtgctggcgggcgcgcggcaggggggttcgcacacgcgctcctccttcctcaccttcctctgcggcctcgtcctcaccgacttcctggggctgctggtgaccggtaccatcgtggtgtcccagcacgccgcgctcttcgagtggcacgccgtggaccctggctgccgtctctgtcgcttcatgggcgtcgtcatgatcttcttcggcctgtccccgctgctgctgggggccgccatggcctcagagcgctacctgggtatcacccggcccttctcgcgcccggcggtcgcctcgcagcgccgcgcctgggccaccgtggggctggtgtgggcggccgcgctggcgctgggcctgctgcccctgctgggcgtgggtcgctacaccgtgcaatacccggggtcctggtgcttcctgacgctgggcgccgagtccggggacgtggccttcgggctgctcttctccatgctgggcggcctctcggtcgggctgtccttcctgctgaacacggtcagcgtggccaccctgtgccacgtctaccacgggcaggaggcggcccagcagcgtccccgggactccgaggtggagatgatggctcagctcctggggatcatggtggtggccagcgtgtgttggctgccccttctggtcttcatcgcccagacagtgctgcgaaacccgcctgccatgagccccgccgggcagctgtcccgcaccacggagaaggagctgctcatctacttgcgcgtggccacctggaaccagatcctggacccctgggtgtatatcctgttccgccgcgccgtgctccggcgtctccagcctcgcctcagcacccggcccag

SEQ ID NO: 204 - protein, 328 aa, Homo sapiens
  VARIANT (1)...(328): Xaa = Any Amino Acid
MWPNGSSLGPCFRPTNITLEERRLIASPWFAASFCVVGLASNLLALSVLAGARQGGSHTRSSFLTFLCGLVLTDFLGLLVTGTIVVSQHAALFEWHAVDPGCRLCRFMGVVMIFFGLSPLLLGAAMASERYLGITRPFSRPAVASQRRAWATVGLVWAAALALGLLPLLGVGRYTVQYPGSWCFLTLGAESGDVAFGLLFSMLGGLSVGLSFLLNTVSVATLCHVYHGQEAAQQRPRDSEVEMMAQLLGIMVVASVCWLPLLVFIAQTVLRNPPAMSPAGQLSRTTEKELLIYLRVATWNQILDPWVYILFRRAVLRRLQPRLSTRPX

SEQ ID NO: 205 - DNA, 493631 bp, Mus musculus
  misc_feature (1)...(493631): n = A,T,C or G
aaataaaataaataaatctttgaaagaaagagagagggggggggagaaagaaagagcaaacgaaagaaagaacccactttaatgtaaagaatcagtactgtccagcagtatacttccttatactctgaggcggactgatgcctacgacagggaaaatgtgggtgctgtgcctgccaggggcgctgtcagaacctgctctatggcttgctgtgcagtcagctctccttcctaaaagcctccagctactcaacgttacaaaacggccacacaaaagatcttctgggagctgatgaaattaaatcctgagcctgagaaaggccagagccttggagctcctcctcaggaaacacccgatgactcggggtgaaaacctcaagccaccatttcatgccccctcggaatcaaatggtccttgtgaaagcccccagtggggcgttcaatagccagagcaggaacaatgaagggaggcatacacagcctggcggcttccacttccacttcacctgtgtgaagacgaggagggtcggatgctcagatgactgatccatgtccgcaggtggctgagaactctctcaggtttgagtgtaattatttttagcactcagccaaacaaccttattaggtctgacacctcagcttcctttctcctctggggctgccactgaaggcaccgtgcatgctcgagccctgctctactaccaagctgcagccccagctgcaagacccatttttttttttcttttgccttttcgagacaaggtttctctgtgtagccctggctgtctgatgtccttgaactcagaaattcacctgcctctgcctctgcctcccgagtgctagagttaaaggtgtgcaccaccacgcccggctcattttttttatttttttatttttatttttttaaggcaaggactcattgtgtagccctggctggcctgaaactttctctgtaggccaggctggtctccgactcagagatccacctgcttctactgcccaaatgctggaattaaaaggtaccatgacagcaaccctttggattcttaagaacttactaatgtatttaagggtttctgaggacacttatgtcaacaataaaggcttgccctctagagtattttttgctttgtaaacttttttttttaattgggtatttatttcttttttttccccaaagatttatttattttatgttatgtttatgagtactctatagctgtacagatggttgtgagccatcatgtggttgctgggatttgaactcaggaccttcggaagaacagtcagtgctcttaactgctgagccatctcaccagcccgggtatttatttcatttacatttccaatgctattccaaaagtcccccacatgctcccccacccactctcctacccacccactcccacttcttggccctggcgttcccctgtactgagtcatataaagtttgcacgaccaatgggcctctctttccactgatggccgactaggccatcttctgattcatatgcagctagagacacgagctccgggggtgggggtggggaggtatactggttagttcagatcccttcagctccttgggtactttctctagctcctccattgggggccctgtgatccactttgtaaactttttaacaattgctgaattagaaagcaaagacaagctagggagatgtctcagtggttaagagcaccttagctcttccagggggatggcgtttcatccccagcacccacatggagtggctgccaacatctgtgtccctccagctccaagggattcagcatcttcccctggacaccacaagcatgcatgtacatgacattcactaaaagtaaaagcacattctaaccactgtgtttactgttatacccaaccagggttctgtagatcagtctgctagatctgctccaatttagttgcaaacgctgtggaggggtgtgggttaggtcagggcggtctgtgtgcaccaaatatggtgacaaaggatcgtttcagtgggctttagaagcgacaataatcccagcattataagtaaacctcaattatgtccttaaatttactatcgctgttaccttgggtaaatgggaaggaaagaaatgccccccccaatcttttaggcagcaaaagagagagagagagagagagagagagagagagagagagagagagagagagaaaagaaagaaggaaagaaaagaaaagaagagaagagaagagaagagaagagaagagaagagaagagaaaaaagaaaagaaaagaaaagaaaagaaaagaaaagaaaagaaaagaaaagaaaagaaaagaaaagaaaacaagaagaaaaagcaggacatctgcgctgtaactggctgctctaggcccaagtaaatgcccaggtcggggaaacgatgcccacagaaagtgctggacactgtctaggaaatgctttccactcacaggctatgtgatttgcccacagtcatacagctctgacagaggtactaggacaggacctagaatgtcccactgacccatgacaatctctgactgcaacaagagaagcagggagctggcccagcaaaggccctaccagcctgcaccccagctctaggacccaagtgctgcagagacaatctactccaggaggctgtgctctaacctccacactgtgccgtggcatccgtgaccccacacacaaaataagataaataattgaaatgcaataataagaagcgatctggggactgcgagctagcttagcaggtaaagtgtttgatgccaaggcttgaccacctgaatctgatgcacatggaaaggaaaagatggacccctcccgaattgtcctctgacctccatatccacacgtgcacgcacatacactactactactaaaatagttactttaaaaggaagaaaggccgtaccaagctgaaccccaggagagctctcagtgggaggaagacagaggtgggcagtgagaaaagagtctctgtggagaaggggaaggagacgctcactttaaacataggtgtgggcgagggaggccctctagtaaccagaaaggatctggcaatgacaaccccgggcatgatggcgcacagcacacctttaatcctagcactcaggaggcaggggcagcagctctctgagttcaaggccagcctgaactacaggtaagatctggtttggttggctatcagtggatgctgtaaggagaggctcagatgtctactcacccagcaaaggaactttgttttgcagcaactcacagtagctcgtggtgagaatcccaacaggattgctggggacaaagcgtccttctttcactaaccgctcgcatgttcgcattaaagtccctgagaactgagatgggtccactccatagtctctccaccctccgacgccatccgcaactcctgaaagagaagaagtgctcttcagaccatgatcattggctgagaacttagctcagtggcagagctcctccctcccatgcacaagaaaccacggtcagcaacctcgctgcaccccttcctccctccgcctctccctagcagctccccggagcacactggtgctgggactcatgaaggctcatttaggagcaccaccgcacaagctaacatctctgtccacactgccaaatcatctgcttactatctggtctttccaatattcacgaataactgatagtatacacctttaaccccagcacttgggaggcagagtcaggtgcatctctgtgggtctgaggccagcctggtctacagagtgagttcctggacagcaagaactacataataacgagaccctgcgataggaagtactggatttattcatgtgagggttttttctggcatcattgtgcctgctgcctgcagagagcagaagatgacggacattggctcctctgtgagccaccatgtggatactgggaactgaattcaggccctctgcaagagcagccagtgttcttaactgctgagccacctctctaggccctggctttttttctttaagtccaaggttagtgctgataacttttgggccagagctgggaatgagtacatgaaaggaaagcagagccagaacaagcacttgtgcacacggaactagatcccagaagcaagacaggctcgtgcacacgcagcacacagaaataacgaaatatcaagaaatgaagaacagaacagaaaacgccatccctttgctcttcctgccctgtgcagctggccagtccatgtgtgctgaggggctctgaggaaggatgctccataccaagcttttctgagtgcactgtgagaacttagaagagacaagggacagtgctctggctgttttatactgactcgggattcctaatactctgggagctaggcctggtagtgcagggctgtaaaccaagctactcaggaagactcgaagtacaggccaggccagacaggttcttgattctgtctcagtaagtcagaaatgcgctgggccatagctcaggtgtaggcgcctggctaacactcacaagacctagtgcctcaaacaaagaacattttggtagaaattatagccctggccgtcctggagctcactctgtagaccaggcgggccttgaactcagagatctgcctgcctttgcctcctgagtactgggactaaaggtgtctgctaccactatctggtatcactttttcttaagatatttaaagtcattctattctactggatgatactaatgtgaactttcctaggtccatggggctgctggtgagtgcagagtctgctggatgctccctttagcaacagggaacaagtgttcagtcaacagaacctggacgtcactcttgtaccatctcccatcgcaccccttgcaaaacaacatgcttcttaactctttccaaagttaaaatcaattcctgcctacaggcattaaagaaacagaaaagtgtcagacatatacacgtttttaaggttttctatggtttttctggaaggagctgtaagaaatatgaacaatggttgttttagaagccaggcagtggtggcgcacgtctttaatcccagcacttgggaggcagaaaaaggggcacttctgagtttaaggccagtctggtctacaagtgagttccaggacagccagggctacacagagaaaccctatctcgggaaacaaacaaacaaaaaaaagaacaataattgttttagaaataagggactgatttctaaatgtctagggtagtggttctcaacctatggggttgtgatcccttttgggatcaaacacctttcacaggggtcacctgagaccaccagaaaagatatttacattatgactcatgatagttgcaaaattgtagttatgaagtagcaatagaataatgttatggttgggggtcaccataacatgaggaactgtattaaaaggacacaacattagaaaggttgaaaaccaccgcactacgagtatctggagatgcagcgcagtggttacaacacctgcctgggatgtgtgaacattgtaacataccatttcgtactatttttatctttaccaaaagcatgtgccacagcttgatcttactgtgtgtgtgttatatgtatgtgcgcatgtgtgtgaagacaacaactgtccaccttcccatcatcatttccgtgtgcgtgtgcgtgtgtaggtcaaggaagtcgtccatcagggtgcttttctccatccacctcatgtggctcctggggttccaggtcaccaggcttgcagagaaagccgctctgctgaccactgagccgccttgctggcccgccaccttctcttgtgagaccgtgtctccctgaaccttgagcttgctgactcagccgggcagtccctccccccagctctgtgcttacggtgcacactgcttgctaccctagccttttatgtgggtgctggaaccaaactcaggccatcatgcttacacagtgggcactttaccaacaaatgctgtcatctccctaactccaaaaattttatttttaaatttggggggaggggcagacaagatggctaaattgataatagccaagcagaatttgatttttaattaagtaaatggaggggggcaagcatggtggctaataccggtaattccaacacttgggaggtgggaagccaagagctcaaagccaaccatgtggagatagcctttctctctctctctctctctcacacacacacaaacactcgtgctcgaggacacacggggacatatatacaggcacagcacatggacacacacatcaaaaaagaaaaaagacccaggcagtggtggcacatgcctaattatgccgcttgggaggcagaggcaggcagatctctcagttcgaggccagcctggtctacagagtgagttccaggacagccagggctacacagagaaaccctgtctcagaaaaaaagaaaggaagaaagaaagagagaaagaaagaaagagagaaagaaagagaaaaagcaggtttgcttatttattttttaattgtttgtattataaggctcaagaactctactacctagctacatccctagaccaaatctagggccttctgagtccgaaacgccccctcccacacaacatttacatttgtgtacattcatctgtcacaggcatcttcaaggaatgtaggtggacaacactgacaacactggctcacggtgatgaacacaggaaactccctggtgcaacttataggaaacagaaggaagccaacggaggaggggacaatagcagcagcttcctcagttatgtggccaccagcaagccaagcctccctttggagtaattccaaaccaactgatgggatgggatgaagcctggcatgtctccgaagaactgggggtggataagggggcgacagagcagaggcaagtcaggcctggtcatgaatggagtgctgttgaaactgaatgagagctgcactcgcctctaccttgagagcctggaaaattcccacatcaccaagtttaagtaaaatgacggcagcactaacaaagtcaaaggaaagccaccctcgggcctgctttgtggaggagtctacttcagtgggagctgccaggtgagggttacagtcatgggaacctatgaacttagcaggctggggtgcaggcaagagccacaggagacctccctcacctcccaggagcaggtgtagacaaggaagaacaaacatggggaggatgcttactgccctgcttctgaggaactcttccctcgcagggctttcacagggcttagctgcaacaatttatgttaaaacacagaatgggagattccagccctgggcacaccatctgatgatgaatcacgcatgcattctctactgcgtgcagggaaaaatttgctcttaaccaggccctgatccaacaaccacaacgaacttaaattacaaatcagcgggctgagtggctggactgtccttctgcgccagccatcttctcctggagtagcccgaccttttaggtacctgttgcctttagcagacagatcccaggcaaaatgccatgggctcaatctcctgagaggaaaaagaaactcaacattacttcagctttccaattaagccaaagagggaaggttacatctggaaatcactcactaatgtaccaggagaagaggtgatgtggagtaactgcaccgcatgtatttctagcactcggaccacaaagagaaggcgagccaagcctgaataaagctgttatccaaaatgcctctgtatgtaaaagataaaacccctatccaaactgctaagactgtgacctggaagattcctaaagacccctcacccccaagaagccaacacagtattagccagcagcagcagcagcagcagccgtggttacagcgtgtggcaacagcatctggggtcacagtgtgtggcagccccgcatgcctgcattactagagtcctagcatgaaggggaagtgtttacaggctactgagggaagaaagcaggccttctttgcagtggcacttgactgtccctagagggtcctctaatttcacagacagggaagggcatgggaaggaacttgcctcacagggcgctgaccctccctccatgactcccgagtgtgcagagatctgcttgctatctctggattacaaaacactcagtgccagcaacaagaacactgcacggcagccttcggagtttgctactgaacacacagaaaaggtgtgttcagtaaggtctttgggtctagtgtattaattaaatgtattaaataaaattaactgcattgcgttaatctaagttttattacatttttaattaggggtggggagagacctaggcatgccaaagtccacgtgtgtcagtcaaaggatgatatgtgagagtccagagttctccttctccgtgtgccgcacagatcgggctcagggcgtcatcagacttagcaggaaagctaagccttctgagccatctttctggctctctgtctccactgttttcccccaaggtctgatcatttatttgtgactcttacttattttggactggactcagaagtagaagcactcagcaagcacagcctacatctcctggtaatctgttcctggcagttttctttggctaccttcattctcttggctaaacatttattctgcagcctctcattttccttggtgcgttgtttcttcagagcaataggtctatgtgacaggacctgtgtattaagacgttcaatcttgggtgcgttagtcctggcctctcgttttctttgtttaaaggcttctgatgacatttggtgagaattatctcctttagagagattaaaaagcttttggattctgctggctcttttaagccccaactgctagggcagagtagtatctgtcagtccaggaatatcctctctgtctttggttttacagtagccaagttgagaacactaagattggcacccacaatgcatctgcaaacagacttgtacttcctctctccagttctcctcggtccataacaaaaaactctcctcatcaccagcaggagcactctccccgggtcaagactatttgtttcatgggaaaactgtcaccccctccattgccttgggccatatggccttccactcttcccccagagtatcggtggctgcgtccacggctcagggaagagtaaggaattgcaggggtatgtgctcaaagtgattttattttaggaatgtgaatcctggccaaatggctcacccatttgacatcctgtgtactgttttacatcagacaacaagcgattgagatcaaggaattaccacgtgcctagcctgtgatctattctccgagcagaggaggaggctgagttatagcgagtggcccttcatgtcacctgaagccagcgtgcagaagctgcctttaactcactgtcactatcttatgttcccagtagtaatgccacatgaacataccatagctccagtggctcctttgaccccaaattcaattacaactattattggattaaggtaacggttacacatcagaagagctgagcaaaagcctgagaagggactagagagcacggaagtcctctagtcctgtcactatttcctgagttggaagtgatcaactacacacaacttatgccattacacttggggtttgttttttgagacagggtctctctgtcacctgaggctgttcttgaacatgcagaagtctcctttctggcctgacctcctgaatgccagggattacaggtaggagccacttataggatgcagaccttagcaattgtgttaagttttccgtgcactgatttcctaatagaagaaatggaaatgaagcaaaagcaaccctgccctgcctcccatcatttgatggcagctgccaagagcactcctttcttggagcccctcccaccctcaaggctttctttctcacctttcctttacaaattatttttttgttctcttctaattacttaagatttatttacttatcttatgtatatgagtacactgtagctgtcttcagacacaccagcagagggcatcagctcccattacagatggttgtgagccaccatgtggttgctgggaattgaactcaggacctctggaagagcagtcagtgctcttaacctctgagccatctctccagcccctctaattacttttatgaatggaattctaagtaacaatttttcattttttaaattagaatacttttccttcatcagttaccaccatacaaaaatggcgctgaagggcctggctgaagctcacctgcacagggcagttcatcaagcccacgccctgagctcaatcctcactatggcaactttaaaactgcatctcccagccgggcgtggtggcgtacgcctttaatccaagcactcgggaggcagaggcaggcggatttctgagctcgaggccagcctggtctacaaagtgagttccaggacagccagggctatacagagaaaccccgtctcgaaaccccccccccaaaaacaaacaaacaaaaaaaaaaaaaccctgaatctccccagctgctcactggggctgcagaaggcagacagacctaggaaggcctctaaactaagctgccattagcatgaatgtctcatggcacacacacacacacacacacacacacacacacacacacacacacacaggcatgtgacaatgccacatgtgtccagaagaggttgtcaggtttccttggagctagagttataggtggtggtgagaaactcaacttgggtgctgggaaccaaacatggaccctcttgcaagagtgatactcgatcttaacagcagagctgtctctccagcctcttctatacacacaccttccagactgaccttcaattatttttaagatcattctggacaatgacaactagagaacactgcattccagttctaatataatatataatataaaaatcaatgaaggacacatggcaatttgcctttatcacaacatatttaacacaggcgatggcaacactgcaatggttcatagcctctcccaagggagcatgcttcattgacacgggagccttacactccagcaaagcaagctgctgctcaggggttggttttctgccagtaaaacacatctcatgtggcttggatgggagtacctgctatgaagggaaactgcaggacaaaaacctatgactcaagctggagcaagagccgagaagcagacggcaggagccgctcacaggcagggcggatctcctgagacagtgcttagcagtgtttctccagctctgtagagatggagactcatccaactcagggttcccctgcaaccctggcaaggcaccacaacacaaagactaggatccgatgaaaatgagatccaagcacacagttgactctgtatcaataggaacaggtcatatttacaccaacatttctgaagcttcaactcctggggcactggggaatactgccctgtgactcaggacggagaaatgtatctgcaaatgattatcccaaagggaatgaaaaaagcaagattactgaaaaactctgttccccatcaagctgctgcccagtccgatggactctcaatagtcctcagtcctcgaggggagaggtcccagggattacaaggctctgcctgccataacaggccaggaattccctctgcacaaagcttcctcaaagcaaccactgtgcgtcaaccacaaagaaacctgtgcctgtcggctccagaggctcagtctccaccaagctctctaaggagaacagcgaagatcaggctcaaggacagagaggaagaaagggtccagcctgtaagaaacccagactccaccaaagaaatggactgcccagggcaacagtcaagagacccaagcaggagcagacggcctgttttagaggtttcagaatctgaggaagacaaaaacagccacttattcctaagcaagaagactactcagtaatcaagctaaaagagtgtgcacacaacacacacacacacacacacacacacacacacctctatctatcttccttgttttgatcagtcgcctggtctttaaaagcagtaagaagccctggaaggagggtaaggaaacaagagtgtgaagaggggctggtgagatggctcagtgggtaagagcacccgactgctcttccgaaggtccagagttcaaatcccagcaaccacatggtggctcacaaccatccgtaacgagatccgactccctcttctggagtgtctgaagacagctacagtgtacttacatataataaacaaataaatctttaaaaaaaaaaaaaaaaaagagtgtgaagagaaactgaaataatgtgtgtgtgtgtgtgtatgagagagagagagagagagagagagagagagagagagagagagtgtgtgtgtgtgtgtaagggcatgagattgatggggcgtgccttccttggaactctccaccttagttcttgacccagggcatcatgcttgctctctaactttagctccccataaccaataataactcaagctgcagcagatctgacttctctggcctctgagagcacctgtactcactctctcatgcattctctccctgacctcctctgctatacaacacacacacacacacacacacacacacagtattaaaaaacaaacaaacaagtaactaggtgtggtggtacatacccttaatctcagtacctgggaggcagaaataggtagatctctgtgaggccagacctgaatggaggcctggtctacatagtaagttccaggatagccagagttacataataaagccccctctctttgaagaaaaaaaaaaaggcaggtacttactgttactgtgggattatctattctagcccaactgccaattgcagcttggggacctggctggtaacttacagatttaatatgaatcgctggccagccagactccctccagacactacagaactgatggctgtctctctgaagccacttcaatcctttctggcttccaacacaatctccccaaatgttgagtgttgttagctatgctctctggtctggaggaagcagccaatagatcatcaccagggaggagagggatcctgcctgggtcctgcctgcagtcagtgttgggactaagtggacagagctgagggtctggaagagctgtctactgggtacttttctgagccctcaggacaagagaagggctttccttctcttttccttccacaccactgcccctaagggttgacctactatttctaacaactgagagtgccctttccccctctctgcacctctacgccaaagcctgactgtctggccctaagttcctaagcccattaagtccttctgcctcacctctccagtaggtgggaaacaggatacctcaaaaaaacatgtatgtttaacctgatcccagcattgcctgttttcttcacccctctgtaaaataaagagctgggcctgaccagaacagcaatccctgagagaggctgagtgccccaggcaggttttgtagtcaaagccccatactttgggctggagagatggatcagcagtaaagaccattggctgctctcacagaggacccgggttcaactcccagcacccacatagaagctgtgtcacggctctatgtgagtgctgttcctgttccaggagatttgacacccttacacagggagacagacagacaggcaggcaggcaaagtattaataagcataaaataaaaataatttttaaaaacacactatccaccaacagttgaccatgtacagagaggcctcaacaccaacactgcctgtatccaactctgttgttgcattaagtgggcaactcaaggtggccaggaaatgagtaatttcttctttttcaaaaacatttttatgttgttttttaagatcttcattttatttatcgctatgtgtctgtgtattctatacgtaagcaggtgctttcagaggccaaaacaaggggttaggatcccctagagatggagttacaggcatctgtgagcccgatgtgggtctgggaacagaactcagatccactgccaaagcggttaagtgctcttaccagtgagccatctgggctggatagtttgatgtcaacttgaggaggggacatcaattaacaaaatgactctaggggctagaaagatggctcaaaggttatgagcactggttgttcttccagaggtcctgagttcaattcccagcaaccatatggtggctcacaaccatctataatcagatctggtgccctcttctgctctgtggggatacatgcagacagaatactgtatacataacaaataaataaatctttaccaaggaaaaaaaagaaaatgcctccacagaagccaaacatgggccaggcagtggtgttcaggaggcaaaagcaggtcagtctctgagttcgaggccagcctggtctacagagtgagttccaggacagccagggctacacagaaaaaccctgtcttggaaaaacaaaaacaaaacaatggggaaaaaaagaaaacagaagtccccacaagatctagtcagagggcatttttttaaaaattaagtgattgatgcggggaggggtgcagaccaccaaccattgtgggtgggaccatccctgggctggtggtcttgggtggtataggaaagcaggctgagcaagcatggggagcaaggcagaaagcagcacccctccacggcctcttcagcaacccctgcctccaggttcctgccctgcttgagttcctatcctgtgagctcctgtcccgactcccctcagagatgaagggtgaggacgtgtgagctgaatacccctttcctccccaagcggttttggccatggtgtttctcacagcaatagtaacctaagtaagacaccatctctgcagatccaggtcagttctctaaggcactgtgtgtgctgtgtgcatgtgtgtgctgtgtgcatgtgtgtgggagaatgccacagctcccattgaggtcagaggacatcgtgtgggactcaggtctctcctcaccactatgtgacgtcagagaatagaactcagcaaccaaacttagcagcaaagctccctcacctgctgagccatctctccagccctgactcatttatttttatccttctatgtcctatgctttcaagatttttagtaatattatcaatacatttttataacaaaaactatgtaagtctagttaaaactatatcctacacttgcattctacactgaagttactcagcacatttatcagcatctactacatgcaaggcactgaggcagcttcagggatttagatttctaagagttcctgcccataggaggtacagtgaagcccttactgtgcttgggtggagggttaagagatttaggacaagttactaaaatacaacaaaatagacataaaccagtgtggtataatataaacagttaaaacgcaagcactagaggcacactggtgtagctctagccctgagtagtggaaacaggaggagctcaaggctaacctgggctatatgagaccctagctgttcctttttaaaggaaactcaaaaagcaaaaactaaaacaaagccctaagcagactgtgtacgtaaaggaaggcatgggtaagtgtcagaaggatgctgagtcggccctgccatcctcaccaaggataaagggcaagtcaggaagctcagggagaaagagacccacgtggagaagcctggccaagaagctctcaccgtcagtcagtcccaacagtgtggcacaggagccagggcgctctggagatccctggagggaaaagcaggcctgctgccacctaagtcaacactaggctcttatttgcctcaatcaagggctttgtcctacgattagcttaggtatagctgacacctgcacagtattctgactcagcaaaaaccacctccaggaaagaagctgccatcagtctccttaagcgtcagtacactgggccagggtaggctctggggcagacatgggcaactccagctaagtcttagactaagacgcaggagcagcctcagcaccttcatttacatgtgagaggctcgtgccagggtcctctgaggacagtagtgcactcacctgtcagagtgcaggtgcacggaagcctgtgtggtcacagtgtgctgctcacagctggctgggagaaaagccagccgctgtgtatcatggtgcacaccagtgatcccagcacttggggatgaagaggcagaaggatcatgcattcaaggccattcttggcttcatagagaggtcaaggtcagcatgggatgtgtcagatctcgtctcaagcaagcacatggggggctgcacgcgcacgcacaccatcaacggggtggagatggatgaagcagcactgtgaagcatgccaaggcttggggcccacagcacagacaaaatgaaagattttttaaaaggaacaggcagggctggaagagatggctaagtggctaagagcactggtctattcctccagaagaccagatctgatccacagaattcacatggtggctcacaactgtaaatccagccccagaaggtccaatactttcttctggcctacatgggcaccagatacaggcatacacacaggaaatagccatgcacataaagtaataataaaggttgtttgtttgtttgttttttaaagcaatacagaggctggtgcagtctccagcgggcaggagcgcgattggagcttttccgactcccgttcataagccgccagctctccagacactggtctgtggtcacaaccaaaagacaatgtccacttacagataatgtataaaagatgagtgagaggatcatttcggttctccagtcaactctccaagcctgtcattcaatagctcattaaatattcaacagtgacatttgcaagtactaaggaagaaccatttatttgtctgcaaaaaaaaatacaaaggagagaaggatgcacctgcactctgaggccctgaaccgccttctccccagaagcaacttcatttaacaatcatctctcgggcacatgatgcctgctgtgtagggcttgctttaaatgagaatgctagacaatgggcaatatacaaagggctagccattttctccagtcattgtgataacctcaatggctaacatcttctctcagttgatggccaacacctggcccagcagttcccaagcccttagtgcaggctgagatgttcctctgagccctggccctcaatgtctgcacagcacaggtgattctcataggtgttgctgtcccagcactcggcactccacaagcctagagactctacctccaaaggccactaagcaaccctacctttcattcccaaacctggtcattcctcttgccggtcccagcccatcacaagcagttcttcagcttgcacttccagtatagaactcctgagaatctgctgggtaaaaatccagctcccaacccttcctccctccgtatgctgtgtcacagttctagtgattctgtctgccctgcctgccagctccttccagctgccctggatccagccctgtggggctctgctctttcagcagctcctgttttatccaaagcatccacctgctgctacctcaccaccatgtccgcataccccttccattgtataggccacccttacttgcttgtatatatacagtatgctttaggacacaaggcactaacaatgctgcttgcctctgaagaggggcttcaaagagaatgcagggagggggttgactctgggctgcaaatcacaccgccaggataagaggctcagtttggaaactcctgagaggtgagaggtgaaagcccggccacctgtttctcactcgactttatatttaccacacgaaatagtcctgaggccaaggctcagtcttcactcccccccccccccattcccttggctttgtcacagggccatgtggatattttcagagaagttgttaacagaaactcaagagagtaaaaactttttggtgacttagctgaaatgttgaaaagctttttctacactaatcagttttgaatttgaagtcacacagtaccctgtgaagaagaagaaagacaggaccctgtgaggacacccccaatgagatctcgtttcacaggaaaactcggacatctattacccactagtggccaaagctcaggtccagctctcagggaacaactcaagcctgacctgacctggagctgctgtccaacactgaagtgaaaatacaagcgcttttctgtctgcctcactctgtgcagccaaccttcagcagctccgattctgagaagccagaaaacaaaaatgtgctaggtgatggtagccttgaaaggtcaaaacaagtgatcaataaaaacagtctgtaccaaacaaacaaacaaaacccaaaccaacagtccgttcattcctggacccaccattacgcatttgtaggaagtacacttttgtagaccctggcggagctgcaatctcttaacagtctttgtgattcacaccaagaacagatatacattgtggacagcctggtaagtatatgcatgttaaatgtgacaccaccaggctgacatgagcttactggagaatctgacccacagcgcctggacgagcatcaagcactcgacctttctgcagagtttttgggtgctatgtgcaacagggccttgtgcactcctggcctgctgcagagctcctcaatccaccctaaggagctattcccaataaagagaggtcacctcactgttactttatagcgggaaactaagtacaacctaaataataaaagcagagggccaattcagtaagttctaatgtataatgcaggagatgtgatgaactctgcttgtcagtatagacacatccacaccaagccatgcagtgtggaatataaactagcacactgctcaacagtgtggcaaggccagggggagcagtgctgactgcagccaaggtatgtgctaccggtgctttacacactactctttatgagcaggcgttattttctaagctcaaagcggaagcactagacgtttaaaagcactagacaacgcaactgagtcgtaggtttgagtctaacttcaacaccagctgcaccaaacctaacgactagttaactttacagacgactaaacgcagcaggtgacaggtcagatgagtctgcagcaacacaactgctctgctctgccatctccagtgcggccttcaggggcagcggctgactcctggagtcaggtaagcaagctgcgtggcgtaggagaaagaaagggaggcctttcctccttacacaaaggacctgtttgctcctccaatccacccccaagtccccacttggcatcttacggaagcactcagcccctcttccactgtaatgatcgaaaagtaaactggcagggctgagccaaaagccagctcaagcccagaggaggtgaagtacctgctatcagctatgccctctggccttaggattgatttctatgaactttttagcaacagaaagaacaagaagctcacgttcataagtgttcctaacagcagcagcgcactaggcgcccttcaccacttctctctcaaagggacaggaagttagcacgtattctgaaagataaaagctcgccgggcatattattttcaaggactaaagtccaatttctgtagaaataagattcaaaaaatacaaactgtttttctgagaagtctgaatcccaaggcctaggcatagccgtaggaaagacacgggaactacataagggaacttggcatttagcctcacattgacgagtatttgatctgccagaggacgtgcttgtaggtcacattctgacctggtgtggtgttcctgcagccgcacaccagcaccaagtccacctggacattgctacagcctttcagatcacatgctgcccgggttggtgattccttagcaccccaaatccctccccaacgggagcccatctgcaccctaccttccccagggattcaacaagtctttgcaactatctatctaaaaagtacaagcactgtgcttctataaaatccaatggcttactgacagcaagatccatccagagccctctagagattattatcgccttgagggaaaagctgaaagtcaggacaatgtcaagctgaacccaaagtctccaaattacaactggtggccaggaaaagtagctgaaggcaatgggtgaaagtgaaggtgtctgctaagcaccttacaaagtctaactcgcccacacagcagggtggggtggggtggagctcagaaaacagcaggcgtcctctccatccaccctgtcatctgtcatcggcccccaggatctgaacgccacacagcagctagtcagcactcaacagccctgtccggactttcccctctttctcaacagttcactctttcttttttccttctttcttttgttgaggtaggggctcactatgtagccctggctatcctaaaactagctatgtagcccatgctggcctcagactaagagaaatctgcctgcctctacctctcaagtgctgaaattagaggcctgtatcacactaagcctagtgatgttttctctcaaaaacacagactatgtgacagcaggcatatttaaagaacttattaatcttagaactttacatatttaattactgcaatttaaaagttaattttctttttttttctttctttcttctctctcttttttttttttcctttgagacagggtttctctgtgtagccctgactgtcctggaactcactttgtagatcaggctggcctggaactcagaaatctgcctgtctctgcctcccaagtgctggatcaaaggcatgtgccaccactgcccagctaattctctttatataaaataattatatattcaaactataccaacttatcatatgtccaagtaattccactcccagttttacacctgaaaagattaaagttacatgtcatcgccaagtgtggtggcatgcacctgcaatcccagcacttaaaggccaaggaggaaaactgctcagagttcaaagccaacagcctatgtagtgaatgcccatatgcacaccaaaataatatgtaacacctgctcacacaaaagcttatatacaaatatgccaaacgttattcacagtatgaaatatgtgaaaatacatagtgatacgagcagatgagcagatcaacagaatgtagcatactcctgaaatggaatattatgcagccataaaaaggatgaagcattgacactgtctgacctcaactttgaaaacaggtaaaacaaaagaaaggagcatgacgagcagatgagcagatcaacagaatgtagtatactcctgaaatggaatattatgcagccataaaaaggatgaagcattgacactgtctgacctcaactttgaaaacaggtaaaacaaaagaaaggagcatggaagactacatattctaggcttccacttacacacaatgcccagaacaggcaaactcagagaactggcaagctgctaccaaggttgagaaacacccacaagtggggagcaactgcaagtggacagacaggcttggggtttgagggaaaggggcagcagattctgggctcgggaaggctgtacaacctggtaactactaagtatacatttttaaaaggtgacatgtcatgtcatttgactttgcaactcagctttggtatgtatgtatgtatgtatgtatgtatatatgaatgtattatttttgacatgtattgtggagctagaggtcagaggtcagaggacagcttggtggggtcagctttctccttttgctacacaggtcctggggctcaaactcaggtcattaggcttggtgacaagcacctttaccaggtgagccatgttccaagcactgcagctcagcttaaaacaacaaaagactcaaggtcattaacagatagatttgactttaaaaaaaatcctgactgcaagatgagaccaatcaatgtctggacaggacctgagattccagagaggacttcttgaaacttgggtgtcagtgaactctccagtgatgacttgtgtaaaagtgcagtgtttatcaagactggaaatatcaaactagacctaacctatgacctgaacttcattaacgttaaggttcaaaagccaggcatggtggctcacaactttaatccaaccactcaggaggcagaggcaggcagatctcttgtgaatttgagaccagtctggcctacacaatgagttctaggtcagctgtagctgcatatagtgagactctatctcaaaaacaaaaccagggctagaaagataatgattcagcagccaagaggaccagctgcccttacagaagacctgggtttgactcgcagcatccccatagcagctcacaaccattcagaattacagttccagggaacccaatgtccacccacatccaccaagggcatcagccatgcatgtggtacgtgcaagcaggcaaaacacccccacacacaaaacactaccacnnnnnnnnnnnnnnnnnnnnaccaccaccgccaccgccaccccaccaaagaatattttttaagattggcaagactcacaaaaacacttcagaatcctggcccagtaaaaactcaaaaccaaaggctggcgtagaaaactgttttattttcatgtttaggttccaagttaagccaagcttaaacaaacaacccttggctttttaagagcagcttcactgctcagtctttagaggccagaatttatactgcacaaaccatgccttccattttcaaataaatggttttctgtaagctgtgtttagcatgcaggggagtttttgttgctttccagttatgagtcagagagaataaagcgattataaacacattcatatgctctctcactctcactctgactctttccctcccttcatcccttcaagtatgacagagaaagccctgtctgccaataactagcagtgctttgaagttacccaagcatctgaaggtctctctactcatcaccaaaacatggaggaaatgggcctcaaggttgtgaagtctgcagttctcagcaaccttttgatgctgctgttgtgatggggacatcaggtggctctcatggctctgtgtacctaggaaggcacagcatgcaaagtgacaaagctcagggctaagtaaagggaaggaaaacagctcgtgccgcatgggcttactcctgctggcccaatggagagaaggagcccctgccaattttccacacgggatgggagtggtgctgggactcaccacaccctccacagccaatttttcctaaaagaaatccagtggggacaataacagtgtgagtcatcaagtgttctttatcatgactaacaggacaattcagtcccaatgttatcatacatacacacatacatacatacatctatggacagtttctctgtgtagctctggctgtcctggtagaccaggctggccttcaactcagagatctgcctgcctctgcctcccaagtgatggaattaaagacatgtgccactatgacctgtcaatttcaatttttaaaaaaattaaaataataatttatttctcctactctagctttcattcctaacagctgaggagaagcccacagtgagtgaccaaactgcagagatacttagcaagagagagtctcaactcagagacaagacaaggcctctttatgtagaccaagctagccttgaactcacacagctttaccgtaatgtgattcagcttacaactcgtatcagttcagcctgtgataggatggtgtcaatagagtcagaggcaccacctggtgaactgcctcatggctgccaaagaccaaatgaggccaacttagaaagttgtttcaggtgactcccaggatggctttccagaagggcacctccacaacaggacagtcctggagaacctgttcctcactgttctcatgcccactcccccatttgcaggtgtgtgtctgcaagatctttgtcaaatctgactagcttcttcttggacacataagcagcagtgtgtgtgtgtgtgtgtgtgtgtgtgtgtgtatctccatcagacactcaagcacctgccttcagtggcacatggtggactgtctccagcctgcctctgtgctctcttctccaaagaggtcccttgcacagccaaggatccttcagccagtgagccaaggtaacttaacaactgagtgcccaatgctagatacaaaaacgaagagctctaccaaggtgcctgtggcaggcgattcatagccatgctgtttgagggactacaggaaaacctgaacctgactgtctagccagagcctccacattaagtctgacagcctactcctttcatcttttccagataaggaccgcagactcagaaagtccacccaagaccacaaattacagagctacttagttgcaaagcttaacctcaaagtaggcatggtttctgccagaatgccagagcaggagatgaaatctgtgcttttttagaaagggtctgaccagtatctcccgtacccttgtaaatatgccacaatgccaagatagcagcgtgttcaaattcagcagagacttaatacattcagatacagtagtcccctttcttcttgagggatacattcaaggcccctagtggatgcctgagcctcagagagtactgaaccctctaagtactttttcaaatacatatatagctatgataaagaataatttgtaagctgggcagtggtggcacatgcctttaatcccagcacttgggaggcagaggcaggtgaatttctgagttcgaggccagcctgatctacaaagtgagttccaggacagccagggctacacagagaaaccctgtctcgaaaaacaaacaaacaaaccctaagagtggttcactccaggtatttgtcaatgtgatatgctcagacccaggtctagaaagtactattactgccaatcaatcaaaccacagatttctcacaaaaataaaatcaagcccaaaaaactagcttgtagtcagctttataaaacgacctttcctggctcatcatcgcttaacctgtccgtatgactgcagctcctgacatctttttggtggtgttgggtcttgaacaagggcctcatgcatgggtggcaagttagcagcctatactacccacggctcactgtgacttcaaaggcagcacagaccctaagttccccaagcgaagggctgctggctgcctaggtgacttgcagaagccgcaaacggcagcctctcaatagacttcacggcgaatctgtatacttccaaacctagggaggctctctgaaaggttggtaccaatagtgcggtctaaatactacaagatttttctcaacacagatgaagaggttattcatcaattaaaatgagaaccaaccccggtatcatgcttacaaacactccatgtgacaaaaccaaaactcacaaggttatctgatttgaaaatgtcaagagctgggagctgggcacacacctgtatcttcagcaagagctgaaggtcagcctgcactaaacagcaaacgagctacaaagacactgttcacacgaaaaagaaagaaggagaaaaaaaaaacggcaaacaattactgtcacaaaaactattatttgctccgatgccatattttgtctaagcctatgaagcttttaagtaaccataaactcaatgtcactggagaagtgaaaccaacgtgacatttgaacctaggcgccaatgacagtctgtccttcaatatcaaaagaagagcttcccgaactgaaagacctttagtggcatacagggaactctccaagggcataccctaggtaaagtttctgacagcttgtgcatttgtttaggcctttggacagctctctctctctctctctctctctctctctctttctctctctctcctctctctctctctctctcctctagtaactgggatagatcttaggaagcacctgtggcctaaaaagctgtgaccgagtctcacagcctttttggctgcagcctacaagcaggtccagccattctattttgggtcaaggagacctttctgccacccccaagtgacctcaagtagacaagctgggttagggagaaagcactgctagaatttctaaccaggccagcagtccacccacaaccccacggcccttcccgaaaaggatggcaatccgaggacggtccaggcagcgggaagaacccacgacggggggctgtgggctccccgccgtctgtcttcgggtctgctcccggatcccgcagctgggaccgggccgtggcgtcaggagctcgccaagaagcagggattcccggggcgccaagagggaggagggagtgaggcaaagcgaggttagcagcctgcaggtgtcgccgaacgaggaggacgaggtcgcgtgggggctgtgactaagaagagtgcgcggttctgcaccgggacggactggacacattcccaaggcggtgaccttgggcacgtggctccaccgctctgtccctcagtttccccatttctaaagtgtggggatggggagggagggatcgtgaggcagaaaacgcatctcggggcgctcggcaaggcgctgcgctgcgctcagcggaggaagcagggaagactcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgccgcccctgcccgccgcacggggcctcgcacacgctctaccgcacgcactggagccagagcgaggtcagagccggcggctcctccgcctcaaccacactggggtcccggctgcagccgccgccgccgccgccatcttccgctccactagcgtgttccgggccgcgccggcagcgccgccccctctccgaccccgccccggccccgccccctctccgcggctcaggtccaagccccgccccctcggactcgcagccctatgtagtcaccggaatcgagcgtgcgcaaagggtgtgggcgcagtgtctcctggaagtcgtagttaagagttatagtcgctttggtcttggctacctgtgatccaggagttagatttaccagaggactgtaaattattgagaatgaccggtagactgggttgttgggggttttttttgggggggaattagaatgggtgtcctgttttgattttttttctctctcaccacctttttttttccctcttctgatttttttgagatagagtttcatcaagcacaggctgacctcagactcgctctgtcaccaaggttggccttggattccttctgatcttgcctacagcttctcaagttcaaggattacaaattatgtgccactatatcttgtttaacagtttcttccatacacaccacatacacacaccctctctctatatatattcctttacataactgtaagaaaccaagattgggattctacaccatctagtatactgggtgagaaacggcaatcctaacatttccattattcctgtgtcttgaaagccccagatctagtaccctagatcctaagtttgacagtcaacctggccaagcaggtctttttcctgcctctgatttggaggccttcagaaactgtggagggctgagagaactgccaagatgaggcctctttctccagccacagctgccttctcttttcaagagggtcatcccttggcagaaagaaggggtcaggcatgatggcctatagctctaatccctggcagttaggaggcagaggtaggcagatctgtgaacatgaggccagcctgatctacatagtgagttacaggtcagttaaggttacatagacaccctgtctcaaaaaagaaagaaagaaagaaagaaagaaagaaagaaagaaagaaagaaagaaagaaagagagagagaaagagagagaaagaaagaaagaagagagagggagataaagaagagagggggcactttctattttattttttctaaaactcttggcctatttgaacaaagatcaaacagccttccccaaatattaacaattgtaagttatttccctaagaaattatttcagttgagtaacagcaaagactctttatcatcatcatcgtcattactgttctttttttttttttttaagatttatttattattatatctaagtacactgtaactgtcttcagacacaccagaagagggcgtcagatctcattatggatggttgtgagctaccatgtggttgctgggatttgaactcaggatcttcggaagagcagtcggtgctcttaaccactgagccatctctccagcccgtcattactgttcttaagagaactttttaagctgagcagtggtggcgcacgcctttaatcccagcacttgggaagcagaggcaggtggatttctgagttcgaggccagtctggtctacagagtgagttattcttattttatgtgttttttctacatgtgtgtcctatgtcatgtgtgtgcagtgcccctggggcctcagaagagagcattcgatctcttaaaactggagttacagacagttgtgagcagccatataggtgatgggaatccaacccaggtcctctagaagagcagtcagtgctcttgactgctgagctatccctccagtctctagtattttgttgtaaagacaggatctcctataacttaggctgaccttgaactttctgtttgcctaaggctgacttgaactcagtcctgtttctccttcctctacaggtcaattgcccagccttataagcacacactagcatgcccagtttatctcatttacagtgttggtatgtgtcataaacatatacacattgaggtttcattcctagccagtgtgggtggtgtataaatgatctaggtccaaaataccttttctagctatttggtgtttccttgctgactggcctcctgccaagcacacagctgccccaaaacctttcctttattctttcttctaccagtgaggatgtaattccatatctaaggggatcttagatatctgtgttctctgttgtgctcccagaccatgggatttcactacagaccgggttactcaggggtggaggcaaataggcatcatatcatcagggtttaatctaatatctggcacatgggagagaagtttgtaaatgtctgatctgtttggtaaaagaaagaacagtgggctagaccatacatactatcagaatggaaggaaatgtttggaaaggtggaattcacaaacaatagaattggcctttagtaatccaatgtgaaataatttgtagtttaacttaatattgtgtataagtgtatgtgtgtgcctgtgtgtgtgtgtgtgtgtgtgtgtgtgtgtgtgtgtgtgtgtgtacataggcacttgcatatccagggtgtggaggttgggggacacataccatatgtatgcaagactgaggtcaaaggacagcgatcaggagaccagctcttcccttccaccttccacgggttctaggaatcaaactcgtgtttccagggctgcacagtaaatgcctgaacctatggagttctctctcacgccataatttaaaattgtaacataaaaaaaaaaactcatccaggaatgtttgcctttttctagatccactctgaacagcattccagtcactgcagtcatttaatggtccttttttaagatgcagtgttgttggtttttttttttaatatacctaaagtcctgccaactaaacacccattactatgtcgcctaattactcttgttcttaaacacttctgcagttcacttctgcatgccaagcccaagctcttctgtaactcaaaggttcgcatcagaannnnnnnnnnnnnnnnnnnncctgataaatcacttcctatgatgagtggctggatatacaaaacagaagttcactttggagataaaaagggaagcattcacatcttgctttgtgtgtgtgtgtgtgtgtgtgtgtgtgtgtgtgtgtgttacaatacaataactggcacatgtccaaaagagggggcagtgtctctctggaatcctctatcctctgttgcttggcatttccgtctctgccaactgcgctaaaggttgctctttaaaccacacacacgccactagccagtcccagccagcctgtcaggtaatcctaccccaaggacaagttttttttctttaagacggtatgccaacccgttccttgccttgtccggctcccgcagaccaatcaaacttatttttcaaggcaggtataattacccaatttccatgtcggtcatgaaaaccggttggattgggccagcgggaagacaggtggctcgcttgcctggcctttgccataacctgtgtccccagttaagtctgcggtggcgactttgggtgtcacgtgccttgagtttccagccgccgagatttctgccgacgggttgctttctgaggcatgtggcaaaccgtcctttctcaaagttcctgtgttcttttcttgcatgtgcaggggaggcgggggtaggttccctggaattattggttctaacgccagctctgaagtttcatcagaaaagccaggggaaaggactttgcaaaacacctcgcgctgctctcccctagggggacaattcatatctgacatttcactggacttgagaaaccctgagttttcctccttagtggagttacattcctagcacttcaaggattcctgggaggtcagttgctgctctcagaggccaagaagtggtgaaaataccatccaggctcttggagcacctctgtggcatcaggaaagagctttgcccagagattgccaagcctccgttactaatagaagagaaagaaaagacacatattttctaaagggaacttcctgccaggccaggccaaagatctcctctgatttctattttgctagcctaaggaaaaggagcactagttgttaattcgtggtaggatttcccaacactgatactattgacatttggacagggtgtgtctttgacagcctgttctcagcaccataggtgacttggcaacatccctggcctctacccgatagatgctggtagcaccctgccactcccagagggataaatggaaatgtctgagctgtttccagataccctcgggagggtacaatcgctcttggattagaactagcaagttatggcaacaccaggcaagcgaacaagtaattgtcaagcattcattagattaaaaaaaaaaaaaaaaaaggtctagaatggaatgggaagaggttaacaccaaggagtggagaaaaaacaactgctgttcagtcaagtaaaggaagtgatagtgcgcccaaagggcggggaacgccaggtcccgtgaagaggtgaagaggtggcactctaggggctagggctggggctcagcagataaggcgcttacctactgcacacaaagccccgggttcgattctgagcaccacataaatcaagtaggattgattatactctccacactcaagaggtagaacccagagcatcaggagtttaaggccatcctctgcgacgtaatgagttccaggccagcatgggctgcttacgacccttctgaaagaagaagaaatcaagaggagggggaattgttatcctcaaaggaaggcagagtacctgagaagatagtctagtgtggcttaaaattaagcacaggatttaaaagggggaggagtgacagagacaagatgtatcccatggtcatgaaaaggaattcatacatacatacacacacacacacacatacatacacacatatatatatacatacatgtatacatacatacacacacatacatacgcgcatatatacatacacacatacatatatacatacatatacacacatatatacatacacatatatacatacatacatacacaatatacatacacacatttatacacacacacatatacatatatatataaatacatttatacatacacatatacatacatacacacgtatatacgtacatacgacagtgaggatgagcttcagaaacccttgtagagaaagaagccagggctctcaggatggctcagtgggcaaaggttcttacagctaggccagaccatctgtctcaatcccctggaaccaaatggtggagggagggaatccgttcctgaaggcagtcttccaactttacacgtgctccagggcacacactcccattcaagcatacgatagataagtaataaacaataaatctttttttttttttggtttttcgagacagagtttctctgtgtagtcctggctgtcctggaactcactctgtagaccaggctggcctggaactcaaatacccacctgcctctgcctcccaagtgctgggattaaaggcgtgcgccaccacgcccgacttagaataaatcttaaaaaaaaaaaaagacccaagactcctgtaggccggtgcctgccttcaatcatagcactcagaggcagagacggatttgagttccaggacagccaaggctacctagaaaaaccctgtttctcacagacagacagacagacagacagaagccagccaccaaagggcagcatgtcccacgccatgttcagaacaggccaattcatctggtgagggagcatattacttacagttgaaagtcctgagggagaggaagacagagagggagtaatggtatgaggttgctctgggggacttcagagtctggaatcacacagggacaatgtggcacagccttataaagtctgtaatagccattgactaccagactgtaaagaggagaatttcatagggtgtcaatcagatctcaatttaaaaggccctacagagggtgggtgacccatgccagtctgaggggcgggggggggtacataatgccaactcaggtgctaccccatgcttccttcatctacttggtattcagaagctcttgggatagagagcctcacgcaggcaggatgtgggaagctccaccctaaaggagcgtggtaaacctggttccattgggctgagctctcacactgaacagaaagaaggcagccagctgagcgctgtgttcatcgcgctgtgttcatcgctctctgcttcctgagtgcagatgtcaggattctcagctcctaccaggtgagctcccgggatggaaccaatgcagaccctaaggttttacctgctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacacattagcttactgttgaaatgccttggttacctcaaaggcttggcactcctacaccttcccctgctaccccaggcccaatcagggaagtggccaccagtcacccacctgaattctcacgtggctggttggcttcctcacctgcagcccctgggccccatcattcttctccagtcggggaaatcctcctttctcccctctgcgtccacgccctccaaacaaggacctttagcttttggaaacagagattcctggttgaatcagagcattagaaccaatctccaacaaccaagcaagcatctggggacaaacctaacttggtaaaagaaccttggcggtcacacagaacaagcaacctgttttccacctgaggaaagtgggtgaatagaaagtctatgccaccacactgtggaggtacatgcttgtaatcccaagattcgaaagtcagaggcaggtagatatctgtgaatctgaggccagcctggtccacacagctccaggacagccagggttacatagtgagacattgctttttttgttttatgatttttttaaaaattgagtgtagtggcacacaacttcaatctaagcacttggcaggtagatctcattagttcaaggccagcctagtctacagagcaagttccaggatggtcaaggctagagaaaacctagtcttgaaaagaaaagaattttttttaatttaaatttaaaaagggaacaaaatccgaaaaacttctcataagaagccaatgggtagttgggtgttgctggtctgaactggagacctggagaggggtctccaggaagttaatgactaggaaggaactaggtgccatccattcttggtagttggttcacattgctttgctgggatgtgggtggaaggtggggaggtcatgttttcccctcctgaaacccatcgcctcctctcagctctctgagaatagaatttgattctcttggagaaaaagtaatccactatgtctgagatttgtgtacttggaccaatgttccaagaagcgacacactggagctggagagacaccttatttggcaagcatgaagaccttagttcggagatccgaactaagcactgacaagaaagttgagcccagtggtttgtgcacctgcaatcccccagcgcaggggaggtagaagcaagaggaccccctggtgcttacttgtgagctccgggttcggtgtgagataccatcggaaaattaaggtagggatcaatcgaggaagatacctgatgttaacgtctggcttctgtacacatacctatgtatgtgcacgtgcactagaacccgtgcgcgcacacacacactcagaaataagtcaactcacgcgcaaagtggagacatgacccatctgtggccaatcagcatcctagtctcttggtcacagtcattggcttaaagaggaaggacctaactagtgtcaaaccgatgaaagcgattttgagatcgtgtagagagttaagaagagtcaatgcccaaccagcgccctagagcaggtgggatgcaggcttgggtctccgagggctgccatcttggctacttgattagaaccaactgtgacattcattgaagccccttctaaaatcctgcgggcctcaagagaggatcaatcacattttgctgagttcccccttggacttaagcctcaggctttgacttgcaaaacaaagcggcccgacagacacaacacgtgaccagcttccatggctaccctaacagtgtcaagaacaaagttcctaccacaaaggcggctgtgtgggaggagcttctctgctcatttgcatagagaagtgggaacaggtgcctctcagggccccactgaaggaaatttctgacttcctgcttcagtctctgctccagatacagcaagctcctgattggagggcttggaaaagatgctgggtgtgtagcctgtctcttccacctttttgacctcgatctgtcctgaccttcagacacgtgcgttacgtggacacctgtggattcctggtccctgtagtaacccagcccaggtctggcaaaatcagtttgatcccgagaggttgtttctgaccaagctgggtctcctttgaaatttgaacatcaatgttagtgcttagatttctagtgtcctgatttggacgtcaatgttagcagtactgccactccacaaaacccctcgtgttcactgatgtttctctttttggagagcttccagaggccgactttgggagcctaaaataacacgtaaaggtcagttgttgtttttttgtttttttaaaaatacaatccaggggggttggtgggatggctcagtgggtaagagcgcccgactgctcttccgaaggtccagagttcaaatcccagcaaccacatggtggctcacaaccatccacaacaagatctgactccctcttctggagtgtctgaagacagctacagtgtacttacatatattaataaaataaatctttaaaaaaaaatacaatccaggtctggggtttaaaggtaatttaactgtgagttaggattctgggactgggtggtttgagatagctaaaattgttctgctaggttttaactggtaactacctaaggacctaaatttttggattgaagaaaccattcattcccacctcctcttcctactctaaactatgaaaactgtcctcaggttgtacagtgggtctcctgggtgggtctaggtgctcccttctctgaccaataaaaggtctgctcttgctattaaggcagatctgcatttatttaccttctgccagtttaattcttactttgcggatcccaggggtcaaataaaggttatcaggcttggccccagtcttatttactgagctatctcacccgccctacccgtctccgcagcccccaccccccatcctttaaggatgatgctggggattgaactcatggcctcctgaaagctatgcaaatgctatcccgtgtactactccagccctttctgcctaaacataaacgaattaattaaaaannnnnnnnnnnnnnnnnnnnnnnnnnnnnnnnnnnnnnnnnnnnnnnnnnnnnnnnnnnnnnnnnnnnnnactagtgaaagtagtgagtgtttccttgacttttgccatgaagcagaagatgaaatcccaaaggtgagctgagagagaagtgggagaggctgagcactagagcctcaggctggtggagacaggtttgctccagatgtctgggaggacatgatatgctctggggacagacaaaataaataaataaataaataaaactgtccctgtcacctgccagaaagaagccagaagctgagagagcagccacccaggctggagaagcagatgttcaggcttgaactgaaatcttgggagacagcctcggcaggtgtgagagggaggggggaagctttgcaaggtgctccgagaggttttaagagaaaagaacaacccacaagtttaaggaacccaagaaaagctgaggtaaccatttaattaagtcagtgggaagaaaatattattactcttttttttttccagtgattcagggaggttagtcatctctttgggaagatctaaactggaagctgggtttgtgtggctcatgcctgtaattctactctctggaggctgaagtaatgaagatcaaaagttcaagaccagagctaagaaacggctcagcatccaaatgcacttcctgataaacctgatgacctgggtttaatcctgggacctgcaagttgtcctctggtctccgtatctgcactatggcacatgcgtgcgaacacacacccacacacacatgcacgtacgaggccagcctggtctacagagtgagttccaggacagccaaggctacacagagaaaccctgtctcgaaaaaaaaaaacacaataaaaataataataataattcaaggtagtctaagctacagtagagagactttacatcaaaacaaaatcaagttagtttgctccttgacttcttatacacatttcacaaaatgaagagacaaaggaaaaagagaatacattccaggcaggaaatttttaatcctttagaatttgtatctatgattgtgagtgtgtataatgcatgtgtgggggtgcattgtggggtgcatgtgtgtgagtgcccatgtggaggtgcactgtgggggtacactgtgaggtgcaagtgtggggacacatgtggggttggttctttccacctctatgaggatcccagggatctaattcccattgtggagcttgtccaccaagctcttcccagtcagccatctcaaatgctcttttattaaaaacattatttagccaggagtggtggcgcacaccattaatcccagcactcaggaggcagaggcaggtggatttctgagtttgaggccagcctggtctacaaagtgagttccaggacagccagggctacacagagaaaccctgtcttcaaaaacaaacaaacaaacaaacaaacaaaaaccccattatttattgtttagcacattcacacacccagagggtgtgcacatatgcattcacatgggagtttgtgtgtgtgttcattttctccatcctccatgtgggttttaggaattggattcaggccatcagtcaagtgtcaccctactgagcaatcttgctggcccacaattggttttttgtgtccaggtttcattatatagtgctggctggcattgaattctccatacagactgcccttgcctcaggcttacagagatctgcctgcctctgcctctgcctctctagtaaaaggtctgtgctactacatccagcataaaccttttcttaaaattacatttgtttgtttgtttgtttagcacatgcgtatgtgatgtcatgcttatgatgtcagaggagaacttggagtgtttatttagcacatgcgtctgtgatgtcatgcttatgatgtcagaggagaacttggagtggattctctcgttccatctttggttggttggtttgctttgtttttggaaacggtttctttgtgtcctggagctcactctgtagaccaggctggccttgaactcatagatccgcctgcctctgcctcccgagtgctgggattaaaggcgtgcgccaccactgtgtggctcattctatatatgggtcccagggattgccatcaagtcagcaatcttgaaagcaagcacctttctttacccatggagccatcccaccagccctaattgtttgttttaaagatcaaacctcagagctgggaatgtggctcagtggtagcacacacttatctaacatatataaggcccttgtttcaacccctgttacctaccttgcccccactccactgtaaaagagaaaaggagaaagaaagggtagaaggaaggaagaaaagccatggtttgagagacatttcttgtttctcttttgttgggcctttaaaaacagctgttttaggggttgtagagatagctcagtgattaagagcactgactgctcttccacagatctggagttcaactcccagcaaccacatggtggctcacaaccagtaatgggatctcatgccccctactggtgtgtctgacatcaatgacaacgaactctcatatataaaatgtgtaaatcttaagaacaaaaacccaaatattttggatttattttatttctacaaatacaagagtttgcctgcgtgcatgtgtgccaagtgtgggcccggtacccaaatagatcagaaggcataagatctacatgatccccaggaactggagtcacagatggttatgaacagccacgtgggtgctgagaactgaacctgggtcctctctgtgatgaacaaaatgctcttaaccactgagtcatctctctggtccctttgggtttttttgctttgtggtttggttggttttggagacaggatctcactctgtatctcaaactggcctggacctcactatgtagccctggctagcctcaaactcacagcaatcctcatctcagccttctgaatgctggaagagaaaaatgttcataaagcaggaagtcaagaaagagttcctatctagggactaagggaagagatgggtccggggctaagggatctcgctggctttttcagaagaccccagctcagttcccagcacttatattaataactccaactccagggatcaggcacatgtgcacaaagaaggaactcacatctagaatacacaactaactacacattaataaaaaccaccaacaacaaaaatctaaatacccacaagacaacttggaaaagaaaatccttgtatccaataactaggaagagacattcactcccggggtgtccacagagagacgcccacagtatagaggctagctccagcggcacgggggagaaccaagacttctgtgtcacatggagaatgggaactgaggagaaggctatatagcataaggaccagagttcgagtctcagaacctacataatcaaagctagatacccagatgtggtggcacgttgtgttgtaattcctgagataggcagactcctgggcctcactaacctgccagcctcgcctgctctgcaagcactaggtcagtgagagacccaaccctgtctcaaataacaagatggaacccatgcacatgaacatgcacatgtgtacacatgcactctcaagcgcgcacacacacagaaattgagaacttttcaatgtcctggaggaaactgggcgtgttggctcatacctcaaaccacaacactgaggagactgaggcaggaggattgctgtgagtttgaggctggcctggactatctagtgtcctgtcgcagtttttttttggagattaaaaccttctattttggagggaaatgccttaaaacacaggatgttaagtagaaggtataacagtaggatatttaaaaatggtgtgtgtgtatatatgtgtgtgtgctgtctttgagtcatttctgcttctgtacgtaatccctcatccatattcctataattaactgcaataaaactcattggttcaccaagttggacttctgtctgtcacttgtggccttccaacctagggtgatgggaagttcagtctgtcactggttccttccctgcgtagggtgagtgcatgtttattcatgaatccctgcttacagtctcagaggacacacagggaaaagcctgtctccaagtagggtgtgggtgtgggtgtgggtgggtgtgagggggccaaaagttcagtgcaaaaacgaggaagcaaaccttgttgaggttgggcaagatgaggaaacttcttctataggtcatctgggggtcacagaaagaatttggcctatttgaggtgtggagtgatggacgtcggggagatgtcacgtggttttctttttggtccttgcctctgtttgcacgacccagagattgtccttcacatctaagtcaatggcactggaaagcaattctcaaatcctgccctttccttcacctccccagtcccgttctttgtcagttaattaccagggacaacaggagagtgagaagccagaatgtcatacatgactcacacaaacgcacctcagaaagggattcaacttgccaaagcccaaacagctaatgtggtgaagcctgccaggtgtggtggcgaagaccttcgatcccagttctccagaggcagaggcagacgaagctctgggagtctgaggccagcctagtctacatagtaagttcccagacatctaatccagggctatggcaagagaccgtgtctcctaaaaacaaaacaaaaccccaaaaacccggcaaaagtcatagtaaataatgtcctttgcagataatgtttattgtatgcgggagggggggagcattttagttttgaggaagaacaccagttaaggctctgacttgaactaacattgctcaactgaataattttctgggtgacccttcatcttccctgaaagaagactctagagcccttgtccatggtaagtttcttgtttgtttgtttgtttgtttgttttttgaggcagggtctctctgtatagccctggctgtcctggaactcactctgtagaccaggctggtctcgaacttagaaacctgcctgcctctgccttccaagtgctgagattaaaggcatgtgccaccatgcctggctccatggtaagttctaagtgtctttaaaactctttatttcttctatactgggggcagggggaggcaagtatgtggcggtcagagaacaacttgtgggattccattcttgatttccaacttgtgggtcctagggccagaactctctggttgtcaggcctggcgagaagcactttgacccactgggtcatttccctgaccattaagtgttttgttttgttttgttttgtttttgctttgattcgatctcactggttctcctattaggtgctcagttaacatttgctaaataaacaggagctaatgaaaaaaaaaatgtttctcttccccttggaggtgactaattttaatgacaaacgctgccaccttcaggtcgaaggtggaagtgtaaggttcagaacagcaaactgtggtaacctgtcaactacattcaaaggcaatattacatttttctctagttttacacagactctaatcagccggcacctgtcctttccatcaacaacaaggccacacttcctcaaaaaaagaccacaccccctaagagtgtcactccctgtgggctcccaagcgcttggattaaaggcatgtgccaccactgcctggcttagtaatgcattttatgatttattttaaggattgattatgtatacgtgtgtgtatgtgtgtgtgcatatgcacatgtgaatgcaggtaccaaaagaggaagtccagttacccagatctagacttacagacagttgtgagtcacctggagtaggttataggaaacaaattcaggtcttctacaagggcagtaagccttcttaacctctgagtcatctctccagcctctattttacatttaattctatctattcttttgtttttattttgtttttgtttttctgagacagggtttctctgtgtagccctggctgtcctggaactcactttgtagaccaggctgacctggaactcagaaatccacctgcctctgcctcccaagtgctgggcttaaaggcgtgcgccaccacttcccagctctgtttattctttccagtaaacttggggttataggtaatgtgcatgtgttgtaacacgggctgcagcagcagtgccgactgaagaggccccatggagcttcaagaagaggtgaccgaaagaggaacttcctgcaggtcccccaaacaacagtgaaaacatgtttacatcacagaactccaaacagatgtcgggaaggcaagagcaacagatctcaaaggggtgtgtgtgggggggtaagggtagcttaattccattttgaagcccgatttccatcccatgtagacctttaaccttgctaggcagctgaagctgactttgaacccctgatcttcctgcccgccatcatctccggagtactagaatcacattcccttccttcctgctgtttttctctcagacaagatctttctatgtagctcagggtggccttgaacttggggctgtttccctgctgagtgtttcaagtatctactacacctggcctcagactgtgtgctttggtaactgcaaagtcagtgggtcagcgcacgtcagttgatgggatattaagagccaatttaggttgaaggtgcacacacctgcagttctgacactaggggaggctggccaggaaggggcagaggatacacagtaagactttgtctaaaaaaaaccaacaacaacaacaaaaaaccaaggctggaacctgccttggtatggtgccttggtatggtgccgttggtatggtgcttgtctcggatgcatgaggcgctaggttggatctccagggtcatctgtactgggtacagcgataggcaccctgcatcccacccacttgggaggaaggagagggaagaccggaagttcaaagtcattcttatttacatagtgagtttgaagccagcttgggctacaggagacaccctgacttgaaacaaacaaacaaacaaacaaacaaacaaatttacctgacaaggagacaccaccgcaagcctgtcaagttagccacaaacaaaaatggaagtggagttgatcatgcctaacctcccagtgtttcaagagcatccaaaactggagttgtcagactctattggtggggaaagaacactggggagtggctctggagaaaggttgggcggtttcttataaacttacacacaagaccatagaatgtacttctaggaagggtatccaagagaaatgcaaatacaggtctacttaaagtctagtatacctgttagaacggctttcattaaaaaccactgaggggctggcgagatggctcagccagtaggagcactgactgctcttccaaaagtcctgtgttcaaatcccaccaaccacatggtggctcacaaccacccataatgagatctgatgccctctactggagcatctgaagacagctacagtgtacttacatataataataaatcaatctttaaaaaccactgaaaactaaaaccaaaccaaattctacacccagtaaacttgttacttgttgccaacaaaaatgttgactgggaagaaactccagcataggtgactactatattgcttatattcatatattcagttttgaataatggaagcgtcacatttagatgtgtgcttttatttgggtgcacacactcatgcaggtgcccccagggaccagaggaccggtttatatcctttagagctggagtaacacaggtgagaagccaccatgctggtgctgagaactaaaccctggtcttctccaagcagcaagggctcctaatggctgagtcatctctctagcccctagatggactcagtgaattatgatggaaagaaagaaagaaagaaactaacaaatgagtccccactgtcccctaaggctttcgaaatgtatgagcagataacagtctacaccttgaagtcaaatgtcagaaaattacattgaggcttgagactggataaaaggattttgagaacttttcacagaatgatttgaagcacagggctgtaagacttaaggaagggctggagagatggctcagcggttaagagcttgggctgctcttccagaggtcctgagttcaattcccagcaaccacttggtggctcatgtcatgtctatgactgtctcatgggatctgatgccctctgctggtgtacatacatacagacacaacaccatatacaaaaaacaaaacaaaacaaaacataactaacccttaaaaaatacctgagagacagaggcaggtggttctccgagttcgaggccagactggtccacagagtgcattctgggacagtcaggtctacagagagaaaccctgtctcaaattcctcccccatcctccccctaccagtaaacacacacacacacacacacacacacacacacacacacacacgatgagaagaacattccaaatgatataatcataaaggcagatatggaggttggatgcggtggtgcatgcctggcatgaggcactgacatagggctgccttgggttcgagattagtcaggcacagagagatcccgtctaaaagaaccaaaaagttaagaattcttttgtttctcttatcataaataaatccgtggacagaagtgctctggcgacctcctgcgatgtatccaaaggcaaagaaagtaaagaaagtgttacatggggtaagaaattcaatgtaacttaaaggaaccaagtcacttctaaacatgcgctgcgggtcttttattagaaatactctcttctaggctctgccctagtcttgactgactccgaattctgtgaggctatagctgggaatctacattttaaaaaaaaaaaaaaaaaacaaccacgcagcacccaaagtgtcacaacagaagtttacatcttccgattttctgagggctccttagaaagagctgtctcataccccgcccccaccggccccgcccctcctctccgattccgcccaggccccgcctatagcctcgcccagctcccgccccattcgcgggtctgacttcaggccccaccttcttccgcagaccagtttggcctcgcgagccctttcccgtgatacctagcgctaggctgtgactgttgcccgggcaacagacgggcctagctccccggcgcgggctactctgctaggccatggggtcgcggggtctcccgccgctcctgctggtgctcctaaactgctacacctcttcgagcacccaggtcattgccatcccggctgcggccaccccagcagtgacgaaggaggatctcaattccaccaaggccacccccaccactctgcagccctccctgtcgcctaggaccccgggaactcccagggcaccggagcgctctggccccaggcctaccccggtcacggacggtgggtacaaaggggtgacccccctggagcgggtacaccagctcaaagttacccccttctcagcctccctgtcgttaccctcagggggagatcggatctctggcacacaaatgcggagggcggggctcagttactcccttttccgcatcattgcagacggctgcagtggggtactagatagaaacctacagaatgagttgaaggcagtactggtagaagaaagagtgctaagtggatcttcgtcctctccacgcagacacacggacatgggcatcccagttgtgtctagattactgagagcccagcagatattttcagggtgattaagtgcgttttagacattttttaccagctaaatggagttattaaacacacctgtttcatccgtatctacttaccgctcggaatttgaagctttggcaacaattcgtggttgtaaatttaaacacatgaggtagtggacttaattgctctctcccttttacccatcccagtgaagggagtatggcgttcttttagtgagtacgcgcagttgtccatggctagagaggacctagtcaaggaggagctaatttgtctttcggactaagaaagcatttttcatttatcaataaaactcccctttcccttcgtgcctttccagagcgttataccactttcggggggaattttttctaaatcttaaaaaagtattttaaattgtgtgtgcatatttgtatatgtttgtgaggatggggtggatatatattggcgcccttggagaaccgaagtggggagctggagtttgtttgagagctggctgacttgggtcctgggaacagaagttaggtcctgtatacaagcagtatgtgcttttaactcctgagccatctccccagcctgttctagaaccattccagtctcctgccttcgccttctttcctaactttgttcctgacaggtttgctaagtgacccagactggcctgtaacctgacatcttcctgactctgcctcccagttgctgagattcccaggtgtgggcctcccagcctgcctcccatctctagagcttgtttttttgttttggtttttttttttttgtaaattttgaaaccattcattcatacaaataagaatgctatgacatcccgtcagcatttggctaaaattctttgtttgaagcctgagattattgcccctcttccccaaaaggaaaccaaacattacagttaagatgcagcccagggggctggagagatggctcagtggttaagaacactgactgcgcttccagaggtcctgagttcaaatcccagcatctacatgggtggctcatagccatctgtaatgagatctggtgccctcttctggtgtgtctgaagacagctacagtgtaactcatataaataaataaattaaaaaaaaatcaagccaggttgtgcaggtggtacactctttaatcctggggaggggtgggggaatctctgagtgtgaggccagcctgatctacaaagtgagttccagtcagggctacacagagaattcctgtctcaaagaaaaacaacaagaaacaaacaaacaaacagattcagtgacaccttagctggggaaaggcaggaaccatggtggaaggcacctgtgacccaaagtagcctctgcttcaggaagcaaagagcaaacaaccaaaattgccaaagccctggatgcattatttcctctctcctcacagtagtctgtgccatgaattcagtttgttatctttgtgctatatattgtttcttgttgttgtatgttgtggttttttttgagattatcttatctatctgtatgccatatacgtgccccgtaccttcagaggccagaagagggcatgagatcccctggagccagagttagagatggttgtgagcggtcctgtgggttgtggacaccgaagttagatcctctgcaggagcagccagtgctctatcgcgatcaccccgcctctttagccctctgttgtttctttgagagggttttctccattgacagagatagaatgagcagggtagtaaagacagtagtaaactgagccagtctatcgcgtgctcagtactctgcgaggaagctctcccttctgctctcgtggaggttctctgcctgatcgatgcgagtcctgaagactcagtcacagtggctgtcagggtggctgaggtctgagttgctgtctgggtgggggtgggggggatgtccctgcctttcctccatgttgttgttgtatcctgtcataaatgcattaccttatattgtaaaattttaaattacaaaaggacatcataagccaaattaggaacatttgattattggtcaggatcttacgactttgagttcagcaaccggctgcatgtgaggaaagggacaaggctgccaacagtccttccttggaatctgctctgaaggagacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagttgctgctctgtgtgtctgcgacctgcttccggcacagtgtgatgtcaactgctgttgcgaccctgactgcagccctgcagatttcagcatcttctctgcctgctcagtcccagttgtcacgtaagcatacgacattgtcacgtaagcatacgacagggaggtttgatggccgtttggccaggatgataaaatgtggggacaggaatcatgttccacactcctcagaagccctgtgggcaaaaccctgtgttgtcagaagcagtcacttgtcccgtgcagctgctcaacagtgtgggtgatggagggacacgtgtgtgttgcctctagagtgttatgaagtttggaaattaatatttgagctgtgcacagataatgtgtcacctctttgtacctgtgaaatagtctcatggcagtgtgtgtgtgtgtatgtatgtatatatatagatagatagatagtgtatgtgtgcatgtatgcatgggtgtgcttgtctttgcatgcatgcatgttggcctgtggaaagcatgggtctgttcatttattgctttccaccttcatttttgagatggggtctctcactgaatgtagaaatcatccccctagcctacccccgatccccggttgacagatggctagcatcctcttgtctcctcccctgcccggtgccctgttgcagatacacatcagagcctgggcttggtttgcttttgaaatccatgctggatatcatgcttctttaaaatcacccttcagaagcaagtacgttccccactaggctgcgtccccagcccctgttcctgctaggccgcctcccctgcccctgtccccactaggctgcctccccagcccccgaatcagctctctctggggacttgaattagtcagggtgctttgtgtgcgtctctttggatgtaagcgaagcaaggcttctcagttcccagtgcatgggaaatggcagaggtggaattctcacgcaagtacaagtcgaagatgtgatcagctctgagtgatctcggcttgtttgtcagaggtttttgtaacacaaaacaaaacagccctttaagaaaggtttaagctctcaggatgggaccagcagatggagctgactgaaatgcaggacagccacctagcatgcttagtccttttggaaacacaatggactcttcccaggagaaaccattttatcagcctaatggggcaactgaatttcctccagcattgtgaaatagcctggagagcaggtgctagcggggtcccttcctggcctccaagaccagagcgtgtttagccttccctgaaaatcagtccgcttgtcttgaaactgcaagcgagccctgacagccctgagagaatggcggcttttgaattgagtgccatttattaaattgaatatttttttaagacagggtttcactgtatagccctggttgtcctagaacttatatatagaccaggttggcctcaaactcagagatccacttagctctgcctcccaagtgctgggattaaaggtgtgcaccattgcaccaccacggcctggacacccatacaacttttaagagcttcctgttggctgagggagatgagtgagtgagccagggcctgaggaacaccagggaatgaggtcgcctcagctaggccagggaaggccttcctgaaaagatggtctgagctgtcctgtatgaaggttacccacaagttatgcagcagaagagaggagggcaaggtggctcagtgggtaaaggcgcttcttgctagcctgagtttaatcttgagggcctacataagaggagaactgacccttgtaaattgtcctctgacttccacacgtgtgggatggaaaaaagtcacacacacacacacacacacacacacacacacacaataaaaatactcaaagcaaacttcctagtatgtttttatatttatttttttatgtgtatttgtatgtgtgtgtgtgtgtgtgtgtgtgcactcatgcacatctgtgtgtatctgtgtgtgtcatgggcagcaccatacatgcagtgcctacagaagagagcatcaaagcccctgggactggagttacaggtatgagctgcttgctgtgtgttctgggaaccgagcctaggttctctgtgacagcagtaaatgcttagccaccgagccgtctttccagctcccagaatgtcatgatctcaatggaaagtgttctgcactttactccacacccagcaggcttcccttaaacagtgttgttgttgttgtattttccgagttagggtctcactgtatggcactgactaatgtggaacttgctgtatagatctgaactcctagactcacttgtccggaccaccctggtgctgggattaaagccgtgcactgccacagcagacagaatcaaagcctcaggaccaccctcgtacccgcaagtaaagccacatggagtctctgctgacctgacaccttcatcagtgtcccttagtcgtatttctgtagtgaaggcatctgagaaatgtagggtgatctggcttagattgtggactgaaaacttgctgttgctttctttgactttcaggggtgacaggcagttttgtagtcagaaggcagccttctactcaatgaatttgacagcagacccacctcaccgtgactttaaactcattgatcagatcaatccttccgtcttctgcatccatatttcaaactgtaagtatttggattagattttaaaagttactgtgtggaagagcacctcctcactcagctccatttaaagcacccagcttctgtgttgactgtgtgaataattcaaaccccagggctgatttacaggcaactttatagatcctgggcacacacactgtcttcaagaatttgctctgtagctgcctttatcttacacttcaaagatgccttgtagtcagagagatccaagttgtgtgtgtgttttgtgtgcatgtttgtgcatgcacgtttatttcctagtagagtaatggctaaaaatgagtctcatttttaaatgttacctgtggttttccatttcctttttcttttttatttttacttagaagatttgcatgaatacaggatctttatttttaacccgagcagtcagctcaggcgagtgtgttggtcccccatgctcctgagtgcatgctgttctcgggataacaagcccactcatagctctgtcagctaaacctcatcatctcattcccatgtctttccatgtttggcatttgtcccctcatgactgaagacctggggggaatgtgcttatccaaagtgacaagtgacagtgactgtctagccataactgcagccaagtggacatggagcctgcctcctcttcttcctgtcactcacagcacaggaagtgggtgccaagagatgagtggtattttctgacagccacccacggagagtgtcccctagaaggagaagaagcagacttccatccatgtgctagacagacagagcagcctgacccttggcttctgctgtgtcgtctccctgtaggccttcagagcaagtactgccacacagttagatgcagcccagtcgaatgatcctgctcctctgttgaccacacagaccagggtggtctcaaactcatgatgattagggatcctgttcatttaacaagcctcgagaaatcctgggagaggcaaatgtacaagaaaacattttaaaattaaatgtgtgtgcatgtgtgtttgtgtagactagagggtgactgttttagaggctctttcttctgtgtaagtcctagggatcaaactgaagtgaggcctgccgtctagacagcccggaaagactgttttcttctaggggttttattgctattaacagtggtttccaaaggtgtgatgtcacatactctatacattcctgctgatttccaatgctttgtctacagacaagcctgcactgtcttttgctaatccagaagtgcctgatgaaaacaattttgacagactgatgcagacatcaggtggctttacactgagtgccgaatccgctgttccttccacagccgcatcagatggcccacagcccactaaatacgaggtgagccaacaacccgatggcagctgttcatacatcctgaaatactctatccttagaagcgaatttcagtatcaacatataaaggcaaactgcctgcccttgggacatccacgagagcacggagagtggatgctactctctgtcaaagatcatgagaatgcaggcgagcgctcagattctgcactcaggatgtgaagtcacttctgtactgaattttgtctctgtggaattttctgttcttttgaaccctagtgcatgtgtgtagcggactgactgcagccgcctctggcacagggactgggctctctggacgccaggtactcatctcggtcatatttagttttacagacattaggaacctacaggctattttatatcctttcgttagcaagcccgtaaagaatgactcgttaatgttgaatgtggtcagctttagaagctgggcttgctggcgcccaccggtcatctcagccttgggagctggagaggtgggagctcacacataaagtagcgtgacctccatgagaccctgcctcagaacagagcagacggacgtcgggataactgagtgcttaagcccttagccacaggcaccaagacaggagttcaaatctccactgtccatgtaaatgctgatggggttgtgctggcctgcctgtcatttcagcattgaagggtggacatgggattctcaggagcaggctagctacagactcgcttcacctgcaagctcagggcttgattgagagaccctgtttcactgaatatggtgggtgagagattgaagatgatgtctgacatcaacctcaagcccgcgtttgcacatgcatccatgtgtctgtgcaatcacacacaggtgtgtccgtgtgcctagacaggtacatcacacacacacacacacacacacacgcacacacacacagaatagagaaagaacaccttttcagcagcgtcctctgatgaggaaagcaccgtgcgcactagtcgtcagagttggacgtcacaaaggagcctcaggaaaatgcagaggcccctggtggagctcatgcttggtgtgccccagggtgtggctggcatcagtcccaccggctcactgggcccagaggatccacattgcacatggccaggaagagctcggccctgctcatcctggtttgtaagttcatctacaagctgtggagagaactgtggtgctgggggtcacagttagaaacatcatcctaggacactttttttctgtgacagactctgtgtcttcccgtgtcaatatgaagattggttgctgctcctggagcattcgctgcctgccaggcatcatgtcaggctttccagcattcctgcctactgcctgggcaggacgccctgctgcaagagcagtccgtgctcttaactatcaaaacacctgcccctcctgtgccaccatcctgtctttgcagacataagcttccagcttctgttgttgtgaatagagagaccttgtctcaaaaactaagatgaagacaactagatgacctctgacctctgtgggcccttccccattcacaaacacatacaatcttataagattttaatgagtatcacaactaccatgaaaatgaacagtgatttgttcatgtctgtgctcagccatctgattcctgtccacagacacacacacacacacgtgtacacacacattcttctgagcctctattaatttatctgagataggatctcactgtgtaaccctttttcacctagaactaactccctgtgtggacctagctgacctcatctgcctgcctctgcctcccaagtagaggacacagttaaacctgggtaaaggcttgaaccaccacacctatcccaagcaactttaatcccagtattgggaggttgaggcaagaggaccacttaagccctggaggagttcaagactagcttgggcaacaaattaagtcatctcaataaatacataaattttaaggggctagagcagtggttctcaacctttcgaatgctgtgatcctctaatatagttagttcctcatgttgttgtgacccttagccataaaattattttcgttgctacatcataactgtcattttgctactgttatgaattgtaaagcgaatatcatatattcaggacggtcttagatgagccctgtgaaagattgagaactacttactggcttaagcctcttgcagacgctcactgagagtctctctgcatctcagttctgctagactcagagaaactctgcttttattgcttactcttggcagggaggggcctagtgaagctagccagcttcagggacttcctgaggctcttgtgagttgtttaccttcctgcttaaggattgttccttcagggtggaatgttttagtcttggaggaaactgttatgtaacagttttggctgtgtagacctggctagcccaggactatatagataaggctgacctcaaactcacagaggtccatctgcctctgcctcctgagtgctgggattaaaggtgtataatacacaaaatttattttaaaaaggtgtgtgtggatgtgattgacagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatatatgggcactgtgtggcagggactgtgcttagtactgtgtccccaattcccccgctctgtgagcattgccatgtgtctcgcccatgctgaaggagcaccttatctaacctgtgggtgctttgtttgcagtatggagcccctctgcagactgcaggagcatcttcagggtcatttctgaaactgccctcgcctctcacgtcatctctgtgtgcagatcagaaccccgcaggtaagagggagctgctgctcttcctgttggccacttaagcttgccagttaggcaggctcataccctaaacactctccaggtagaacgcctcaaaggtcgccacctgaggaggtcctttctccccaggtcggcgactgcctgcacactgtagtgagcacactggctacccatttcagggactacaagtctccacagcatttgattcagcactcacttgcatgtgctggttgacttctgcatgaggctggttcctggagttaactcacccaggggccagtgacagggctcagcaggtaaaggtgcttgccaccaagcctggcaactgagtttatctctgagactcacgtcatggagggagagaattaatgacctcaggttatcctctgccttccacatctacccacaagtcaaatgtcattttaaaaaaaagtagaattctttgacacagtcccttgaggtcatgctaacatccctgcttcacttgagccgtggaaatggtgaggcttttaatttcttcttgactgttgttttttaggttttgtttttgttttgaatgttttggttgtgagtctggccttcaaggactgagccatcatctgtcaagccacccccccccctttttaagtttttttgagacattgtctcactatataggcttagctagcccagaactcaatacatagaccaggctggcttaaaaagattcacctgcgcctccctcagccatccccatgttagaattaaagtcatgtgccatcatgcctggctcttgtttggtttctgagtcagggtctctccatgtatatctatctgccttctaactcagcctccccagttttgggataccaggcctcatgcctgcttgcataggacttctttttttttttttttttttttttttacaagagcacaaatttacttttacttatttactctccattagtttaaatctgggatgggtacggcatcacacggattctgtgtccaagggccttcgcaggaagttgcttcggaatttggcgtgaatcataccaccgtttccgtgggcccgagttacttttccccagatcactctgggtttgtttggtttgcctccaggagccactatatttttttgtttgtttgtttgtttggttggttttttggtttttggttttttttttttgttttgttttttcgagacagggtttctctgtatagccctggctgtcctggaactcactttgtagaccaggctggcctcgaactcagaaatctgcctcccgcgtgctgggattacaggcatgcaccaccactgcccggccactgtattgtttttgctttatatgcatgaaagcatctcttgcctaagtagataagtagaatcccatttcatctcgggcatcaacgccttcaattttaagaagagctgcgtgctctctttggttccagagacctcgcttgtagccagcaaaaatggccttgcaccacagccttccagacatacttgcttctagaagtactgttcccagcaggcctccacagatgccaagatggcagagaagtgtacgggatgtcttgggctgactcccacagtgagaacactgagagcatggtgctcaagtgcctgggtcaaacccacttcttccaggatagcagagaagccaaccaagggctcgggtgggcctgggctacagaaggccaaagccgtggctctctaaccctcggccacctggaagccactgtaacgagcaactgggtgacaagttcttcctgacctaggaggtcaatgtcagttaaaagcactgaagtctggtgggtgggatgccacaaaccctagctcttgggagatggaggaaggaggactgccaatttgaggccagcctaggctacatggagagaccttgtctcaaaaagcaaacaagccaagctcagaagccatttttccttttcaaattgacaaaactcaaaaagttggaagctgtggagagacatactctcctgcagtagttggtggaacagttggtcacaccctgccaaaggcagtgtaacatatggatcgaaattaccagagctcctgaaggaaggcttggcccacatgcaggagccccatgcagactgtgacagcagcagccaaggctgagacaaaactgctgtggccattagccgggaactggggagtaattatgctgcatccgggagagaacgctaattatcccttcaggattgctggaagggcttcaggatgctgcagtgctcacggggaaacgtgcacaacagggtagtgggtgcgcaccgcatcctcgtccacgggtgaaaatgtctcaaaaaaccaaaaaaaaaccttttccgcatgtgttttttttatttgcatagcatttctcaaggcttcggcaggtggtcacgcttcgccccctgaggcagcgctctgggcggggtgcggagctggaaggagacacttgctgcttttgtgttggagcttattttgctttttcttttttaaaaagaattatttatttattatatgtaagtatactgtaactgtcttcagacccaccagaagagggcattggatcctattacagatgattgagagcttccatgtggttgctgggatttgaactcaggacctctggaagagcagtcagtgctcttaaccgctgagccatctctccagcccttactttgacttttctgcatgactgttttcagttcccattcttgagctgaacatgttctatatattcctcccccacccccaccccctggatgttaccatttccagcgttcctggtgagccaggccttcgaatgcagccgaagggtggacatagaacagtgtgaaggaatggaagccctcagcatggctcattacagcagccctgccattctgagggtaagactcatctggatgcagaactgactgtccctttaagatgtagagtgatctccacttggcctggcctgttgtgttctctggccctgtggtatcggtggctgctcagtgatctttaggaagtttgtgtggagctcggctgtgtctcgtttccattcagttttaaaatttccttcatttgtcttgagagcggctgagcaaggccaggtcttcagtgactgctcacgttggagatcgtccagcgccacgttaacagtccagtcctaccaacaccataaaaagtgggcttccccgtctacctaaagacagaggctatcaggaatggtctaacagcaagctgggtggggtacccaagtcccaaggaaagggccatgttccttagagatggtgatggagctggaacagagtgagcgaggctctgtcctacatgacagggagggagggctgaagagaggaagaggtgactcaaccatgggataatgtccaaggcccctcctggtttctaagttcttattagtgttgtgggagggtgaggcacctgggctgccatattcagagtcctttaccctccttagtccctcctgttttctaagttggtcctccaggcctgagttctagtaagtttgaattctcaaattgtcctcaaatgtgacaaggtgtagctctctcttagtacagacttccccaagcgtgccttttctgtcaggacccctggcctgagagggtatggagccatgagatgggaaggacagccatgtgatgttagcatcaggctgaggctcggcctgggagaccagagtcaggccctggataccttctgtgccaggggatgtgaccctgccgtgaagacaggtgcagcaagggaccaagcagtgactctctccccagtgttagggctgagaggcagtgtgggatagtgacagcagagcaggcaagcctcgggagtgctgctgctgagggaggatgagacaacagagggaagtgtggtggttaccacagagatgcaagagtggtcctgagtgcagaatctgctgtcatggtggtggtgtctcgatggtgagcgtggccttcgctgaagtctgggaaggctgtagagactcatctgcttgttgtgcctaacttaactgtgctttctttctgtctaggtacctaattcaatgacacaggtaaaagcataaagcctgcctgcctgtctgtctgtctgtctgtctctctccgtggtgagtgtgtgtgggtgtgtggtttgttggggatgggctaggaaggatgtgtacacgagtgtacataagtcattggccagaggtcaaacacaggtatcacattcttcgagttatctgattgttttaaggataatttttaccctggcatagaagcacatggctttactcccatcaattggaagtcagaggcaggcagatctctgtgagctcaaggccagggtggtctacatagagagtcccaggccagccagggtaacacagtgagattctgttctcaaaataaaatggaagacgtgtcaggcctttctgtgacacagcctctagaaagtgccttgtttctactgtttcagactggccctgtcctcgtgctgtttagatccagtggcttttttttttttttttttttttttttttttggtttttcgagacagggtttctctgtatagccctggctgtcctggaactcactttgtagaccaggctagcctcgaactcagaaatctgcctgcctctgcctcccgggtgctgggattaaaggcatgcgccaccacgcccagctttccagtggccttttgatgttaacaagagctagttaagtcacagggttccccacttggctcaagctgttgaggttccttggtggcatagagagttgtgcagactagattgccttttcctgtcacccatgtccccatgctgtctccctgagagagtgactgtgacctgggagggcagttgcaggtttgccttggtcataggagcagcgtggaaaggctgcatgtttatttctaaggtgatggcttccacacttgccagcttaaattataaacagttcagcataagttgaagacagcttggtgagcaggtgctttgggcgtcttcccaaatgtcacctggagagtcctcgtcagaagcatcctggcatcctcaggggtccttgttgcttagtcactcttctggagctggtccccatccaggctccctgatatcatttagaaagtttgtctgactttgtccttcctggaccctgctgcctcgccagccactgtgtgtgtgctgcctggaaggcaggctgcatctcctgaggcagtggtttgctctgggaagctgggcttctggctgtgaacctaggactgagtgtgtaggagcatggactctgtcttttggtgttaagcatagtgtgtgtgtgtgtgtgtgtgtgtgtgtgtgtgtgtgtgtgtgtgtgtgtgtgtaaatacctgtcctcttgcaagagtgagtttacagcatgcacagcgtgtggcagtgtgtgtgtcccctgctttgcatttgctgtcactaagtattcattttaggctctgggtactgtcacccgtgctttatgtcacatgcggtagcctcatacccaaggatactctccctctcaggtctccatcaagatccagtctgtaatgtatcggtctctgaatcacacactgacgcagttagaaggccatggtgtcctgcggccatctctggtcagcactgggcaagacagactctgcagcaacgttgttctccaggtaggcatccagtgtgcctctgcagtcctgtccgactgcctgactccagcctgtggggcacagggaacggcacaccgtccagagggcactgtgctccataccatgctgatacccttcttggtctgacctccagttgcttctgctgctctgccctgtcgtcagaggacatgtctttacaggtctccataaacctgacacgttgtaagaatacatcaaaatgttttcgtcagtggctagaaagatggttcagtagagtaagaatgtttgttccacaagcatgaggacctgagttcaaacccccagcacccacgtaaaagccaagcatggctactacccctggctataaccccagcattggggaacagagatcggcagatcccaggagtgcactggtcagccagcctcactgaaatagagagcttgtggttcagtgtgagactgcgtctcaaggcaacaaggcagagagttacagaagaagacacccagtgtcattctctgacctctgtatgtgcacgcatggacacgcatacacactcacgtatatgtagcacacataacaatttattgtcaccactgtttacttgattggactcatttcttctgcagaaatagactgttcctattgtgtttgagccagctgaatctaaaatgtcaaaaacctgagtacacagaggccaaggtgaccactgggatgttaaggggacatgagtaatgtgattagacagcaggcttgggggcgtgacttttctgtggctgcctctttagagttggtaacatggctgctgagccccattccatctcaggtgaagtacagtctgctgtacacagccacaggccagatccacgaagccggcctctccctcgttctggggacactgagcagcgctgtgagtctcctgcagcagaagtttgagattcactttattcaggtgagtctgagagatctgcgtggatggcagatggagaaaagcctggcttttgggggcagcaccgtcagtctagaagcatgacccagctcccaggctgcgctgcaggagctgtggggtttgcctggaagccgggtgctgtcccgtgcctggcaggctcaccgagtgctgtcctcccactctccgggatctatttatacttgagaacagagggagctgttcttccagatgttacagtgagaagcactgggttgcccccgcttgtacctaaatactgtagcccggggcatcaccttgtctttcagcatggcaccaagcctgttcctctcagcggcaaccctggttacagggtgggactcccgctggctgctggctttcagcctcagaaggggtatccttttggaggtccgcagagaaagtcaccttcctgtctgcatgggtgggctgtggtagcctatgggaaagagatacctgactggccactccaggccactggaatgtttaaggagagcctggtgcttggggggaaggtggcagtgcatttaaaaggacagctagatgtagaagggtttgactctttgattcatttgttcacttttggttttgtgtttttgagaaagtctctcttgctatgtactgagctcacaatatagaccagcctggcctcaaactgacacagatccttttgccttgcctcctgagtcaagtaaccaaaggtcacactttgacgttgcttcagatctcaggctggctgtggcctggccttgatttcaggatcctcctgtctcagcctcttgaccacaggcatgtgctgtcatacctggccagctcacatttaaacagagactcttaagcaaacagagtggctttgcagataaattgtctgttttctgcattggtgaggattgaaatcaggtcttgagatactaggagagtgctctgccaccgggctgagccttggcccactccttacacgtcattttgaaacaaggttccttccggcaagttgccttgactggtctcaaactcacttgtagttcaggcggtcagtcctcaaatgtgcaaccctccttagcctttggaggagcttgattatgggcctggccactgcagccggctggaactagtttcgaagatgggccaatcaaggaagagatttactggcatgtttgccccttcctggtaacaggccaggggctgggaagagcttggtctcactgagtacgcatgatgccattttcttcctagacagtctgtctgctctgaactgttgactgtcccttaacagcctgtgaatatctgggattattcagacaacgaacagacaaggccaatttactattcttcgtagcacgagccagcaggattgccttgccagcgaggggcttcgcacccctgtgctatttggctacaatgtgcagtctggctgtcagctcaggtgagtgactgtggcagagagcacacacccttccattttaaccacgtcactagcacaagtgccgcagccttccctctttcctcaccttggggcttgacacatcgtgcttaaggtcaaatagcaactagcatttaagttctgagcaaaagtgtttcctctgaaaatccttctatttctgaatttttaatttttacccacacagcacaacagaacaactgagagaaagctgtgctgtgggaggcaaggtctccctatgtagctcagggcagactcaaactcctggccctcctgcctcagccccctgagttctataatagcatctttggagctttggttctccatatttgttgctgaattcctactctgtacaaatccttctctttttcccttccgttctcacccccatgcccttcccacctctttggagtgactctgttactagtttgattgctagctctgatctcagatcagtgttgcttcctaagagttccaccaaacactgccacaggatgccaggatgcaggagcccaggataatccctggttccctcctgtggaacttggtgttccagcaccctttaggaggacaggatgtgggaaaagcactgtgttgcctggcttctgcccatgccacaatgttcatagagggagaaatggtggatcactggttgggaaactgctttggaccatctccatgaccaggatgccccaaagtcagggccacatcagcacttggaggaaagaaggatagaagtatagaggctggcgagtcttggaggttgtcagcacctccctccttcggcctctctttccttcccaaaggttgacaggcaccatcccttgtgggcttctggcacagaaggtgcaggacctgctgagaggccaggccttccctgactatgtggctgcctttgggaactcccgggcccaggatgtgcaggactgggtgcctgtgcactttgtcacctactcctccaacatgaaggtaaagagtgtgaggggctgctggccacctgctcatgggccaggtgggccacaggtggctggggaggcacgagggagggagggaccagagggagggagagagggagggagagaaggagggaagtggctgcaaccaaactgggcagtttgcccagctccgcttttcctcacagtgcctttgactagtagttttcaaacttctgcagtccctgtgcaatggaaactgaaaggaccagaatcagcctaggaccccaagagcaagttcccaggacaaaggagagcagggaataaaagacaaagacaggagatagagggtgagggagaagggaaggggaacaagggagagggggctgggggcgtgatatttgccctgcagggacaaagaagtgcctctggatagagaggagacagacaaggcccataggcaaatagaaatttctaagggatgaagtgtttcattttaattaggcatgttaattagggcagctggagggtgcttttgattgctggacttcaataccttgatagctggaccttggtggtcagccccaggaggaggaggtggctaaatgagggagcagacctccacggctggctttaaggatgtcatctaatgatctaacaaggtggagggaatggggagaggagtcaggcctgccagagtcatggttgccgtgctcggcctgctagagccctccagaaactatcactggccactcagggttatccagagggtcacttgtttggctgttggctggacacagtggtcactccgtaaaatggaaccatagttgaacatggttgagaaatcccctaacccaaaagagtgacatccaaatctgaaccatgtttaatgccaaccaatggcctcatgttactaccaatggcctcgtgtggtggccactgtcaaaactgtctgtgagaggtggacatgaacagcggattccccggccagcatatatttctcagtcatcatggttgtgcaaatattccaaaaacccaggacatcaggccctccagaccttcctgcagtcctccagtccaggacggtcagctttgatggcagtgatgcagcaagccttcctcgagcattgggtgacaagagggacataggtgtggcctcctgtctccactccttccatttcatgccctctgggctgtaatggcagtccacccccacatgagctctttcaattccaaagttccccaaagagtttcatggacgctggcatcctacaaatagcttcctggtcacacgtgactcctctgcccacctcctccttttgtcttagcagcaacgcgtgggccgtcctcagcggaggtgtgcgctccattctcccctaattgcccagctatttcttgtcacagctgcttcaggcctctcattatctgctttgtatatttataaggagtggctcagtggggagaggagcctcactagatccccattccaaggggtgcttaacccctgtactcagcctccagtgaacctggggtatggctcttagcttcgcggcactgggtaaagacacccgttattagtgccaagggaagccggcccagggcatctgctgttcacacccactgcacctgcagcagctcctagcaacgggatattggcacgccagttgaggaacaaggtttctaaatggcacttgtgagctaaggagtcccgcgactgctttgggcaggctccagtttagcaagtctgctagctttttaagccaggacataatttagaaaaatacatgtggaaattaaaacacccaggcaagtactgtagcttagcaggcccctcatctgccctctgtagcttctgcagttccagttatcagcaagaggaaggtccgggggcccaaagtctattcacctcagtgaagatgatgcactcttactgttgtttaattgtttgagacagggtctctgtgttgtcctggaactcactgtgtagaccaggctagccttgaactcaagtatctgactgcctctgcctcctgagtgctaggaataaaggtgtgcaccaccactgccctgtactgttaccttaggtaacatacagacactgactgtacctctagctgtagaccagcctggcttcaaacccctagtgctggaaggaaaggcatgtgcaacacagctatctttagataaaaataaaatgtgtatgagtgcatgtatgtatgtgcgctttgtggtgcctggttcctacagaggctagaagagggtgtggtgtctcctagaactgcagttacgggtggttggttatagggactgaacccaggtggtcctgtaagagtagccagtgctcttaactgcagagccatctctccaccccaagccgtatcttcactgctagatggcgaaattcgatgaaagaatgcctgtatttcctgtttgcattttaacatgagacacagtccagttcatcttttcactgttaagctcttgtcttccctgctgacccccagccagtggccagaaacatctctgaggtggataaggactggttgaggccctgagggtcccaccactagatagtgggacttcacagctccacagtgactctgactttgggaataggaggggctggtagcacaggatgctgtagtaagtcaggctctgtgaagttgcctgtacctgaacttgtatggcgtgttcaccctagtgctccgaacactctgtaattgggaaacatgttatgattaaaatgctcaacagcagatagtctgacttgtggttgtgtaatattctggtttaatctggtttcctcttgcagggctcttgccagcttccggtggctttggctatagaagtgaaatggactaagtatgggtccctgctgaacccccaggccaggatagtaaatgtcactgcccagctcgtctcagttccagaggtaggcctgctggcgacagtctccacggggtggaatgtggctcacatgtaggccaattcttttttttccccaagacagggtttctctgtgtagccagggtttctctgtgtagctctggatgtcctgaaactcttcgtagaccaggctggcctcaaactcagggatccaccagcctctgctttgtgagtgctgggattaaaagtatgtagcaccaccacacagctataggcctgttcttcacctgggacagcctccagcctcacactaagaaaaataagccacaacaacaacaaaaaggagccgatgaatacagaaagccccatgacagcaagggtggtgggaaaggtttattacttggaatgaaaggttatttctctctagatttcagttcctttacaagggggtattggggctggggtcgtcctcacagctcccacgtgctgctttgcctgctgggtcttctcatggagcccaggctggtctcaaactgaccctcggcctcaggcccctgagcattaacaggcatgtgccatcaatcatgcctaacttaattttgagtcttaaaaaagttcatgataattctttaacttgtacttagaggaaaagcctgacaggttttatttgtgagcactgaactgtggttggaccagctctgctgtaccagcgtggtctgcggcagagcgctcctcagccgccttagtgcctgccttagggcagctggctgtgagcgaggagatggtgagggtgtccactctgtcttttccttgcagcccctcccagggcctgagaggaccgtggtcatttccactgcagtgacatttgtggatgtgtcagcccctgcagaggcaggcttccgagccccacccaccatcaacgccaggctacccttcagcttcttcttcccgtttgtgtgatgagctgaccccgcaggagtacccatcctgaagatcttcccttccgcggcagtgcgcacctgggccctaggcgcaagaggacatgaacctagctgccgcctccccttgctgttacccttcaagcagccctctgctctactccactgccttttaaaactctcagaaactttactctgctgggctgtggtgttgggtcagatgggtccagcaccctgcacatacaggtcaaagggcacggccctctgggagatgagcgggaacagagtgtgacgtggcagtgcatggagagcctcctcgtcagtgcatcatccctggtctagtgggagttgttttcagaatgcctgttggcatttgagaggtacaaaccagcaaggagctatgtaaaactgtgtgcccacaagggggttgtatcccaagattgtgctaattacagggccctcagggcagccttgggaccctgccatgtgctggctgtataactggtgggctggtgtgggctgccaccgaggagagaatgtggtgggtgagccctgggaaggagagggcttattttacacattaattgtacagtaactgaaagagctgctagtgggtacagagccagtttgaagctgatggtacagctggatgctgcagaggagggactgggtaccatgatggctcccctagggaggcagcaggagaagctggggacattctagtagagaaaggttttccagagtgagctggttcggggtgcgggctccagctcctttcaggatgtgcattaagttggctttacaagcccagcctccttgatcatttttgagcgacagtggagtccagcttgagaaaaggttggtgcgatgatccctttgctgcaagcgtagggcgtggacgccaaggagacagcagtaccagtgaagatgtgtccccagcatcccggggtgcaagccaaggcagagatggagactggactttgcaccacaggctggctctctggccacagcccagctactccaggcggagtgtctggaaggctagttcacgtccccgagaagtccattctgtttcaacagcttgttgagccgctcaatttcttgttcctattgtaaaagcagacaaacactgggtggtgaccttctgagctacattcccccaggcccggggctgcagacagctaagtggcattctggctgctgatgggagcgagtggctttcaaaagggccctgggcagcaatagcaggcacaagatgcccagaggagggactggacctggctcttggaggagcccaagttaagctgaaaggaccaagaagagggaactataggcgtggggtcaacatggactggaggggacagcagtgaaaccactcgagtctcaccttctcggagcagctgaattccagatgctggatcttggtggccagttggatatttatctgctttagccttaagatctgccgttctgagcgtgtcttcacggagatgatgatgcctgggtgggagggaggggttagggttcataaagctcaacttttaaacatgtgtgagacaggggtggggagtggatgcgtgtgcaccacagagtgcctgaggatgacacagtacagcatgcaggaagtccatctccttccaccaggcgtgtcctacggcttaatctcaggtcatcaagcctagcagcaagtgtcagccctgagacttgtgttctgattcacacatatacttggagcatgcagagagaactgtcactgggcagactcaacaaggcaggcaagatcgatacttctgagctcaagagtaggccgctaggcagtatctccctgtggcccgcaagggtgccaactctagaggctagctgtgttcctgtccctcaaggacacgtgtccctagcagtaactgaaagttgcttgtcttccctggtcagcgtccagagtgtgaagataaaacagccagaagttaaagcagggacccaccctgtagcacagccttgacctgctgacttgggatatcctgcacaaccccagtgacccacagctcctgacccgatggcagtgctggccctcagatgcagacccagagaggcccaggcgtgcaacagttacctgccccagctgcagggggggtttctagcccctctcagccaaggcacaccctcagggagcccactcactgtggctgcactatgttatgtttaataaatcttttacatctgtctttttggtaagttcatttgaaccatatgtgtcactagcctgtcacctttggctccaccggacacaggaatgttccttgtttgcttcgctcttctccccagagctaaactggcttagtggtggccccctgccatccacagccccagcgggctctgacaaactgagtgggctgtggcgcacgaggcaccagccccctcaggggacacacccaccccaaacaaaggccccactgccaccctctcatcccaggctccctaagcctgtctcagcatctaggccccctgagccctctgcagcagaacggaggggacagctctaggtgactgctgtggtccctgcacaagactgaacagctccaactgccagccgccgcagacccaggcacggggggcagtgctcgtgcctagattcaggcagtgcaggacttcctgggtgtccactctagagatggaagccaagagatgttgatgcttgtctgcagcaggagatcccgggggggtggggggggggggagctgtgctgtgctgcctggtgtgctccatgtgggaaccctggggtagggtagtcagcccagagtgctactcagccgcctgtgtccctcctggaggatggcctccagtgctgctctgggcgcaagtcccctgggcagagtgtgaaatggctttcgagcaaccacagtcagcagctagaggtaacactcgtcaccagatactaccatcctacgtttctcccgatacccaagaggcagcagccacgacacagcccagggatgagagcccaggtatctggtgaccattctgccacctcagtacccaccatggcgcacacccccccacgcagcctgggagcgcaggagacggacgtaccattgatgatccgggccaccctccagagccgaagcaagatcagcagccctagagcttcgaagtggtggcttttaaacaagaggacaaggtcaaggacgaaagacaccaccaccacgaaggcatccaggatctcaaacttgtggtggaagaactctaagcggaagacgaagatcttgaaaaaaatctccaacatgaagaagaccaggatggcaaagctcatgtagtggaacgcctgtggggacagcaagcaaggagcagtgtcacagggtagtctctggttaccaatgaggactccaggctgaggccatgtgtccccatcacagaccacatttccccctttagagagaatcaggccgtgccacacctaaacatctctggccaggcctggctatcatcccagcacttcggaagctgaggcaggaggatcaaattccagacttccctgggctacaggtggcgcacgcctttaatcccaacactcgggaggcagaggcaggtggatttctgagtttgaggccagcctggtctacaaagtgagttccagaacagccagggctacacagagaaaccctgtctcaaaaaacaaaacaaaacaaaaaaagatggcctggggggctggagtaatggctcagtggttaagagcaccgactgctcttccaaaggtcctgagttcaattcccagcaaccacatggtggctcacaaccatctgtaacaatatctgactccatctcctggagtgtctgaagacagctacagtgtaactgatatataataaataaataaatctttaaaaaaaaaaaaagatggcctggagctgcagctcaatcacgtgtgtgcgtgccctgttcgtaccgtgaccgcatagtcttgctcgtccggctcgatgatcttcaaatccaggaggagttcagcaagcacgaggagggcgtccaggaccaccaggcagatgatgatgacctggagggaggagcaagaggctctgagtgcacggcagggcctcctccattctctggaacccctcagtgccctgtggggagctcggggagtctctctcactccctgtcccctagccacccagtctgtttctcttattaccagctctcaaagcaaatgccactctcaaaaggcatatagagttttaagtctccttttctctctctgtggttcatctgcagaacagatgctcaataagatattcaacacaccccagccttgggactctgagtacaagacgacacacatacccctccctgcaaaggctgcctgtcctcagggagtgaggtggcggtgttctcgcccagtgggctaagctcgtcctagggtgtgacacatccaccctgcatagtcaggggaaagggggagaaggcagggttctcctggagagtgggaggaattgggggggggaggttgggggggagttacctgctggaatgggggaagggcaggtgacagactggagtagaggcctgtgcactaatggtggctgcgggtggaggggggtttagttttttttgtgtgtgttcctgtgtcgggtgtggagacaaaagggcatcctcagatgcactgccctaggagcccccaccttgcctttttttatttttttcttgttgagacaggatctcactatttagccctggctggcctggagcttcctacatagaccaggctggccttgaactcgcaaagatctgactgaccgcctctgcctcccaaatggctaggattcaaagtctgcaccacacatggcccgttttgagtctctcacgggcatggggctcaccagactggccagccagggagccctgggagtccttctgtcttccctcaaggctaccacagcgggttcttctgtttttttggttttttgtttttttttttaaaaaagcctgggtttctggcccagaacttgggggtcctcttccttgtagagtaagcactttctgacaaccattttcccagcctggattttgtttttgtttttacttcttggttcttttagagccagaagaaatcagcaaattcatatgataagcgaaagccaaagcatagccatattgtgagcaggctcacagcacagtcaccaagcagcatgaagcatggatctgtgcaccgtgtggatgagctgtgagtgttaacactgagtgcccatgtgagccccaggtacagcgcagcctggggtcccggtggggcaggctggacagggacaagaagactcggaactggctagtgggggccagacagtatcccaggtactgtacgccacagaaatagttactttccaatgattaattttatatcacatgtctgtcacctgaagttaaaagtgagaaagagcaagaaaagacacttggcctctatgaactgaacgcccctccacctggctgctttgtgtggcagggaaggtcacatcccatcctgtggggtgccaactgcagggttccatcagcctgcactgggaccggagcctcagcgggccacacgctggactctgaagcagcaatgggcaagtgagcagagggctcaagctctggcggccccttgatctagatgaaagcgccagacccatctcaagcctgctgtccctagagcctggctcacccacatcttctcttgcttatgccatctcctgtgacaagtgacagcacacaccatcactaggtcctgcagatcctaccagcagacagcaaggatcctgaacccccgctccttcctcccatcccatccggggcttccatccaagatcttcaaccaacctgaccatggcggcccccacacagcccgtccatggcagcccctgccttggtgagcaaccttgctgctttctccacaggaccctggtaccccttctccaccccctacccaggccacagtctctttccataccaggcccttgaccaactcaggcccctgcctgaaacatgcctttctgcccataggacctattatgctcagctttgagcgtcacatgacagtcaccacgactacctccacctccaatttctgcctgcaggggacatctagcaggctaagcggcatttgtctgtcatccacagtaggtggaagactgtcccctcaaacaataaatacctttatgagagtcagacctaagcctggcaggcagagtggtggggatgagtcccttcagaggcagggacatgcagggggcggggggcgctggggctccctttacagctggaaggaagcaggctctctccctctgctctgaaattgcaggtttgggatttcaaccccaacaacataataccacgtttcctgccatagccgcagaggggccggcaagatgcaagggatgctgggttgttggctcactttaagtgagagaaaagacaaacatttttttttctctccctgagaacagtgttcttggtgagaccgaggctgcctcttcctgcttccagaagggacttggactatgataccctgagtggcacccccaaagtgcctccctgagctactggactcaccaggaactgactgcccctatttattctttggtctcttgcattctcctggaggcatccctgcttctagacagctgctcgccacctcagagcagagacagaagcttgcccttgttcgtggggccggagagctggctccgtggttaagaatgttcaccgcagaggacctaggctcagttcctcaaacccccatctggtgacttacaaccacctagatctctagctcctggagatcagacacccctgacctccgagggctccagcatacaaatgatgcatgtatacacatataaaaatctttttgaaaaaaattgcccttcacaatggtagaacagatggcttgcagagttcagctcagcttgtttctctctgcagccaggaagttcccctctctctccccctgtggtagcatctgcagagaggtggtgacagtgagagtcaggtgtgtgtgtgtgtgtgtgtgtgtgtgtatttacatacatgtaaaaatcagagatccacattcgtgtctacagttcccctatccatttcactctttgagactgggtagcattgtgttagactctctcatggaacctgggtctcccccactggccagtgagtcccaaggaacctcttgtctacctcccaatgctgtgattgctggcacgtactgccacatctgacattttccctgggcactggggactcgaattcaggccctcatgcttgtacaacaagtgctcccctctcccaccacccccccatccctgtaaccacctcccaagcctccccagcctccctagcctccccagcctccccagcctccccagccccacagccccacatgctctctgctctgagggccaagcatggtgatgaggttgcaaagcagggaccctcatgcttgtccaggagtaggcactctggaatgaatgcttctctcgtagtactctgagcatacacactggccacaatgaaagtaactagcataaaataaccgttcataggttgccataaagatcctcagcagtgggtccagtcatgaggctgtggagccaccattctctagctctagagtatttccaccaccccaaaggaagtcccatctttctcaagcggccacaccctctctctcctttcctccctcccacagcctcccatctggctccccggctgctggctctgctggaccgttccgctatccagcatcatacacaactgagaccttccctgtctggccggtccctcgggtcatgtgttcaaagttgcagcatgtatctgcatatccttcactgtcatgcccaagtcatatcctctggagggacaggccccagaacggcccctcccccactgttaatacagggtcagaacatgcggagcaatggcacgtgcaaggttctcagaaagcgcctgcggggtacaggggtggcagtggcatagggggctcccaccttagagacctggcgacctctcactctcttacctgaaacctgtgggaactgaagagtttcctcagtcggctcctgaagtccagggactgcctgggcgtggaggcagagccagcctcggcatctgggcccgcagcattgccctcaccctctgctgatgtgggcgctggctcctcctcctcctcctcattctcccacttcttgtagttgacattccacgtgtggtagtcgtccccaaccaccgtaaagtgtttcaagaacctgctcatcctcttggtgggagccaccttggttctgcgagtgacggcctggaggggcgggacagagcgagcacttgaggtccctggcacctgtgatggggagtaggacccaaaccaggccccagggtgctcagagagcagcctagcccaggtcaaaaaggtgggggttttagggagacttatttttggaatgtagtatctcggtgtacaagaggccacaggaaaccccaatcccaccagacatgtccctgcggtctggctggccgtcaccaacggtactacagcccagtctcagcataaggcccacgtgtaaataccagaagagctgtgcactctcagagaaataaaagagctggcgagagcagaggaggaagtgtccaaaagtaaaagtaaatacagtttcatagagaactcagagaagtcgaccctgctctccccagactgtgcctggtcgcacaagcagcaaaaggcaagtttatccagcatggtgccacacacccgccattccagcaaccagcatttaaggggctgaagagttccaggccagccttggctacacagttagaccctactcaccccgcccccccaaagaacaatgtagccggggcagtggtggcacgcgtgtctttaatcccagcacttgggaggcagaggcaggaggatttctgagttcgaggtcagcctggtctacagagtgagttccaggacagccagggctacacagagaaaccctgtctccaaaaaccaaaacaagcaagcaagcaaacaatgaagtaactaaccttatgtgctttggatttcccgtgcaaacagcttttacaacctaagccaacacacagctgtaatcttaaggactcatccatgcccctgacccgcaacaacgcatgtgtgtcctttgctgaaagcaaccttcgaaaatgaatgtccattcatggatacgggttgataaacagtgtcgtctgtgttactgctgctgtctgggccagttggagccagtaacttaatcgttataaactcctggataagctgttaaagtgtcacatctcttccctgtatggtgcttcctgttgctgttcgatgaaagacagaagtcctttgtgggggacaagacacagtcacccagtagatacacatggtcacacaacagacagaatacacaaaagtcacacacggtcacactcagggacagacaaattcacaagacagcctccttcagacagaatagaagatgcaggaagtgtgtagtggaaaattcaaatctggactccaaggttaagtgtttttattatgtcttcccccccgggtgcttttattcctttccttgatgcaacacagatgttatcttggtgacttagagttcatcactaaagtgcataatgcataatccacgcaggaggttctaaatgttctgcctttaaaaccccttcctatcaggcccggctcccacatctccagacccaacatggctccagctgtctccacctgcaatactgcaagtgcctccacccccccccccctttttttttgttttcgagacagggtttctctgtgtagccctggctgtcccggaactcactctgtagaccaggctggcctccaactcagaaatctgcctgcctctgcctcccaagtgctgggattaaaggcttgcgccaccactgcccagctccaccccctttctacaaggaaccataaaggacgtcctaacatcactgagaccatggcaggcctctgcctgaagcttctgccacactcagtccctcttgatagggtacttcctgttattcacgccacaccagctgggaggcttccccaagctcaactcttctaggaggctcggcctcatcccctaatcccacccctgcttctatgtctttagtccatcgtggaaccaggagaggaagagaagcccctccccctagaatccaggatgccacttgcactgacagaatcttgagacatttcaatgcagccgacaaagaaatcacctgcagaaaagctttcctgaagacaccctaatgatgtctaagaatggaaaactgtgtttgagtttcagcatattaatactccttgctcaccctaaaatctgtactgaacctcaaaatcgccttgtgatttctttcctctctcttcttcttcttcttttttttttaatgttgatttattgtcctggctttttcttatgacttcaagggcccagaagacacccagcaggtacagcaacttgcaccacaaggctgatgatctgaggttggaacctcagagctcaaatgtaaaaagccaaacactgcagcacacatctgcagagcaaggggagaggagagaggcagaactgccaagaagggctgcagcctgcaatcctggagtatgcagcccaggaagaaacaagggagagagaccttacctcaaacaaggcggaaggcaagatgatgtctctgtgacctctgcatatacatgctgacacccacacacccacacacacacacacacacacacacacacacacaccatcttacagttccgttcacaaaagggttctttaaggaaataaataaaccagaacctattttaacttaacttacagatcagcctaggccatgatggcgcacgcctttagctccagcattctggagccagaggcaggcagatctctgtgagtgtgaggccagcctggcctgtattgtgagttccaggacagccaagatagagagactttgtctcaaaaaccaaccgaccaaccaaccgaaaaaaaccaaaaaccttgtaagtgacatccttttaggactgtcacttagaaagctggaaaatcttacagatagccactgtagacacctgtgggtgacttattctcttgcgaagcaagtattcatttcttgagattgtctttctcctgtctgtctaaatacttaataaactcactctctttactttgctctggttcattctggaaagtctcctaccacctgaggggaggtggctaggtagggtcgggcagactctctggctgctggggacagtgtcaggctgtgtctccctgtggctgaggacatggggaaagacacagcacttacttgcctgctgattggctgcctgtcccaatggggctctcaggcctgtgagtagtaagacttgtcatcctgtgcagctgatgcaaggtcaggacactgaacagtgccctgcacaggggacactctgcaatgctcccatgcatttgttaagtgactaagtgaacaaagaaatgtggccagagaactcatgtgagagaaggctcagcaatcaagagcacttcctgtccttccagaggccctgagcttagtcctcagcacctacatcaggtggtttacaacggtctattaactccagctcctgacagatctgatgcatcttctggcctctccttgtaaattcacatgcatgcacatacgcaaatctgcaatcagatctttagacatcttttcagtgtggcttgctgggacggcatttacccagtaaacctaagggcctagatttgatgcccagcatgcaagggaaggtaaaagcagaagtggccaggtatcatgatgtacaccttcagtcccagcactcataacggaggcagatggatctcagggagttccagccagggctatagagtgagaccctgtctcaaaggcaaacaaatgaagctagagaaatgactttgtggtcaagagcacaggctgctcttcaaaaggacccaagtccagttcccagcacccacatggcaacacaaccacctataactccagctccaggggatctgataccctcctctggccaccacaggccctccccgcactcaaaaacatggacccacacacagacccacatgtataggcatgtaattaaagtcacccaccgatgtgtgcaaatgcatataattgaaaataaattctttggggctggagagatgactcaagtattccagacactcattgctcttccagaagacctgggtttaattctcaatactcacataatgccttacaactacttataactccagttatgggggtctgagggcccctgcagtctcagtgtgcacaggcaaaacacccaaacacataaagtaaataaaaatttcaaaagatttttaaataaaataaataaatacctcaaaagctctctgtctggccagcacaatggctcagcaggtaaagatacgagccaccaagcctgaactcaactcctagaacccacatgatggagagagctcactcttgtctttgatcaccataggaacagtgccacacacacatacacacacacacacacacacacacacacacagagagagagagagagaagttaatacatgcaattcaaatgtattttaaagctcagtgggaaagaatcggcagaagcacagggactgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagcagctccctcccttcctcacgaaatctcagggcagggaaagtgagacacaaaaaaaatgcactttcactggcccctaaaagtcacagacaggggcagatgatacaatgtaactcaggaaacaaagcaaagcaaaacaaacacctgttagggtcaggtgaggtgtggcaggatatttgatcatactgtgaaccctgagactgtttactgaaacaaacaaacaaacaaacaaacctgtttctagttgtgctgtggctcagaccaagagctttctgtaagcagaattgaataaagtcacccatgggccaagaggcggagctaacaaccagttgacaggaagtaaacagaaggaagagaagagggggcagttttagcaggacaggcagtctattcagggactggttacagagaaaacaagccagatagaaatgaaggcagaaggaaacagagaatgggaatgagtcagaaaattagaacagatcgttaagagttagtttgagaccaagcagagcaattcagtgagaagctgagagaagccagactgatccagtcagcttggagaggagtttgagcctgaatggctgagttgaaccagccagccagagctcagaaagtgcgaggaacggtgagcttattcagaagtcagcctcggaaactgaaaacattctaggcctagataagattgcacagaggcttgaagcttccaggactagggctcagccagcagacagaggcagtgaataaaaactacttttacagcaagaggctgagaagcgtcagagacaactcgaggttgtttgagtctattcccagcagccaaagaaatcttcataacctccaggcttcagaaggaactccggaaaacaaacacacaaacccacatgtgctgtggtgtgtgttccttcatatacgagtaagtaaatgtgaaaaggaagacacacgtggctccattagacaaagaaatctgttgatccctaactaaacagatgacccctattgaacgaaagtcagtgccctgtcaggaaagacaacagcgtgtcctgagcagcataggcaccagactgtccagcatatgacagaaagatgcaggaaaacgtggcccatacctactctggactcaaagtggacattcataatagaactggccaccagatctgctgggaggctgaggcagaaagatggaaaaattaagccagaaagagtggcgcacacctttaatcccagcactcgggaggcagaggcaggcggatctctgaatttgagaacagcctggtctacagagtgagttccaggacagccagggcgccacagagaaactctgtctcttggaaacaaacaaacaaacaaaagaaagaaaaaggagctggaaggagaagggggagtaaaaggagatggaggaggagggaagaaagggagaagaaagaaagaaagaaagaaagaaagaaagaaagaaagaaagaaagaaagagaaagagagagagagaaaggaaggaaggaaggaaggaaggaaggaaggaaggaagaaaggaagaaaggaagaaaggaagaaaggaagaaaggaagaaaggaagaaaggaagaaaggaagagagaaaaagaaaatgtgagaccagcctgggctacatagtgagacactgtctcaaaagagtttaaaaaaaaaaaagtagggggggggctggtgagatggctcagtgggtaagagcacctgactgctcttctgaaggtccagagttcaaatcctagcaaccacatggtggctcacaaccatctgtaatgagatctgactccatcttctggaatgtctgaagacagctgtgtgaagacagtgtacttacatataataaataaataaatcttaaaaaaaaaagtaggaagaaaagaagaaggcagagtgttacaggtcaaaggtcagtggagggcatttgctcagcacaagtgaggcctgccctttagtctccagtactagaaaaatatagttcatagatgtgtgtgtgtgtgtgtgtgtgtgtgtgtgtgtgtgtgtgtgtaggaaaaaaatcagtgtgcaggcttaagagccagtatggttatgattgcttataatatagcatgtgggagctagaagcatgaagatcaggagttcaaggccagccttgactacatagcaagttctaagccagcttgagctatatacaagaccctgtcaaaaaccaaacaaagacagaaacaataagatacacggatacacagaccttagagacagagcaactgaaaacaccagcaggagagctggggagatggctggccacacaagcatgacacctgcgtgtagatgtgcagaagggtcgcaaagcacatctcagtatcacatgcatcatcccagcatccctgcagccaggggagaggggacaaccccttaagctcgtgagccagctagccttgtgcgcacctgctcaggagcaacaagagtccctgtatggaggaaggagaaagaaagggtgtgtctgatctccacaagcccctggaatacacttgatcttagccaaaaggccgagaagcaattgtgcctggaatacaatacaccttcattcaaatagacgcaggcgcgcacgcccccctcccccccacatacaaagatttagatacaaaattaccagttggctggaagtaaacagaacaaacccgagtctcactaacaaaggggcggctatagcaccaagagatgacagggaaatagcggctgaggttggcaagatggcttggtgatctgagagatgacagggagatagcggctgaggttggcaagacggcttggtgatctgatgatccgaatatgacctctggcatccatatggcaggagggaagtgactcttgtaagtcctccacatgcatgctgtggcatacgcacacccagacacatacacagacataaataaataaataaataaataaataaggtatgttttaaagtggctggaaaaaaatagtcacatttgatagactagacaggtagacagaagagatgaactccaagcaggaggaccacgtgagagaacgcttgaagccctatagcacagtggttagggcgcttgccgagcaccggctaggccctgggttccctgctcagcagcacaaggaataaataacctgagcacttgggagcagcctgggggaggggtgtgctttgcctgctgtccactgccctgccctgggtggccttgtctccgtgttccaaattgggtcaagaaacgcctctccagaagacccgacattttttatgtaagtgccaagggggagccctgttgtcacagctgaggtggggctggctgacttggaggatgggggctggggctgtgcaggcatccaaagccctgggctgcccaagtggccccaccacccatagtatctggatacctcaagggctgaaggtttcagatttcttcaaaggctggaagacccaaagaaagcgtaaaactgtgtagcctcctgatagcagctccatcgagagccccagccgcagaggccagccatccctctctccctcaccttccagttcctctcaggtaatgttctagactcaactcttgtcctccgtggcccaggaaggctcctactgaggcccaactttttccattctcaacccaggcctaacgaggtctcacctcgaccctgtcaccgcactcctcagtcccgcaatggctcctttgagatctacaccaagtccaagggaagcatccgagggtgggcaggggaagcacacggtgggcagggccctgggaggctcagcccctcctcttccggcagcccaccccctcatctctgccccctcacctctacccctggagccttccactcaaagcccttcagcctggcagcccctagcctctctcagactcgggttctttcttccccacgcgtgaagactcagatgccagtcacttcctcagagggctccttcctgggaccccgaaccaaagccagattcctctctcagttccacatcctcgcctttcttcctttcctcttcctcagagccctcctcacgttacctaactcttactcctcagtatgtacgcaccccaagaaacgagctgtgtgccctgaattccccatgctcccaggccaaccaggaatttcccccaggaaatacctcaccctgcagacagaagccactgaggctgggggtggggtgggggctcactaccaaaaccacatattaatgcgggagaggcaagttttctctctgaaactctctgaccagtcaagaagtgactcaagtaactgggatggaaagacttgtgggtacctggcagagcagaaaaaggattctggttttaagtcaagactgtcatgccggaagcaggaaagttccagaaaagggttgatcacaagaaaaaaaaaaaaaaaaaaaagccatgtgtctcaattgctccatcattgcagcctctcactgacccagaaagatgggttctgaggaacctgctaagcacctgacccagccccagccaggatcctgtggactttagtggcaactctgtgtcaaccaatgtggaaagtcattttccccctcctcctcctggtcacctgcagttgcagattctgtcacttgggcctatggctgtgctactgtcacctccagactttacagtggagggaccggcacaggcaccctgggtaaagtgcttgctatgcaagtgtagggacatgagttcgagacccagcaacacccacataaaagctggcatggtggctagagagaccgttcagtggttaagtgcaaggcttgcttcttgcagaggacccaggttcaattcccaacccctggaccaggcaactcataattgctgggagctctagctcagggatccaacattctcgtcaacacctgcactcatgtgcatgcaccctcatacatagacagaattgtaaaaataaagataagctgggcgtggtggcgcacgcctttaatcccagcacttgggaggcagaggcaggcagatttctgagttggaggccagcctggtctacagagtgatttccaggacagccagggctacacagagaaaccctgtctcgaaaaaccaaaacaaaacaaaaaaataaataaataaataaataaagataaaacattaaaaacaaaaaaacccaaaaccaggtaaacatggtgtcatgagtttataatcttaaaggatgagttctgggccagtgagagggtctttttcaagaaataaataagtaaagccgggcgtggtggcacactcctttaatcctagcactagagaagcagaggcaggtggatttctgagttcaaggccagcctggtctacaaagtgagttccaggacagccagggctataaagagaaaccctgtctcaaaaaatcgaaaaaaaaaaaaaaagaaaaagaaagaaaagaaaagaaaagaaaagaagtaggagctagagagttggctcagagagttggctcagtagttgagagacctgttgttcttacaaaggacctgggttcattccccagcacccacaaggagtctcatcacatccttaggtaccaggcatgcatgtggtgcacagatatccacgcaggcaggccaggctctcatacacacaaaacaaacaaaaaatggtagatggctccggagaaacagcacaacatccaaggctaacctgtggcctctccctgtacctgtgcaagagcgcatgcatgcaaacacacacacacacacacacacacacacacacacacgcacgcacaaaagctcagaccaccaaattctgatctatcaatcattctgatgactattgaccctctattgtatgacaggcgcccacctctctcctcccctgctcagtttcccacagttggctttcttagctgcccaatcatagcttggcagactggagcctccccacttccggtggtccccacttctggtggtctcagcagcctgctgtgttcaaagtacacaaccctggctgaactgcctccatctcagtagtaggctgtgacccaaactcagctcactttaccaccaaatctgcccctcctggggctcgggggctcagcatcactgccaccgcaacctgagaactgatcatctggctggatcccctccctcccttcctccctgctctgtacatcacctaacaactacctgctcacatgccccttctctggccgttgcctctggcctggacctattccacccctttgtcgttgccagccaggctgagtcctgactttcccactgccccatccatactctcagagaataattgtggcctggctctctgggtctcctctttgtcccgcctgtctttgcccccctcctaggtctctggtgttacaaaagcacacctcactggctcaggtctggggccaattgtacctatctatcatccaggtcttggaccgagatttcccttccccagctgtccctgccatcattagctcccatcacacagtgtcaattcactgtacccctgtactgccggagaggtaaattaaccgcataattgaatcagtgagctgcccctccgagaaaaaggcacgacatgtggcaggtgtgtcacatcagacaaatgactaatctacatatgcctcctgaggctgccagtatccacagggaccaaactgccacctgtaggaggggaaagtctgtaccctgcagagcagcatccaactctacagcaaagagtatgctgtaagaaaggcagccaacttccaagacctagagcctgccccaagtcccttttctttctcagagctactcccagttccttgatctgcttgttattctctatccatgacctgtaactccaacaagacccttcagcagcatcagctaccatcatgcctggttcatctattgtgttatagtacatgctaccttcccttccatggcaagccagcccagcattgagggcctcagtgcagggggaagatagcagagtcaggctcagccccagggctgtgtgactcagtgcacacactggcaggtaagctgccctcgggcacggtctttaccccaattctgtgccccagagccaatgcacttcagcaactaaggacacttggcctttgacctgccacctgtatcttccaacatctgctgtcctggcccagctatgacctctctcccttggagggtgaccctgttcacagctccccgctgccactctgcatccatgtgtaggggtgtgtgtgcacacatgtgtgcatgagaaggccagagtgccattcctcaggagctgtccacaccctccccaaagtggctttctcagtgaactagggagtgcacaggttaggctgcctggatgtgactcccagtgatctgctgtctcctgcttcctctgagccctgagattacggcatgcaggaacatgcccacctttctgtgagggttctgggatggaccgcaggtcctcatgcatacactttaccaacagagccatcctccagacccatacctatcatgcattcattcttgcattcacatgcacgtgtgtatgtggaggcccaactatgatgtcataggatgtggaggttcacatgacatcaggactcatccctcatagcttgcccatcttattcactgaggcaggctctctcagtcaatccccgagctcccaattaactagtcccactcatgagccagcttgctctggggaatccctggctctgcctgctgatactggaattccaccaacatgcccagccctgcacttgtgttgctttctggggattcaaactcaggtcttctcatttacatggcaggagtttcactgctaagacatctcctcagccccagccccagccccatctgcagccagagggctttactggaaacagagcccatctcaacctgtccagaataaaaagagattagagggctagtggctgctctcctcagcctgcctggcctccatttctcagcatctcagaacttggggtccctaagagatgtagtgtgcggcgccaccctcctgctatcccttaggctggtggtgggggtggggagattgggttgtaagtgttccagggggggtccccaagggaccacccctcctcataagatctctgggtagaaccctgctgctggtgcatagctggaatttcagcactcaggaggctgaagcagggggattgaaaaagacaagagtcagtctcataatagtaaaacccttctgggtgtggcctggggtctaactggcttctctagtcctgaacacctcgtgtcctgtcacggatcactgctggaggaaacagtgtgtcccgtgtgacccctgggaggggagtcttgcgtgcggccagcttcctgtggtctcggcccagtgcctcccccttggctggcttaacctgagctacaagtcttcttgtttgcagccttgccaacaaagtgctgaacacaggatgctgtgagggggcccttgcttaaagtctttggtttcccactgctctaagtagtaaagaactagccccgccctctccccccgaggctcacccctcttcttcctgctgcagccgtgactacatgtctggtctcacctgactctccctgcgtggccattctgtttccattcagcctgtgttccaggcctcaagacctttgccccaggagcttgctctggcctggaatgtgtaagcaagctcctttcgaacgctgtcatataccttttctgtcctcttttaggttccccctacatgtctcagatcaggggtgctggctaccctgatcccactatacactcatacacctctccagttgcccacatccctgactgaacaccccagggtgcaggctccacaggctcctgcctacactgtaccttccacacctggccaggaccacgggctccacactcagagacaatgccagcagacacagggacaccattgcctgcccagtgagaggcagggctcagtgcgcccaccacccccgccccagcactggctcggggtttctgaggaatgcctatttataaaatcagggaagtctgtaaataggcgttgaagtctttccttcactagggtggggaggaagtttgaggtttgcaaaaaccacctctgtgccagctgactggctcaggtgtgtgtgtggggggggggggaatgggtgaccaggtctacccagagcaatgatcctcggtgctcctcggtcacttctcctggagggtcaggagtccgatgctaggaggctgcatgggtaatgactttcacaggaatgggatagtggcatatcctccgaaatcctagactatcactccctcgggagctctcccaaaaccacgccaacatccctgctaccggggtccaaactggcctcactgatgatcaaaacccaagaccagagaggtcaagaggcttgccagaagtcatacagctacagagaaacggagcccgactgcaatcccaggtgacccagtggtatgtccctttctcccctgcatgacctgctgagaatgtggcccagggctcctgaaccccgtgctggtgcaggcctgtgacagaggggctccagacagaggaattgtcatgcctcacccctagcacactctgacacattaaccgagacaggatccttcctcctgtctacttctctgttccttttctaaaggaccaatggaggccttgtctaaacaggcatgggaaagcaccctgcccctttcccaacaggacagaattgctgacgttcagggacagggagttagatgcaaagcctgtgacaccagccacaccgcctggtaccacaaattgggctgcttcacaaagccagagaaacagtgagctacccttccaggaagctgtcacccagagaccaacgcgggggtgatgcttcaaccacagagtcctctgaggaaagacttcgggcctctctgttcccttctagaaagctccaaggagtattaacaggatacgtgaagagaaagaagccactctctctggcatctactctgcctccaacaacctgagagaaacacaccagacatagcacactggacatagcaaaggtgacccacagcaacaacgtatgttgccctgaagacacccttgaccatgaatgtcaaggacaagggagcttctccccgagggctggcatatgtgtgaccttgagtctccctgtattagcatctgctcacatccctcagcctaaaaagagcacttccattttttcaatatgcaaggcatcctatgcaggcgtcgtagatagctaagcacatctccctcaagctgaaacctatgccttggggctgtctgtccttctcccatccatttgtctgtctaaataataaattaactactttggtttcagtttggctcatcctgaaactcttctctatggaacagtcaaggctctggcttgccctgagtggagcgtcccaacaggggaaagaaaggaactctcgggcttgtgtccccaccccacccccgcccccaacagcaccgacagtttcaccagagaggccagctgtatattggaaagactgaactcagggcctaatgcacaccagacaaacctccacagatgagccacaccccattatcaccagacacaccacagtcccaaactcaagagcttcggaattcaccagaagtgtgtcgagcctgagaacctccaccaagttcaaggcctccagaggaattctgtgagccgatggggtgccccaccccctcctctacacacctggcttccaagccccgcagatgggccaggagtgtgtgtccatctgtggaatgaggctagcaggtgggccacacctcttgcttgtcctatcatggtgttaccagcctttgagaaatggtagctatccccaggtgccctgctaatgccactaccaggcataatcctcactgcacctctgtaggctgccatttcccagaatggaaaactgagggacagggaaaggaagaaggagaaagggactctaaggaagtcaatgtccaggcaggtggccaaggccgtctctgcagaattagtaactgccaatcagttctgtgcagtgatgcgcgctcacccccgccctgaatatgcttgtgtttttaaaaccaaggagggctgggcggtggtggcacacgcctttaatcccagcacttgggaggcagaggcaggtggatttctgagttagaggccagcctggtttacaaagtgagctccaggacagccagggctatacagagaaaccctgtctcgaaaaaacaaaaaaacaaaaacaaaaacaaaaacaccaggaggacatggctcagcaggtaaaggtgattgccaccaaggccaatgacctgagttcaattcctggcacctgcctggtggaaggagaaaaagatttcccacaagttgtcctctgacctccagaaatgcaccgtggtacaatatacatgagtgtgtgcgtgcacacatgcacacatgcacacacacacatatgtatatataattaaagaaaaatctacgagtgctggacaagttcaaagccataaaagcaaactatttaagcaagcatttcaaagcatggtgcaccaggctaggctcagccattataggcacatgctgtctctgaccaaaaaagggccagtctgccacaaggggcccctgtcaaccatggagacagctcctggtggtggcctcatacccgagttggctccagttccccaaggggtttgtccttgctgggttctccattccaacgtccacttcccctgctggtcccacaccctaacacaggctggggagaatccttcagcaccttataatgcatccctgcaaccagctgacttcattccaatccccagagccacctggactctacctcagctgtgactgcttcctctgggacacacctctgcctaccttggcattcatggtcactagtacaaaaaaaaacaaaaaaacaaaaaacggaagccaaccaaaacaccatactgggccagagttcccagaaccccactatgtcactggcctctcagctcatgtcccccatctccctgtaaccaaaggctgcagacaattctatggccaacttcatcccgctagttgtgggtagcagacccctgccttgctggaggccaagaacctttctggagaacccagcaatcttcccttgcccacccagtctgtaagtacccacaggagcaagtctgagatcacacctttgcacaggtggatatccagaaatctttgcttggcttggcttggcttggcttcactgagccagaacgatgatctcaaactcaatgggtagccgaggacgatcttgaatctcttaatcctgaccccctgctttacctcccaagtgtttgggattaccgatgacccccaccacacccaggtaggctctgaccacgtggttcttaaactagatgtgtcagggtttgtctagcaaaccctggctctcctgaaagaaacacccacaagatcctcctctctcggtgggaacccccagtcactatatacctttgggtcatgggaagtcattttcctgttgtctcaagatccaacagtgagagaactggaggcagacttgtcaccctgctgtctcgagtagacgctccgcaatctgtcctcgaaggtccgtttgagcagtacctgaaaataaggccacaaaatgagttagaagggatggtctgggaagagagccgagagattggcaatactcaggaatgcctgcttgagtgctggattcacttgcgagcatttgtgagaagcatacagtagtcaccgtggccagtgagtggaaacaaccaacatccacagagaaacggatagagtcacactgcagaataccatacagcctttaaacactagcagctgctacagagtggagacgccctgagaacgctctacaacgggaagacagctagattcagcaccttgcatgttgcatgctgagcttggcatgtggtgctgctgtaacccagcactcaggaggctgaggcaggaggctggtgagttcaaagctagcatcggctgcagagtgaggccctgtctcaaaattaaacatgaaatttggagacggcaagatggcttagcaggtaaaagggctgactgagttcaatccctgggaccacatggtggaaggagagagctgacgcccacagattgccctctggtctccacacatgcgccacagtgcacagacagatggacagacagacatacaaataaaaatcttgaaaataaattctaagacaagctataacatgtagctctagctggcgtcaagcttgctgtgtagacctgactggtcttgaactcacagagatccatctgcctctgcctcgctagtatagaattagagatgtacacaaccccctccccaaatttctaaagtgtgtgtgtgcatgtgtatccacacatgtataatatatatgattatatatatatatatatatatggttacatatatattttagaatgtgtgtgtgtgtataggattgtgtaagtgttctcacaggcctgacggaggatcccctgctctggagtccatgtggctgtgagctgatcagtgtgggtgttaggaatcaaactcaggtcttctgcaatcatactatggactctaccactaagccatctttccaggcccctggccctctttttttttttttaaagatttattttatttttttttaattttttattaggtatttagctcatttacatttccaatgctataccaaaagtcccccnnnnnnnnnnnnnnnnnnnnnnnnnnnccactccccctttttggccctggcgttcccctgtactggggcatataaagtttgcgtgtccaatgggcctctctttccagtgatggccgactaggccatcttttgatattatttattatatgtaagtacactgtagctgtcttcagacactccagaagagggagtcagatctcgttacggatggttgtgagccaccatgtgcttgctgggatttgaactcctgaccttcggaagagcagtcgggtgctcttacccactgagccatctctccagcccccctggccctcttttaaaggataactttggtgggtctcttctttctctttggttctggaatgactatgtgtgatttttcaaaattatttttaacatagctgtcagaggcacagagtaaaactttaagcagaaagatgtctgctgggaagtctccatcttccttacgctcccttcccagaagtgtctcctccacacagccttctgtggttttccctcttcacaggacaggcctgcacacacacacacacacacacacacacacacacacacacacagaaggcctccgtgcacatggaaagcctgcatgtactttttcactttttctcctatacaaatgggagtgacacaccatctctcagaaccagcctgatttcctcttggggtggcacagtcacctagaccacccaggccctttccccttgaacccaggagtttgtcacattatgtgtgcacagtgactaaattcaagattgtgtgacaggaggcggcccaggtagacacactggaacccggagggtctgtccgaggagcggaggggcgagagtgaaggggctgcagcaaagagaagcaggcatgaagatgctgggaggctagctcatgctatgtgcacccctaagaactggtaagggtccgcagaccccacccagagcctctggaggaaaggcagctttgagggcctctccatttgcaccattggaagacgcttttaggcatctgtgagatcacagttgggacttttttaaaaccaccaaatgtccctgctataaaccggggacactcgccatccccaagggaccacactgtggcagtgagctctaggtggaggtccttgctgtgatgcccagtactctccctgtggggatgtagtgaggctactggtgagcacaatggggttccccaccccttccaaccccaaaccccactgtgcatgcaccttgaatccggtgcgtttgtacctattcccttatgtgagccagaccaacattggacatctttctccatctctctccgtgtgatttgaggggcgggggtgagacacacattctctgaacctggacctcagcaattctgtgagattggctgtgagaagcctagaggtcctcttctctctgcctcacagaactgggatgccagccgtggggtagcaccaacagttttttatgtgtgtagcctctagcacagacgactgtcaagagtgtcagcaactttggtgacagcttctatacaaacaggagatgggctcagatgcaacccttcacaactgcaggcaaagggccggcaagatggtttagctggtagtggggcttgctgccaagcctgacatcctgagtctgaccccaggacccacattgtggaaggaggaaaatcaaccctggcaagttgtcgtctgatctccataagcacactgtgacacgtacacacacacacacacacacacacactgcagttgaataaacaatctaccaacctacattcaggtaaaagagccttgtgttggggctggagagatggttaagagcactgactgctcttccataggtcctgagttcaaatcccagcaacccacatggtagctcacaaccatccgtaacgaaatctgctgccctcttctggagtgtctgaagacagctacagtgtacttatatatagtaaaaaatatatatattaaaaaaaaaaagagccttgtgtcatcaaagcagaaactaactcctgcacagaaaaacattggaggggctggagagatggctcagtggttaagagcactgactgctcttccagaggtcctgagttcaattcccagcacaaccacatggtggctcacaaccacctgtaaggggatctgatgccctcttctggtgtgtctaaagacaactacagtgtactcacatatataaaataaataaataaaatttaaaaaaaatccagaacttggaaggcagaggcaggtggatttctgagttcgaggccagcctggtctacaaagtgagttccaggacagcctggacaatacagagaaaccctgtctcagaaaaacaaaaacaaaataaaaaaccaaccaaccaaccaaacaaacaaaatccattgacttcaccaactgaagacagagggtttcaactctcaagtcctccctaataaactagcccaaacaaataaaagtggtgaagcccactgcctgggtggccatggagaagcctcacattggctagagagatgcaacctagtcagacatctagtgataggggcttccaaacggctacatcctagacctgaccacttcattccagaaacctttccagagctccctagcaactgcgtgggcagcagtgtgtgtagtacagtggatgctgttgccaaccctctcccccctcccaatacctgaacgggagaagctgaaggccacgaaagcagggaggaaggacatgctagggtctgcgcagtggtggagaaagcagactgttgagcaagcagaactgataagtctgacccaagcctgcgctcatttgcaagcagcagagctagagcctcctgtgcctttcatccgtgctagaccctgcgctggctgggttcagggagaataaaagggaaggggacaggagatgacaaacacctcaaggacagggctgaggccacactcagaacagagcaagatgggaagccaggctcttgcaggttgagtggccaggctctcgtggggacaagtgtcccaggaagaggaaggttctttaacagcaagaacttaagaggacagagtggccgggcgtggtggcgcacgcctttaatcccagcactcaggaggcagaggcaggtggatttctgagttcgaggccagcctggtctacagagtgagttccaggacagccagggctacacagagaaatcctgtctcgaaaaaccaaaaaaaaaaaaaaaaaaaagaagaagaagaagaattctcacgctgggcgtggtggtgcacacctttgatctcagtacttgggaggcacagggaggcaatctctgtgagtttgagaccagcctggtttacagagtgagttccaggacagccaagactacagagataaaacctatctccaaaaacagaaagagaaggacgaggaggaaagaggaggaagaaggagagaaggaagaggaagaagagaagaagaaggaggaggaggagaagaaataataataatagtttggggaggtctagcagggctctcagcttgtgtgaaatgctgtagtgctcagggtcaagtcatagcaggggggctggagagatggctcagaggtctaagagcactgactgctcttccagaggtcctgagttcaattcccagcaaccctacggtggctcacaaccatctgtaatgggatctgatgccctgttctgccatgcaggtatacacagagcactcatatacataaaataaatacatctttaaaaaatgaaaagttatagcagggacatgatggggagggccaaagaggatggaggtctggacttgggtgtagtcatggtgacacagcatccagactggagatctgtgtaggccagaacttgtgactggcctagatggagtgggagttgggaaagaaggatggaggcatgcgctacaggcgggaaagcctggacaagaagtccgggcttcttccttcttgcaaaacatggccacgggaaggttgtgggctgcccagcagctctggaattgggtaagacctagcctagagattttcaaaaccctgccttgaccagccttgctgccaggggagtcttggaggcagaagttgccatcctcaaccacggcctttctcaagaaacctcaagctgctggtgggcagtcaggaaacactgcaaagctcagagcgtccccgccaacctgagatgaaatgcccagtaggcagaaatgccttcagaggggcaaggttgagcagagaggaacgcagctcccaaggatcccgtgctaggtttgggggtgggagtggggattgctaggcttctccccatcacctcagcattcctgggaggtaggtgccattctgaatgccatagggcagagaaggatacagagacacagaggcagtgtcccacctctaaggcatgtagaatcaggtactcgcaggcagtaggtgctgggtaagtggtgggggcttcagaagagcagaaatgcacgctgttgctgttgcttctcggtcttacagtataaaccaggccccaacccacccacccaccattcttgttccttggcactcctgaacccaacagatagggcttcgaatcatttcaagaaggctccactaaattgggtttcttcttgctagggtgcaccagtgtgctgactccttgggggtctgctcttgtggtgctagctgtatctccttccctcctgctgtctccctggggtggctgtagggctctgggatggaaaacagggcttagggcttcacactcacctgctggtagtttgcagcactcctttgcagtggctggctggctctctccacctgtgtgagggggacagggttacttctccacaagtcacaagatgctgggtgtggcagagtcatggctgtggatccaggttaacacccaccaggagaggatgcgcctgtcaatgctcaattccccggggaggagagcggggtgggcagtcacagttcaagaagcagccagggccttggtcaccccacggtgccccctggcctagtcctccactccccgccagccaaaatggacaaaagagcagcagggaatcacgaggatggagggtggccagggcttccttcctccctcccgggccccgcggctggcgggtgtgcagagcagggagaagatcgcagctgccctcagctcgagatacaactaaggttggaaggaagaggggggcgccctgacctccccaccccaagcctcatcctcgttacctggcagcagtctgcttagctctgttctcatcccagggtagagactcaggcacaccccagctctgaagagcccagggggagggcccttgcctttgggggtgtggtgtggcgggagtttccagagctgctcgaacttattgctgctgcaaactcaaaggcctacggaggcactagtgtgctgagaggcactaacttgaagcggctatcaaatgacaaagaccccgggagtatgcacagggctggaactctcttccggctaatcccaccccacccccactcaaacgcctcatccaaggacctcctcctccctctctcttccaaagctcctgtgtttactggaggagatgaactccctagctgaattcagggggccaactgatgcaagagcaggttaaagagaaactttttacctgctaatggagacagtcccaagaaagtaagggcaaaagaaatgtatcataagctggtgggggaatgactgaacccactctctctgggctgggaaggaaaattcaggagagtcactaagagacagtgtgtgtgtgtgtgtgtgtgtgtgtgtgtgtgtgtgtgtgtgggaggggaaggagtgggcttcctagcacacctattcagacccactgcagcccaaaagccccgggtccgtgtaatggaacccaaactttagcttcttcagaaccccagcccttcatggctgctgtgtgtgaaactctaaaagccagtttccttagagttcagtgacttcagcttcaattctggcctaattcagccggttatccgcaacacttgtttccttgtaaccacctgcaggtgtgggctagcctcccttccagatgcttagtgcacagcccccttcgagcttaaggctgcatctccacgggtgctgcaatactgtgtggcactgcacaggaacattatctgcctcccattggtctctgatccactggcttctaccagctcccctgtcctccatgctggtggcaagctaggttggatggtggcaggactcctcagaaatgttgtgatataacagcctcctgaaagttcctaaggtatggcctgctccatcctgaacttcagccttcttgtgtttcatccaaaacttatctctcagggctggagagatgcctcaacgatttgagcacttgttgctctgcccgaagagccaagtttggttcccagcacccacatggtggctgacaaccaggcatctgatggcctcttctggcctccacagacagttgcatgcatgcagtgcacaggcacacggaaaaaaatcaaaactctcctacttcggggtcagctagacagggtgagacagttcctcctcatgtctgtagggtgaggaaggccagggagaaggaacaggagtccctccatctaatgaaccacctcaaagctgtgggctgacatcagcaatacatcctgccatgagttacaaacagtataagacaagatatggcttcagctaccaagacccaagctctggactctctggctgactccctgttgtgtgtacctgtcccttttagctttcaacttgacacagcctagaatcacttgggaagagggtctcaatgaaggaccggctacattgggttgacctgtggggattgtcttaagacccagctcactgtgggcggcatcattccctaggcaggcctcctgcagctatgtgagagaggaaaaagttagctaagcgatgaaacaaacaggactcatgagttattctctctctgctcctgactgtggacatgaggctgccttggtgtcctcattataacaatggactgtgactagaactgtgagctttttgtcagggtatttgtgactgaaacaaagatgaacctaggacaccatataaattagtgactgagtgttgaaagcctgtgaccactgctgctttaaacactgtataagatcctggctgaatcagtaaggcgagaaacaaggaagtttgaagattgcaaagctatcgtctgaagtcattgtgaatccagacctggggaatcccacagagacagcggacagagcgacttctgtccccatagaactcccactctggttgggtggaggggtgaggccactgattggtaagacagaacagcccaaagaacaaataatttcaggaccgcatttcaaggtaaccttgtatacactgagagaaaaacattgctctgaaaagaagccccagtttgcagagacgcttcagagttgtgtggttggatatttgctggtttgttctcaagcatgaaggaagtccctttcccccctcaacccacccccaccacgtccttcacatttctgttgtgtgaggatccatcactgtccaggtatggtggtcctgccctcctgatgctcacagaacagatcaagtaagatctaagcccagggcctggaggctatttctgcttgagctttcttccctcctccaccagcagggagagaaggccaccttcaaaggctctggtgtctccagtatctcgtggttgcagccgaccacttcccttcccagagcacccaggagtgcgtgagaagagggaaaggaagcaagaagggggtgaggtttcagccagggatgggtttggagttcccagagtcacatcagttacctggacctacctccatgtgattcactaccatctgtgacagcccctgagtgtatgtatgtaggtaggtagttgaccatgtctgaatgaggcttggggacctgtgtgatgctgcagtgtggctaggacttggaatggaactcagaggtagagcacttacctagcatgtgaggacctgggttcgattcctggcatcggcgacacttgggctgatgacgtccaaccccgtgccctgaggctgacttctgcttggttgctcagaatgatctggaaagatggaaagacagcagttgccatcaaagaggcctggagttcaatccttcctccatcctgcccgtgccagctgggtgatcttatattcattcaacaaattatctctgagtgttgtctaagtgcgggcactaaaccagcagaggctggtgggtaccacggacccgcatcaagactgctctgtgaaaggacataaaaggaccaaatgacagagcaaatgcattatacaaggtaggacaaggggaggtcgtggctgagcctaacaggtggggatggaggaagtacagactgtgttgtatggctgtgttacctgtcaatcaaaaagcctatggcccatggcttaggcaggaaatagaaggtgggacatccgggaggaggaagaattttgggagagagccaggcaaggaagccacctgggaagacgtgacaaggcagatgcatagaacctgaacacaggcaaccagccacaaggaagaatgcaagtttaaataaacgggatatctttttttttttttttttttttttttttttttggttttttgagacagggtttttctgtatagccctggctgtcctggctgtcctggaactcactttgtagaccaggctggccttgaactcagaaatccgcctgcctctgcctcccgaatgctgggattaaaggcatgcgccactacgcccggcttaaatgggatatcttaagttatgatttcagtcagagaagagcctagctgtatggccaaggtatttatttataagtatattttgagtcagagccttatttctgggaatatggagctaggaggaagaaccggccaccatgtcacaggaggtgaggaccattgagaagagatcaggggagggttctcagggaggtgacatttaaaggctaccagaacatggggtggagcccattttgagatgagggataacttttgcagcagagggaaccaaccgcatctgcagggtctgaggtgggtaaaggcaatgctaaggccaatggagactgagggttgccaatgcaccaagaagccatgggcctctgaggtagggaggggcataggttgactgtgatgtgtgtgttaaaacatacagaccgttgtccaggtatggtggggcgtgcttgtgatctgaggagtaaagacacttgtgtaggggcatactaagttcatggctgccgtagtgagttctgggcgagcaagaattcaagctgagaccctgaagaaagaaagaaagaaagaaagaaagaaagaaagaaagaaagaaagaaagaaagaaagaaagaaagaaagaaaagaaaagaaagcgaactgcttgacctttcatatccagcactcgctcgctcgctctcactctctctctctctttttctctctttctttctctcagtttcaggccagcccagtgtacctagtgagatcatttctcaaatacaaaaatctatagttagagcggggaggcatgaatgttaacattcaaaccacaataaaatgtatagttggggtggcaggtgagagggctcagtgggtaaaggggcttgctctgccaagcctgacaacctgagttcaaaccccagaatgcacagggtggacagacacatccaactcctacaagttaccctctaacttccacacacatgctaaggcacatacacacctaccacacatgtacacaaataattacatatgcaaattttaaatgatatgttttggtttggtttggtttggtttggtttggtttagtttggtttttcgagacagggtttctctgtgtagccctggctgtcttagaactcactctgtagaccaggctggcctcaaactcagaaatccactgcctctgcctcccaagtgctgggattaaaggtgtgcaccaccactgccccgccaaattttaaattataaacaaaacaacgaatcctggatctgcttgctgggttgggggtggggtaggtggttaactgggagggggaatcccaagcgcaggtcagttggtgatgagctatggggagacaggaaggaacaggggtgtggagagagcagctgggtgacaactgggggctgggtatggagggtactgcgcagcaatgttaccccgaccatggggagtcaggagggtcggtgtgcagtcatgtgacctaaacactcaatggcaggtgtcaaacaggtagtgtgtgcctgtgtgtgtgtgtgtgtgtgtgtgtgtgtgtgtgtgtgtgtgtgaagtggagcccagaggtccaccttgggtgttcctcaggagtcgtccacattgtcttttaccaaagggtctttcacgggcctggagccccccaatgaggcaaggcaggctggctaatgaggcccccgggatctgcctgtatctgcttccccagcgcagagatcacaaacatgtactaccatgcctggattcttttatatctgctggggattgaactcaggtcctcatgtcttcctggcagggctgggccaagggcccatgcagaggcagagacccaaggttcactggggcatgccaccatgtccctccctggtcactctgtttcaggccaaagtgggctacccttgctctatggcaggctatccttctgcctctgtgagtgacctgttcctgtttccaggacctgggggctgagagtggctcattcactcctctgcaaggcctggcagttgcctccctgtggccagctgaggcttgcccaatccagtcacactttgaggcctgtgtgggctgtggctctgctcagtccccctttcctgtctctttggtgaaacattcacatccatgctgagtctcgtttagtgaaactgctcgagatatagagtaagcttggggccagcctgggctacaacaacaacaacaaaatggtctggctgtcctcccttccagctaagatagaacaggactggtgacactgctgggcggttgagagctctgcagttagttgcctgaggaggcacctccaggtctgggctagcctccagcccttctcctccctcaggacccttaatgtcttctataatcctgtctccccacttgcctgccgagttggcctgagtggcccagagtggcgtgagggtccagtggtggtagcatgtaggaagcagaacccactctaaaacttgggaatcttgtccccgcaggtcccctctgcttctgtgcctcccttcctcgggcctcaacacagtgccaaggtgcactggttaaataaatctcagtgttccacagtgacgagttcacactagggccaggtgtggtggcgcacgactttaatcccagcacttgggaggcagaggcaggtggatttctgagttcgaggtcagcctggtctacagagtgagttccaggacagccagggctatacagagaaatcctgtcccgaaaaacaaacaaacaaacaaaaaaactagttcacactagagacacgggtgtcctgaccagcaagagatgggcgaagcatttttttccccagagttaacactgcttaagacccctcacggacccaccttgagtcctctctttgctgagccagcagctctgaggcatctctccctgtggagctggcccctctcaagaagaaacacccctacctcttccatagttcaaggtcttacccacccactcaccttcctctgcctggcccagagctgcagtgtcaaccgtccagagggaggcaatgctccaacgttgagtgcctactgtgtgctaggcaaagcagatcttcttttattttttatttccaagtccagactctgctttcctactccagtaaagagaccaaagtgtctcttgagcctagggacatgacatacatacactgggacgggtttaaggtaccagtccggtggtgaggggagcctcagaagccagctaaaagccctagggcttgtccctcaaaggacataaccctggctgtccctcacttgtctcttgggctccggccaatgatgtcatttctgaactacacagtgcaagctgtatggcccatgtatgcctgctgtaggttgccattaccctgaagatgcccaaggtggggtaggggagggcatgtgataacctcctctcaggacctgttctgcctactgagggctgggtgtctggggcagctctcctggaggacagctgcctgaggaggggtgcccaaaggacaaacacttcacctttgacagcagttcttaaccattctgtgagaggctatatgtagaatacaaagaaattgggttgtgttgtaaactcaaaaacaaaacttgagggggctggcaagatggctcagcaggtaagagcactgactgctcttccaaaggtcctgagttcaaattccagcaaccatatggtggtccacaaccacccgtaatgagatctgacatcctcagatgtcatatacagtatacttatgtataataataaagctttgggtctgagtgagcagggttgactggagtgagcagaggtcctaaaaattcaattcccaacaaccacatgaaggttcacaaccatctgtactacagtactcatatacataaataaaataaataaatctttaaaaaaaaaaaaaaaagcttgatttcagctgacctgtgtaccaagggaatgtggtgtttactacggccctggacaggactcagatgtagtgtgatcagagtcccaccatttctgttctgtgttctgtaattttccttaggttgagattgtctctgtcaatcactacgatgtcagacttgacacgcttatacaaaccacacctagaaagaggcctatgtttccactcctcgcctatctcaggatgatccagacaccctctgggttgcctttccaccctgtggcagggcagtaacactggccatgtgacttgggctcacttgtaagcgagtctgtgccaacaagtctcgggactgatcctagtctctggttgtgtacacagggagaccaccaggtacaagccaggaggccagcgtctcgacctccagcctgggcatctttgtgagaacacagactacctcagcagcccaggggaaatggggacgtggcctgactgaccttgggggacaattctcatgttacatgggccaagtctgcaagaagatcctacccagctcacctcttgggaggttggtggttttccaaagaaaatctctggtttcaatcaaagtgaaaagccaggtgtggtggtgaacacctttaatccctgcacttgggaggcagaggcaggcagatctcttgtgagtttgaggccagcctggtctacatggtgatttccagaacagccagagctacatactgagacccagtcttagaaacaaacaagaaagaacctccaagctcatgagtgtagaagactgtgggcactaagggggggggggtgtgggaaggagggggagggaaagagcccttgtccagccagagttacttctgtgctctgggcaagcagattcgggagggctgccagacgctttccacttggccccaggtgggcatctaagccactgaccccagttggcagtgggggggggtggacaagggacagccccaactgggggccccagggtgacacccttggcctccggggttataggagagaggttcctacacaggcgagagttctgagtctgggccttgactggagcacaggaaggccttccgaagggagattagaaagggctcattagaggaaagcctatcccatcgtccaagcgcagcaggccttgatgaacagagacagtctatgattttagcgctttattatagaaaggcagggggtaagagagaaagtgaagagaaagagagagagagagagatcggccatggccaagaggagggaagggggagagagagagaaagaggaaaggctagaaagtaagaagttagagagagagggaggagagagagtaagagtgagaggagaggatgaggagaggagagagtgaggtggggccaagcagccctttttatggtggcctgttatctttactgttgctaggtaactgggaggagtctagcctgaaggtcaaaagcttgggactttgtctatgtgactactagccatgcttctcctgtaggggctgtgggggcagtaacttcgacaggagccagagttccaagagacatgagggaacgcctactgtcccatgtaggtgaattatcaccaccaggtcccggggttcaacatcctgcctcaactggaaaccaggctgtgtatagcccaatgcctcacagcagactctgctttgcaacttgagtggccacagaggccacagaaggacctcagaataagccctgtgttcagaccttgctcacacatctggacacatctgcatcagcacacacagaagcaatcctgaagccttggcctgtaggcggtcctctcttcaagctataaggcagtctcctcagtctacctttgcttcagtgaccagggagaccaggagtgctcaagatggagtagggtaggttactccatcagactaacacaaacacatacgtgtccccttctgaccagcagggtctcctccatgagctcagaaatcacagggccctggcaagccccatgcaatgctcacttttggtacccacacgggagcagacaggaagctgccccgtgcccaccaggggaaactggctgactagaatgccacattattgcctgagtgaccactgggttggacaaggcacagggaggaccaagcctgctgtgaagtggcctcccctgacactaaggtgtgactccatggaacctgtgtgtttgtttagcatgcccaaggttctattctgtcctgagcactgtccccctataaacatgccaatgaagggagtaaagagtgcattggtgacttcatctgaaagacccccgacgtgggtagtcaatcaatctgaggagaccctctcaaggaccagcgagaccacgattcggatgcaaacagcaagaggctttattgggaacacgggtacccgggcgacgcagtctatcggaggactggcgcgccgagtgtggagtttttaccctttttatagggctagggctggggagcaaaaagcgcggttacagaagcgagaagcgagctggttggttagttcgaataaggcttggggtatttctcggtcatttggggaaactgaggtgggactttttagatctaaacaatgtcttttttcaagaaatgggtaggggaggggtacaaggaaagagtctaatgaaggttcagcaatgggcacatatctggtcagaacattggcagacacacaggttcaaggagtgaccagagcactgtgcacctctatttttctaaatcagtgaagctagttctgctaacactgacgtctatcggggcttctgtgtctgttgctggttccgctttatctgagaaccatctgttcttggccctgagccggggcccaggtgcttgaccaccgatatcctgttcggcccctgtcccagtgctattcagccttgatctttaactgttaatctttaactgaactttcttgtaacttttgagaactcagctctggtactttttcatgccttgcaaaatggcgttactgcagctagcttgctaagcctgatgggtgggggtctttcacatctccagggtggactggggaccttagggaagcttggctctaaattcctgtttccgggaactggaaagatggctcagtccctggaatccgtggaaagtgggaaaaggattgacctcctgtgtgtgtctgtagttctttctaaggaggggctgaagagatggctcagtagttagagccctgccagagggcatagctaaagttcccagcatacattgggaggcttacaccccacttccaggtgttctgacgccctcttctggtatctgtgtgcactcataagtttaaaaagtcactttggtagtcaaacagctgagccacaggtggcctctgacctctggtcccgaggtacagatgcctaggctacttttcagggacttgaagctgctttccgtcagaatgtcttttttttttttttttttttttttttttttttttttctcgagacagggtttctctgtatagccctggctgtcctggaactcactctgtagaccaggctggcctcgaactcagaaatctgcctgcctctgcctcccaagtgctgggattaaaggtgtgtgtcaccactgccccgcttccgtcagaatatgtcttaaatggggttactattgctgggataaaatactgtgatcagagcaactccaggaagaaaggatctacttgacttacacttccacggcactgttcatcgtcaaggaactcaagccggtgaggaacctggagacaggagctgatgcaaggctgtggagggatgctacttactggcttccttcccttggctagctcagcctgctctcttatagtagcgaggaccaccagtgcaccggtgcccatcaatcattagttaataaaatgccctacgggcttgcctactgcttgatctctctttgccagtgactctagcttgtgtcaagtaaacatatactagccagcacagacctgtggacgcttgggctgagcaggtttctgatgtgaacttttgccctcgggaaccaaataaggttccaagttctgagcaagccaatcgtccctgaatgttcctccttggaggacctgagaagacttacaacacctgatgatgtcatctccacccaggccggaatcacctgcttcccctccccccagtctccacagcagggcaatttgacgacttggctctcccatttccctgcaactggaccatttgcatataaatggttactttcatgcaaaactggctcttttaggacagagtatcgtgataaaagccttaaatctcaacattctggagctagacgcaggtggattgctttgagttggaggctagcctggtctacatagtgaagctcagttgcaaaaaaaaaaaaaaaaattggtccttttgcttattggcatttggtttcagtgtgcacactggacacacacacacagaaggtagataaggcactagatgggacttctccgaatgggccctgctttgttattgttaattttgacttttttaaaaagtacattaatttgaagctggagagatggctcagaggttaagagcactacctgctctttgcagaggacccaggttcattctccggcacccactggcagctcacaaccacttgcaactccagttccagtggatcgaatgccctcctctggcctccttgagcgtcaagcacacacagtggtgtacagacatgcagacaggcaaaagacccagccatataaagtagaaagactaagtaaatcttgaaaaagaagaggaaaggtgggactggagagatggctcagcagttaggagtaccaactgctctatcagaggtcctgagtttaattcccagcaagcaaccacatgatggctcacaaccatctgtaatgggatctgatgcccttttctggtgtgtgtctgaagggagcaatgttggtgtgttcatgtatataataaataaatctttttaaaaaaagaagaagaagaggaaagctgaacattttaaaagtgtaacttcattttatgcaatgaatccggggacatggaccttaggcactcaaagcatcatggaactgagcacaggttcaactgagaaccagccatgacgtttatttccaatctccttatagccaacagctgacaggcgatcaacagaggatgctgaagcaaaaagggggcacagcggaagctgagcatggagatctgacctcttgctgatcccagctaatctggcctgacccttgtctttcaaaccaagcaaaggaagcaagtgaccttttagcactgtttgtcaccaagaggatcctggagcagctgcctcacccccacccccgacccccacccccgcctccagcctgaccagtgtctcatgtgtcagaaactggatgtggaagccaggcaaggtggcacacgcctttaatcccagcactcgggaggcagaggcaggcagatttctgagttcgaggccagcctggtctacagagtgagttccaggacaaccagggctacacagagaaaccctgtctcaaaaaacaaaaacaaaacaaaacaaaaaaaaaaaaaaagaagaaaagaaaagaaactggatgtggacaagaaaatcagccacaaagaaagacttgaggaaataaggttctcaggatctgtggggccttggatctcctcctgacaaagcaatcaaggccaaagatgcaccacctggccggccagactgctgggccgacacctggctgctgtctgaaatgccaccaccgttctgtttgcaccggaccctcctacctcctcggatgacctctttcctgccttggctcaagacctgtgtcttgaacctgtgtggtgagagcctggtcttggctgaattaactagccctactagggaagactgcccagttgctagagtaaagtagcaatcaatatgcacagtgtgaaatgagccggtgatttaatagtcaatagaggataatacacttgcatcgagattataaatgagcaggatgacttagttgcttgatgtcaagattaaagatctgagttcgacccccaggcccgccccacatggtggaaggagagaagtgattcctccaagtgataccctgacccccgcaatgtgctgtggatgtgcctcctcccataaatagataaaggtaagaaataaacgttttacatgtctaagtgtgtaaaaaataagggggtaaaaaaggatcaatatttctccttataaatacaccgaaatggcaagctgtcatggggaggaaggtccaggcttcaagatcttttattgtcgtgtcccccttatactttcagggaaaaaaaaaataatgatgtcaggaatattatctactacaggaaaataattaaaaataattaaaaagctagagcaggaccagaaagggagcagtgagcagaatgtaaagtgaataagtaaaataacaataacaacaataataataatatacaaaactaaaaaagccagaacagtttctccaggggcagaggggaggacagtggctacttaaatgaacagctgctgcagctggcaggtccccaggcttggtttcaggccacttcccctgtgactccgtctggcagtttcaggctgtgccctccagtttggctcccgtgcatcctggagataggaggtggggctggggtctattgatttttgaatcccaggaaaacctcttcagttctgtttgtactatgtccatctcgagagaactggaccagccctttcccctattgtccttcaggatccacactttatttccaagacagggtttctctgtgtagttttggctgtcctggaactaactctgtagaccaggctggccttgaactcagaaatcccattgtctctccctcccaagtgctgggattaaaggtgtgcatcaccactgtccggcttgatattacattctttatgaatccttttattgattgcccagaaatttttaaaggtttaattcttgtgtgtgtgtgtgtgtgtgtgtgtgtgtgtgtgtgtgtgtgtatgtgtgcatgcgcacacataccacaaaatgcttttggaggtcaggggacaacttgaagtctgttctctccttctgctatgtaggtcccagagatcaaactcaggtcatcagacttggcagcaagcaccttcacctgctgagccctttcgctggctctctttttcaccatatccccaactgtcttccagggctgcatctgaccacaccagggagatgcgtacagcattcagcaatgtcatatggggcttgcaaacactgcatcttcccagtaaataccaaaccttcagtcacttctggactctctccccctaataccatagaagagtctgaagctgaagattccagagcctccaatttgttttggtttttttggttttttgagacagggtttctctgtatagccctggctgtcctggaactcactctgtagaccaggctggcctctaactcagaaatctgcctgcctctgcctcccgagtgctgggattaaaggtgtgcgccaccacgcccggctccaatttgttttgaaattaacctataaatctattactccagctgtgtctggggtatttatttacttatttatttatagtatggctttggggtggctggagagatggttcagtggctaagagcactggccactcatacagggcacccaggatggattcccagcatccacatggcagctcacagctgtcggtaacttcagttccagggttacagttcagttctaggtgtcctcttccggcctccataggtaccgcacacccgcggcacacagacacacaggcagacaacacacacacacaggaagtaaaaccaagtatttaaaaacacagactttgagctggggtgtggtgacgcatgcctttagtcccagcacccaggaggcagaggcaggaggatttctgagttcgaggccagcctagtctacagagtgagttccaggacagccagagctacacagaaaaaccctgtctcataaaacataaacataaaccaaaccaaaacaaccaacatatgacctctgaggactggtactggggatggaactaacgcctccagccttctttttgcttcttggacagggtcatactacgttcctcaggctggctttgaacttgtgaatcctcctgcctttacctcacaacagtctggatgacaggcctggctagaaacaggtacttcagagtttgcattgttttaattaggagggctctggtcactctgatggccctgaagcctctggtgtttgtcatccatccttttctttcaatggagcgcgtgtgaagttgccacgcactggtcctttgaagccctgtttgatgtgggagatgcttttctggggctattcttcactgctccattctcttccttggagagtatcttatgcatttggatcccattcaaggaagggaggcttctgtagtgaagagagtaagcctttccagggcctgagctgaggatgctgaggatgcctctcagccgggagagcgcttgccttacgcgcgtctggggtcctgggtttgattcccagggccacataaactaggaatgctggttcacccctgtcatgtcagcatccaggaggtggggtggggggatcagaagttcaaggatggactagtgtgttgactaagtaggtaaaggtgcttgcctggtgacctgagtttgatccccaggaacctatgtgaagaagagaactgacctgactttggaaagttatcctctgacctccacatgcgtgttgtggcacacacatggccatggccacacgcatacacacacacacacacacatcttaacatttggcttttttgagacaaggtttctctgtgtagccctggctatcctggaactcactctgtagaccagactagacttgaactcaagagatctgcctgcctcagtctcccaagcactgggaataaaggggtgcgccaccacacctgcctgacattctcttgactaatgatcgatgagggtggtgcccaggtgggtggtcctgggtggtgttagaaagcaggctgagtaagccgtaaggaacaaaccagtaggcagtgttcttctatggcctctgctccagttcctgcctccaggttcctgccttgatttcctcactcctggtgtatgacatggacatgtacgctgattaaccctttcttccccaagccaggatgttttatcaccacaacagaaagcaagccaggacacaagggcagacaagacagctcagtgggtaaaggtgcttgctgccaagattgacaacccgagtttcatccccaggacccacatagtggaaagagaaaatcaactttgtcaggctgtcttctgaccccctccccaaactcaccccctgtcccctgccacactaagtaaatgaatataggggctggagagatggctcagcagttaagaacatgcattggttgttcttatgagggacgcaggttcaactccatcacccataacttaacaactgagccatctcctcagcctctaattaaaaaaaaccaactagattaaatacatgtaaatattcctagacttacattgtaagttaaatggtagatgggaaatctctgccttcctcctagttttgctgtgagcctaaaacccacctaaaactaacaaccaaactgcaccaagatgtagtggtgggtgcttgtaattccagtgtcagggaagcagagcagagtggaattcctgggcctcactggtaaaccagcccagcctaacatctggcctcagaaggagggggaaagggaggggggaagggagggagggagagaggaagggagggaaggagagagagagagagagaccctgcctccaaaacctccaaaaaaaaaaaaaaaaaaaaaaaggtagagaatgatatacaaccttggggctggagagatgttaagagcacccgactgctcttccgaaggtcctaagttcaaatcccagcaaccacatggtggctcacaaccacgtgtaatgagatctgacaccctcttctggagtgtcggaagatagctacagtatactcacatataataaataaataaatcttgaaaaaaaatgcaaccttgccctctggtttcgacatgcacatgcaaacacaccaacatagtaatgataatgtcttaaacacggactccaccgtgctagagcaaaccttccctcctccaccccccacacttgagtgaagctctcccggcttctcttgccgtgcacagggatgggctgtgtactggcccatgcctgtgccttcccagagttcctgttggcatctggaagggatgtgggatttcagcacatttcctcttccacgtggtcgccttttattctgctaaattttagaactttgcctcgttccaccagccctggctctaacttttcacaagaaaagaacattctgagtcttcagtgaaaatagaggcatgtggccaggcatgctccccccccaaaaaaaaagaatatcaagctgggtggtgaagtggcacatgccttcaatcccagcacttgggagacagaggcaggcagatttctgagttcgaggccagccagatctacagagtgagttccaggacagccaggcctacacagagaaaccctgtctggaaaaaccaaaccaaaccaaaccaaaccaaaccaaaaacacaaaacaaacaatgcaacatcaaaaaatggaaaagaaaataatgtagaaagaaaaccacacctccccagttaacaacggccccacaacagtgctagctgcaaaggagccctgaccacgccccacaacagtgctagctgcaaaggagccctgaccacgccccacaacagtgctagctgcaaaggagccctgaccacgccccacaacagtgctagctgcaaaggagccctgaccacgggcagggggagctggaagttaagagggttacaaatctttggtaaacttgtgggagggagcctggagcacccagagcttcagtcatgtctgttgctgaggagttcactggctggacaacgccttcactaaagaagagggaaaatagaaagatgtggccaagactacccaggcctgtgacaaaggaggatgggaacccagctcccttgcttagctttaggacaacatggctgtaccatggtgttccagagggcctcccccgagggagctatctctgtgaggattgccccaaacctaagtagggcatctgaggcagcctagcatgccatggcactgccaagagagaggggaggcctgggttctcaaggctataaaaaggctgagaaaggaaagggcacagatgtttgtacagctggagccacaggaaaccacaaacttggggggattgcgaactcggagtcagcctgccactagccagatccccgacccgaagacaaaccataataaagatgaagacagggtctgagaggcggtgatgatgaagcccaccagcacaccaccacagcatgtttgctccttgtaaatagaaacagcaaaccacaaaggcgtgtggggttttcaagattctctttttattcattttggccatgtgtgtttatctttgggtaagtgcatgtaagtcaggtgcctgagaaggccagaaaacggctctgcctcccttggaactggtgccccagagggttggaagctgccaggtgtgtgctgagaatcaaacctgagtcctctgaaacagccgctggtatactaacctcgaagccctgagattattgtctccagtgttctgctgagacactagccgtgaccctttagatggcactgtcttaatagtgattctgacacacacactaacccagcacctggcaatgtgtgacggccagtgtatggcacaggtggttttcagatggacatgtctgtctgtctgtctgtctgtctgtctgtagtcagtgctaaggcttacactcggtgagtgctgcttaactgagtactgctctcattccagaagacaaagaaaagtggaacaaaacgaaaaaaaaaaaaaaaaagacccagccattttgatattattctataggcttccaaataaacacaactttttaaaaaatgtgcactggtgttttgcctgcatgcttgtctatgtgagggtactagaccccctacaacaggaactacagacagttttgagctgccatgtgggtgctgggaactgaacctcggccctctggaagaacagccagtgttcttaactgccgagccatcactccagcccagagacacgactttttctttttgttttgttttgtttcgtttttgagacagggtttctctgtgtagtcctggctgtcctggaactcactctgtagttcaagctaggcttgaacttagaaatccacccacctctgcctcccaagtgctggtattaaagatgtgcaccaccatgcccggctaaacacaacttttaaagagccataacaggaaaaaatccttgaagaaataattgttaaagaaaacctcgctggtgagatggctcagtgggtaagaacacctgactgctcttcagaaggtccagagttcaaatcccagcaaccacatggtggctcacagccatccgtaacgagatctgactccctcttctggagtgtctgaggacagctacagtgtacttacatgtaatcaataaataaatctttaaaaaaaaaaaagaaagaaagaaaacctctcggagaatacagagtataactctttgtagagaacacaaagattggtgaataaattaacatgttggctagacacagacacacatacaaaagaaacaattttaaactcaaggtagagaagaacttctagaaaggggaaaaaagtgtgtaactgagtgtgggtcacatagggttctgaagtcaggcatccttaggttttggctctaaccccacatgggtgggcatacaggtattactatactctatattaagaagccgcagggggctggagagatggcttagcagtcaagagcactgactgctctttcagaggtcctgggttcaattcccagcaaccacatggtggctcacaaacatttgtaatgggatccaatgtcctcttctgatatgtctgaggacagcgactaaagacagttttatgtatgtattcacattgactttttgtgcttcgaggcagaggcagttgaatctataggtttgaggttagcctggtctacatagtgcgaccctggcctagccaaatccaagcaactaaccaaccaaagaaaaaccaaaccaaccaaacaaaactactccaaacacaaataagcaatccagtatatagacatatagatatgtagatatcatatatatcataaaacacatatacacatattgaaatgcaatgcacacacacaaaaaaaccaaaaccaaccaaaaaactggccctgagccccgccttcacgtgacatgtgctctccaggggtttgtgccacatctggagggcaagctgcaagacactacttctgcaccactccctgggtgagcagctctggaactgaccacatctgcctgccttgctgcctagggctaggcttggacttcctggtcccttggctcctagacccggcatcacacagttggggtgggctaacctctgctcaacactcacctacacacgtgtcctcaagcggtagcttgtatttctctgacgacagtggcttcggtcccttgttgtggatggtgttgcaaactgccctgtgttctattcattttacatatgagccttaggttggttctgtttgaagggctccgccccttggccagttatgaatacagattgctgcccctggcctttgttctgcagattcacaaagctgagacggagaccaggtgaactggcagtgacccgagaaagattatggatctaaaaactaattctcgatgctgagagatggctcggtggttatgacgcttgcttccctgtcatgaggacaggggttcagatcccagcaccactgaaatcagccaggtatcccactcatgcctgtaaccccatttccgaggtggaggtggaggccagggatcactgagacctgctgccttctagcttagcttctagcgcaagccctgggctcacatggagagaccttgcctcaaaggaataggcagaagtgagtggtaacggatgaagatagcctgtgttcttttctggcctccgtgaacgtgtgcacgtgtgtatacacaagcacatgcactcgtgtgagcacatgcaagtgtgcaaacacacacacacttacacacaaatcttttattttttttaattaactgggtgtgcacacctttagtcccagcactcaggatagcagaggcaggtgggatcatggccagcctggtctatactgtgaatttcaggccagccagtgttacatagttagactctgtttcaaaacaaataactaaaaacttaaaaataaatttaaaagatccttcaaggagcctttcttttaccaaggatctgagttctattcccaggtttcacctggggcagcaaacagctgtctgtaagtacaactccagggatccagagcggtcttctggcctctcttggcgtctgtacacttctgggcatatccagacagacatagccacaatttcaacatagtaaaaataaaccttaaaagagggaggactagagacatggctcaatggtcaaaagcacttaccgctctcccagaggaaccaagttcagttcccagcatgcatgtcgagtggttcacaaccacctattataactccagctccaggggatgcgatgcctctgcagcccctgcactcttgtgcccacaagtccaccccatgtacacatacttggaaatggtaaaaatcttcttcaaaagccttcaaagataaaacgcagcgtccacaaaattgtagtgagaattctggttttctttaaaagccgttatgttgtgtgaacatgtttttgttctaatcccaggtgtggggtgcgaggctacttcacagcaggtgattatgatctgcctcgcacactagcaggggggtgatctttgccagctgcaggtggtttatgtttggaattttggggactctggagagggaataaatatgagtctagagaggggtgtttggaaggaggcagctgcttcccccttctgctcctggttgctgttgctaaggtttgtcaagtgttcatgcacagagagacaagttagagatatcgtgacgatgaagattggacttaccccaaggaactcatcacccctaatcggaaggacataatctaaagagatctacgcctcctttctcctctaaccttcattctctcctatctactactgagggtgggggggattggaaaggattagggtggaataagggttggaaggggggtagaagtataaaattcccaataaaatggattaaaaaaatatgccaacacaaaacactaaaatacaccttatacgtgtgcatgggagatatagttaagatacacatacacaagccgggtgtgatggtgcacgcctttaatcccagcactcgggaggcagaggcagggagatttctgagttcgaggctagcctggtctacagagtgagttccaggacagccagggctatacagagaaacaaacaacaacaaaaaagatacacatacacacctgacagcacaactgaaacccatccaagtcgggctcccagctacatccacccaccccagacgttggtgcccgcatcttcccactgcacagctgcaaacccctctgactggggcgtgggagtgggggtnnnnnnnnnnnnnnnnnnnnnnnnnnnnnnnnncaggctatcaattccaactctcttaatctccaacattgacaccaggcaccagagggaagctatgtggttctgtgagtcgaaggagggaaatccatgcttcgcagcagcaagtgacttggcgttcagacccagaatctcacttcctcagggaggagcccctccagcccacctgctgtccctgcctcaggactgtggtaacagaaaggctgggaaagccaagccgccaggctgtccaagaacataatgactaggcttactcactcaccagccctgaacaacaatgtgtgggctggccctcacggtgtacacagtatctgccactgtgttaattggatggcccggagagaaaaggaggaagtgtttttaaatggcaccttcaattgcttccagattatatcttggctaagtgactattaaaattagtacctgtcccaggagcagcgtcacacaccttcaatactggggtgggggggtgggggggggaagaggcaggaggatcacatgccggaagccagtctgatctgtagagtgagctccaagctagccaaagctacactgtagactgtctcaaagccagggccactggctcagttgggtgaagggcttgttcttcaagcttggagacctgagtttgcccctaagaacccactcaaagatggatgcagagaatgcagtagtgaatagaccaacatggattgtcctgaccctccacacactacctgtgaacccacattaaacacacacacacacacacacacacacacaattttctaagtatcaggtcataagtcagggaactggttttggataccaggtcgaatttaattaaggttttagttactcacccacccgctaccctgtgttagggtctcagaatttcccattcaacagctgacatcttctcagttgttccttgctaggtggttcagattttcttcctgccatcgataccagcaacaagagaacctgccgaccttcctcctcaagccctggacattaagttctacatggtagctccgggagactcccagaagcacctgtctgcacccacagaaccactttcaatattctgcaggccctctattttaagaaacattctttagctttgagacagggtctcactctgtagaccaggctggtctagaactcatggaaatctgctgcctctgcctcccaagtgctgggtaggattatatatatgcctggcaatttattattttttttttactttttaggcatgcatgctgatgctggaagaggtgtcggtccctctctggagctgtagctatggagttgagacccctgacggggtgttggatacggaactagtctctgctagagcagccatgctctccagcctcagtgtctctaatttcttggttttagacagggtctatgcagctctggttgagtctggagcagttatgtggcctgtgaacagagatctgctcaactgcctccagtgttgggattaaaagcatgcatctgtaatatttttagattatgtgtatgggtgggtttaacataaatgtcatgtgtgggtgttttttgaatatcgggtgccctgaaactggagttacagctgtgaataggtggtacttttaactgatgagaccccctcttttcagccccatctttaaattcccaagatctcatttagctcaagataaaggttcttgaattcatttttatttattttttttattttccgagacagggtttctctgtatagccctggctgtcctggaactcactttgtagaccaggctggcctcaaactcagaaatccacctgcctctgcctcccaagtgctgggattaaaggcgtgtgccaccatgcccggcgttagttagtgttttattaagacctttttatcaaacactctcatccataacagggttttttttttttttgtatgcaaacacaggtggtcttttttttttttaaatgtatttattattatattaagtatactgtagagggcatcagatctcgttacagatggttgtgagccaccatgtggttgctgggatttgaactcgggaccttcggaagagcagtcggcgctcttaaccactgagctatctcgccagctcccacacaggtggtcttggtggagcagaggattcaggtgtggttcatctttgccatcatgcccagatttaaattttcttttcctttttggcttgaaccttacctctccccagctgctttgggcttcttgatcatcaaactttttccttaaggtcttaccaaacacattaacattaatacttaacggatataaatcaaattctctcatggacaacacgtacctatagttgaagatacttagaatgctgaagctgttgtccagcattcacagtccagcaacacatgatggattcttttcagttcagctttgggcagaggtggcagcctgggaggtccttcctgggaactagtgggaaatgacctgtgctgtgtctcgttttctataaagcaaccccactggcttggaccaggagtcttcggtttctctctggatgatgctgccagagtgcacggtatgtgtggccttgtgagcagtcttgagttaatcctgccagggaatattctagctgttctgtgggcccggggcaggaagctaggctggtatgcaccaagactgcacatctggtaagcagaactgagctcagctaagttcctctaggtcaccaagtgggtaaaaaattaatttcagggctggagagatggctcagtgattaagaacaccgactgctcttccaaaggttctgagttcaaatcccaggaaccacatagtggctcacaaccatccaatcatgagagctgacaccctcttctggtgtgtctaaagacagctacagtgtacttagatataataataaataaatcttttttaaaaaatgaatttcaactattttctgattcaaggccaccagcatctcaaaccgagccttttttctttttttttttttttaagatttatttatttattatatgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcttcagacactccagaagagggcgtcagatcttgttacagatggttgtgagccaccatgtggttgctgggatttgaactctggaccttcggaagagcagtcgggtgctcttatccactgagccatctcaccagccccgagccttttcttttgattaaaaatttaaaaatgttgagccaggcttggtggcgcacgcctttaatcccagcactcgggaggcagaggcaggcagatttctgagttcgaggttagcctggtctacaaagtgagttccaggacagccagggctatacagagaaaccctgtctcaaaaaaagaaaaaaagaaaaaccaaaaaagaaaaaaaattttttttcaatgttcctgtgtgtagaaccccaaaggccacaagagggcactggacccttggagcctgagctacagggagctgtgcaccccaccctgcagtgggcctaactgccctgtgctcctcactttccattccccagacatgtcttcagaagcctggcctctgccttcttccttccaatccatcccacacggactctacagtccaccccctcccatgtctcccaagctaacccaacaatgccaatgattctcagcttgtccttatccaccaccaagtatcagatgacagatggacttctttcagccacctgggctggccccaaccaggacaccctttcttcctggattagcacttgtcccttggcccccagtttcacctgttacataggtgtgtgctgtttttttttggggggggggggcggggggctatacatgtatggtacattcattcacatgtttactgtgaatatgaacagaatggtggactgtctcacaccagtttctacaagttttgacactcattacttctaataccaggaagcaccgtgtcctccctctgtggtttggtttgggtttttttttttttttttttttttgggttttttgttttttggagacagggtttttctgtgttgccctggctgtcctggaactcagaaagccgcctgcctctgcctcccgagtgctgggattaaagacgtgcgccaccacgcctggctcctctgtgtctttttatgttggtgtcaggaagacttgctcagatgatgagctcagaggagcacaggctggtgtaactcagcagagacgccccatacactcctaactgggacttgctgtggctctgccattcacccagctagcgagccagaacctgagagaaacgaggcactccctaggttacaagttacaagggtgcatgcagacagaggaggaagcctttggtaaacagtgaaaggcttaaagtgtctcttgtatcaacttcacgttttctctgctcagggccccatgacagaaagcaaaccacctctagggctgatgcccttcaacagcctctgacctaatcaatggctcagattccgaccattaggttcaagctgaaggaagcaggctgggatgtgggagtgcccaggggagtacttggctgacccttaggacccactggccagcagtcaggccagacaccatctaggcctgccctccaccaccacacacagggtctgaggccaagacactccccaggaaccagggctacctggcttcctctcaatgcaccagcagctttaatagaccaaggcagcaagaaactaaggctacaggcagggctccaaggaagccagcccctccctcctgccaggctacttagccaagacccaggcccctcccaaaaggactgcatatggaaagacaggaaaggattcgtggggccgctgctgacagaaagacacgaacaagttaacaagcttgcatttaataagtctgaaaccattctcagcacatggcattgtacacgggcatctgtgcaaacagattcatttaacaggtcgtagtttaaaaaagtcatagatactgtgagttctgtataaaccggtggacggcaagttagttccttttgatttataagcctcaatgtcaccgcagaataaagaatgtagccaaagaaagcattatcggtcactcgtataggacagtgttgtttctataatttgaagctttctgaatggacgggttcaggcctgatccaactgtaaaaagatcactcagtgaatagactatatgggaactgtacaaagtgtcattaacttccatcattaatagcttactcagcactataccactattgctagttaaaataacctgcttctgaggccccacggagggaggcggcctgtgcacgcagcctcgatgccctggccacctcatccccagggcgtgccatacagtccaacagaaactttggctttaggaaggagtcacagacattgaaaagaatggctttaatcgttattaaatgtgcagtgggagggagtgtgcttcagatagtctgggcagggctggcggcaggcaggtcactcctgctgccacagctgcagacactagtttgtacatgacagacaatgagggaaagcagtccctttcaaacaaactggaaaaaaaattgttcacagtggtttgtatcaacagaatgcatttatgacaattacatgtagagactcacgcactctaaggctctctttatatcctaaagaaaacaggcatttacattattcatgacttatactaaattaaaaaaagatcaattgtacactttctcctcagacaggataacctgccagggtgtacagcttaacaccatcatcagagctgtccacaaagggaacagaggttcaaaacaaaatgctctcttgagaatgaagtgcttggcttgctgctataaccagcaagtgccagcagtaatcaaatggaggagggcccgacagacaggtctacctgggcaagctgaccagcacatcacagtttaaaaaggaaggttatgaacgctatgttacaagtcccaaccaggcagtgtcaagtgacatctatttctttgcttgctttgtgatcataccccgtggtggtgtgacaggtctcgtggcgttgggcttctttttctctgcaggctttaaaatctgtaaagaggaaagaaagaagaaccttaggagagctatacctggacctcagctctgttcagatctccatctagaagttctgcctaatgctgctgccccctaaatgctgaaaagccctctagaacataccctggaccgactggtccctgagcattttggtggagaagtgccatgacatacagccagaatatgtgatctggaaaacagtttctgctggggccaagtgacaaactcaagtctagagcttcccacaaccttgaagctctgtggaaggcactggagtctgcagtctctggggagtgctgaggcctgcctcgggacttccacagctacagtaacattaacaactgcgtgagcttgaaatggatcaagcccactatagggaggaaatgtaagaaccaggggccagcacaggagacgatatcatggcacaagctgatgtgttggcacttgggaggcagaggcaagtaaatctctcttacattcatggccagcctggtctacagggtgtgttccaggccagccagaggcaccccaactccctcttctcaccaaaagcactgactataagtgacactgtaacacaccgcttgcttccacccacttaaagaattcaactacacctaacgtcaatcctgggaaaaggttccgtattatttttcctttctttaggaagagcccacacactttttccatgggataaatattcctaaaaaagaaagggcagcctgctcagcagaggtgcaagcacatgaaaagtggccacagtctcacctggaaggaacacatgagggtctcatccacactcatcatggcgcctgcattgtcaaactcgccacagtagttgggtgcagaaaacagagtgactaactgcctctttgcaaaaaactcatagccatcttcaaccacctgtggagagaccgtgtcagtgtgagcagctggggcacgagctgcccctctccttccccactgagctcggcctgctgccgctcgccccggaggcacactgtgtggcaagccatacctacccaccaaaatcaacaaggagcctcggctcacacccatgctctaagtgtacatgtaaagtcaaagtcagtacctgatgggctctacatataagatccaaatcatgcttatggagaaattttgcaaccacttctgcaccaaatgtgaaggacactcctctgtcattttcaccccagcctaagacatctttatcggggtcagaccacaaaagatcacaaagaagaccttgatctggtacatcagttggtctcataattcgccgaatctgctccatagattgaagatctggtgataaacctattcaacgagaaaggaaaccccctgaagtgcagacagcattggcctgagcatgtggccagcccctcctgctgaggaggctggcactgccatgctgcggtgaaacctgtgggtttttaacttggttttgggggaaacaatgcacgaaatgtactgtactgctgttggtgtgctggtcagagacagtcacctcaacacagagccccgcaacacccaaccactgaatccacacttctcccaatagaaggcaggaagggaacacagagggtgccaccatcaccagatgcaatggccgggcacaggcacgacaatgctcagctgtgaggcagctccttccgagcctgtggtccatggaccaccaaatgtcactcaacagatctaacagtcttgttctctaagtacccgatccaagagggcatagagactacgccttaatacattatgtgggtttttggatagctgcttcatttccaatcacccccaaacctccacatctttgcaatgcctttattacctcacacacagaacagctgaggaacggagcagagcttttgggaagagcacagtcagggttcaggcagacacatggctgagaagagggcactagggctcgtcctgtatttaaagtctcgttctcttcccaacctataacccctgcttcctcacacttgatccaaatgaccgggctgtatcactgtgaagaagccttggcaccacagtggcctggccagggtcaccgtgcccagctgcctgggtgaaggcaacacctccatgtcacatacctccatgacagcagaatatcttctcgtccacgatggctgctatcggcaagcagttaaaacagtctgtgaacgttttccacagcttaatgttgtatcttcttttacctgtgagaacgcagacagtcgccctactgctcttcacctttgctctctaaggccacctttcaagcaactgaaacatgggggcacccacaggcccacagggctggggtacaggactcatccagaaccaaacgcgtccccagagctccagacagggcacctcagccagccacattagcgcacagcacccactctacttgaaacctcatctggtttgtggaaccttgaccttgagggaacttctacttctgaaggccgccacgtcctcctgtgttgtcagctcttccttcagctgccttagctgtgaagctgctgcagccagacaggagccccaccctgacttcaggagggccagggactctgggcaatcagaaagctcaatctgggcacatccggtgcttggtcctaacagtctacactcaatatactccctcttaagcaccagggttataacggggtgtcagagcgtgtgccctttaaaaccactgtatgaaaactatggttggagttcacagttcataagccgtagcccctcctacattctctaactggccaaggactgcgcaccacagggcagcctctgctcctgggccatcccacacttgagtagcagtatgttgagtttgccactacactaggactctgtcctctttaacagagaacacagggacatctaaagggccacggtatgccttttagagttcagcggcacctagcaacagccttcctaagccacgccttctaagctgggcagaccacccaccaccagcacccagcattcagatccttccgaggaaacttgcatttcagccctggggaggccacagattccctggataattctggaaacttcaatgaacacagtcaacacctccaattaccaatagctaatagtaagaacttcaatgcggaaactgaggccagatggccttgactccactccaaaatccatccggtccctctcattctctgctgagcccaatgtcactcatgccttaactgagggctggattaaaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagctgcaactggagccaaggttgtggtctacacttcagaaaaaaaagtaaaatgagataacctcaaatatgagaatatgtacaaagtattattttaaaataaaattgggggctggagagatggctcagcagttaagagtactgactgctcttccagaggtcctgagtgcaattcccaccaaccacatggtggctcacaaccatctgtaatgggatctgatgccctcttctggggcatctgaagacaaccacagtgtactcacatactttaaataaaaaaacaaacaaagccgggccatggtagcgcatgcctttaatcccagcacttgggaggcagaggcaggcggatttctgagttcgaggccaacctggtctacagagtgagttccagtacagccagggctatacagagaaaccctgtctcgaaacaaacaaaaactgaggaaaaacaaaaaggagaagggggagggtggaggtgatgtggcacaccttgaatcctagcactccagaaggcagaggtgggtggatttcaaggccagcttgatctacagagtgagttccaggagagccagggatacacagagaaaccccaaaacaaaaaacaaagaaagaaagaaagaaagaaagaaagaaagaaagaaagaaagaaagaaagaaagaaagaaagggaaaggaaggaagccagccagccagccagcgcggggctgagaaggaaaggtgcaagcctggcaaccaaggtcagggtggagacagctgactctacactctggctccagcaaagacagacacactaaatcaaaatgtagtttttaaagcgttttttctccattatgcatcttccagaaaagttattgtccctttcctaaataaagctgcactacaagaaaactacaacatccatttcaaaaccaagctgttcactgcaagatccacccacatataaggctggacagcagagcagcactgcctgcaactgtggtgctgctctcaactcacaagccactgacccatgctttcagcagatgctctctctatccagaaccagtctaaccaaagctgtgaaaagcagagcagatggagcaagctctggggtctgcactaagagcaaagccgtgtgccatcaagactatttccgtccaaccccatcagcacccaggtcaggctgctctccctaaaccaggacgtgggtaggtatgctgcagcagctccaactcccaggcctgctacccgctgccttctagccctggttcctcagaggcaaagtacttacactcatcataaaatccgtagatcctattgatgctggcgcactcgtggttccctctgagaagaaagaagttctccggatacttgattttgtaggccagcaagaggcagattgtctccagggactgcttgcccctgtccacatagtccccgagaaacaaatagttgctctctggaggaaagccaccgtattcaaacagacggagcaaatcatagtactgcccgtggatgtcacctaagggtgagaacatcagtgtcacaaatcagcaaacagacaaaaccttggcaagacgcccctcagacactcatctcatatgacaatggcatctacaacgttcaccgccaacacgaatttcccggttgtagcatatttagttcaactgaccatgtaaaatttaaatgcacaggtccagagctccccccagacacaactaattaatttatttgtggtaaagagtatcctgtctcacctgtttcctgccaagtactgcagtcccctgagctcagcttcagggatttatgtgaacacatcctttgtcactgtccagtgagacgggccccctcacaacacttacattcaagacacccactttggccatggcttttcaacttctgcaaggtcaaagccaaggtctcctcgctctaaacacacagtttattctgagtcagagatgcaatacccacctagactgtgcgactctagaggacggtctgtacctgctcctacagcagagtgagccaaactagaccaggccccccaccgcacccccccatgcccatgctccttcagagaacatcaaaggccaccagtgtgcccccagctgagtaacgggagtcccacactcaccacatatcttgagtggtgcttcaagttctaaaaggataggctgactgaggaagatctcccgagacttcaggcagagtcctcggatctcgttctcctggagctggacattcttgcctggcttggaccctctcactgtggagagaaacagcagtcaggacacagcctcacatggaaatgttcaactcaggacagcagagctaagagcagctaactaattactgcttgtagcttctggccaaggctgccgcctgcactcaaatgcacagacacgtcaataacaaaaatgaaccttagaaaaaatgttaacttgagaagggtggcgtggtgtgatattgaatattttttttctcataataaacacctgttagataggagttggccaaatgtaactgaaatcagttttctggctggccagtatggtctcaactgagatctggaatgtcagttgtatacttcaagctatgttaggctcctttacagcagctccaaggttgccctgaccctgcccgtatctggccgtttcagagtccctaggacacactcgtgccctgtaccaagacggtcccttctgcttccaggcctctctacttttagaatggactcaagtttgcagtgggaaaggtcacagtcatatcaccaagtatgtcctcagaaatgttcaggacatgtctccagcaatgatgtttcaggaccaagtgcaactccatggtccctaatttctgcgtgttgtctgcatttcactttaaaatgctgctgagctcactggttaagagcactgactgctcctgcagagaacccaggttcagtccgacagcaacgtgtcagtcagtcacaactctaactctagttctagggatctattaatacccctctggcctccgatgagactgcactaacatacatgcaggcacaaccaccagacacataaatcaattttaagaaatgtcctagaagctagatagatggcccagctgataaaagactgccttgcaagcattagaacttatgtttaagttccagaactcacagaagagggagtggggcatggggagccaggcttgatggcacacatctagaatcccagtgctggagagggaaacagacacatctggaaagccaaccaggcagcctaatctacctagtgagtcagtgagaaagcctagctaaaaggggaaaaaaaaaaacccaaagccaaatcacccttgaagaattaatgacacaccctgaggttctcctctggcattcatatccaaataggacaccagcattaagtcagtgcctattaagaaaaaggcctcccaggcatccaaagagaacaactcccagcctagcaccagtcatggcagctcctgagccctctctgttcacggcctcggtaaggtctggccacagcccactctcctcaggaggcgagggtgacagcagtggagacatctgtgtgggttccggttactcgagatcagataatcattatgcagactgaagaacaactccaactgccaaggatctgaactctccacagctctcaagtggcagcagcttcagggaacggctgccgcaggccctgcttaccgcaaggctgcctggcacaggggcctgaccaccttcagtgagctagaatctgagtctctgctcttttgtacagaagacaaaggacgcaggcacttcacttgagttcagcagacccaggctaagcagcccatttaagactgcatctgtctatcataaaccagtcaacagatttgcttttagcagaatcctaaatctgactgatctcactagcttaaattttgtccaattgcaggctcggtcataaaatcatctgtcctgacagctaggtaagagcagaaaagtctacaggcaaacacagcttttgaccctgtagcagcagagcaatggcactcccaagagaggcctgctatggaccaagcagagtccactcaaggctgcaaagctgtacccatgcttggaaaccagagcctcagggaagctgcccttcagcctgtacgactttagacatccccgcttctccgaaggaacaagctgatcagggatgaaatggtatgcaaagcaacattagtttttcagggaaaagacaagaaaaggatgggccctcaaagcaggaaaaaacattatgagataggacagggagccagcaaggaatggacccctctgagcagcttcagtcccccccaaatataactgggctgtaagacaaaagatgtggccactgggaattgacatcgggtgtactctcgtctttttttttatttcattctttggctacactaggatcccgcctctccatcccctagtactggggtaacagacaccttagaaaataggttctgagcctggcggtagtgacacatgcctttaaccccagcactacatggagagttccaagacagccagggctatggagataaaccctgtctcaaataaaccaaaccaaactgtttctggtggggtcaaatacagggccttgtttctgcagcaattttacaggctgaactatcttccccagtcctccccttaaattttatgggggttggggttgagggtgagtaggtcagaggacaaatttgtggagttggctctcttcttcccatttgctggttccaggaattaaactcagatgtcaggcttatgcagcacactttatccaccgagcctctcatcagtcccctctggggctatgcagcctaggctaagcaggcatggccaattctgagatggaggtagccctgcagtgagtctttgagggaaggcaggacagcagctaagcaacaaaggctttcctttgccactggagccagacaagacaagcagcactcggaggagagacaggaggattcctgcctcaccggccaaaaacctgggcatgccgcccagcaggaggcttatttttggttagaagggaactcctggaagcttctggtctcaacaggaattttcttcaggagagctctgcatttgtgcacgagtggcccactcttgtgtctttggtgataatcttcgtatctggcttctcctggtacagcccacaggcttgctttgttacatacatacagggttctactgcagagagctagctgggtgttgctaatattccttgattctgaaaacatccactgccatttttagacagtttgagtgcaattttttttaaaagatttttgaaacaaggtcttcctatgtagccctggccggtcttcaactcagggatctgcctgccacttcgataataggattaaagctgtatgtcaccacaaccaactgtttgacaccaagtctcattatgtagcccagtctaaccctgaaattcacgatcctcctgcagcctcacccctcttctctagctaacaacaccctgtctatgtagcattcactgacatagcacattccacagctggcaacaacttctcacccttcaggacttcccagacctctcttcaactgaggctgtccccttccccaagaatacattatacttcctgaatggctggcaacacctggttgccaaccagccccaagaaaaccttgattcaaaagtcaggggtagggcatttggggggggggggggagtggttgtcaaaataagcataggactacaagcctttttttgccagtgagcattgggtatgtcttaaagctgccaaattggcaagatctactttagctctcagtatcaagcaatatgactttcccacaattaacacccaggacctgtccatctaacctttttctctggctcttactattgctgggtcagcctgctgttcccaatgaggctcttgtgtgtacctagaaaagggacatttatttaggtcggctggcagctaacaacaaaggctgttctgtagatactgcacttacctggaacatcactaacatcagcacacagagaaatttcactaaaaatctcactgacaacaaaccccaaagttcataaaccctgagcttaatcaggttactgctgctgctggtagtctactgctgctgctggtagtctgcagccctagcacctctctaggcagcagtaactttccacagcctagcaacaagcaagacagcatgacagaaggaagccaaggagatgtactgagggatagaaaagcctccacagggttggtagcaccctcaaggctcgtaatgcaccaagccctggggttccgccccagcattaaaactgggctgtgtaccaagaggatcgggagttcaaggtcctcatctacacagaccctcctggccagccgaggcacaggaaactccatctcaattaaaaaataagtaataaaaggacaggacaaagccctagatgaattacaatgtgatttggagctaagagctgcacagaaggggcgagtcagcagcccttgctgtctgaccacaaccttacctaagcagccactgccaaggccaagcatacatctagccccaggtaggcagatctgagtccaaggccagcctgatctacatagtgatgagaccttttttttcaacaaataaaaaacaaatttaagtcattccttggtgaaagactaccttcaaggtattttaaaaacatgtagaaaaagatctcaaaccaaacaaacttagtactcgccacactgaacactttcttgcaaactgaattattttctacaaaacatgcaagctaaagaaactcctcaacaactcctttttccccccaacagcaaaagtgcatggctctccccactgtctcccactaccctcccacctcgctggggcactgctgctgtcatgcatgacaacactgatctcctctacgtgggcaaccaggatgtggctaaaaaagctccaaccaaaaaacgtcccaaggacgtatcttgttttctataatgaacactaagccatttgaacactgtatttcaccgggaggcaggaggatcagcagagttcaaggtcatctcagctgtgaaggaagttggagggcagcctgagaatctttccacagctgaatgccgcatctcagcatcagtgccttgcacattggaccccatgagcttctacttcctgtaagtcctaaaatacacccttcaaaaacaaggatgtcagcaaccctgacacagaggtgggaaacatcatcagaatcagtaccttgccttcacactcccgatacaactgtgaccaagactgaagacaaaaatccctcccagaattctagctcagggaaccgggatttgctttacttcagtgggcctgtggggcttcctcagctatgaggcagttcccacccaacctttcttcctgtgacccagcctgaatcaaagcagtaaaaaacacacatagctcttttccctcagatattaaagtgcactgaccaccccaacccagccactgtgggatcacacaggccagctgctttcctttgagaggtggctgtcctgtgtgtcccacctgcctaggactgacctgcagcctggccttgcaaaagtgaaggggcagtgaaggctctaggagccatacctgacaaagggaggtttttggagggtggaggaggaaggagatggtttctctgtgtagccctagctgtcctggaactatctctgtagatcatgctattctctcttttttttttttcctttggagacagggtttctctgtatagccctggctgtcctggaactcactctgtagaccaggctggcctcgaactcagaaatccgcctgcccctgcctctgtctcctgagtgctgggattaaaggcaccactatgcctggctatagatcatgctattctcaaactcagacatcactctgcctccaaagtcctgggattaaaggtttgggccaccgatgtctcacccaaattaagtttttttaagactcaaacatctacagattgaggagagggtcctgccctgcctgccaggtaaagtatggggacatatacctgttggtgtggagggagggcaggatgcccgttaatgatgatcttgctgtgttgtgtgccctctgctcagtctaggatctgcttccagacccacaagcccatcaccctcacctgtctttcatttaggaccctggccctcaggagcaccgaaaagacacatacacaagtccttagagaacggtagggcagtcagatgccttcagagacgaggactggagagcaatctgtattagcagagctacttcccaccatgcgctgacaatgaccttcatttacagaaacatgttcttgcacattgccatgtggagaaattaaaaccacttgctactcaagaaaaaacactagaggtttcatgaagaaagcaccccaattcccattttccactaaaacagcagagcagggtgctaccttcacacacagctagtctattttctgctctagcatgtccctaacactgtgctgaggactaacacagatcttccgccagtgtggctgaccacccagggtgacactcagggaaacccactgcattcagagtgccacagaaccgcagtgcctaggaacccaacccaacctgcctgtttacacagaatctgtagttcaggctagacccttaggaactcatttcattatgctactgcctcgacctcctgcccccacctaagtgccagggactacagtagctagcgttggatagtctggcacttcttctgtaagccagactggccttgaactcagagattaagttgtctctgtttctcagtgctgggattaaaggcatgtgccaccactgtcagtttaaaatgtatttttaatcatgtctgtgtgggttagccatgtatgtgtgtgccttgagaagctggtgtctgactccttggtactggagtagcaagcactgggctacctgggatgagtgctggaagctgagcttggatcctctagatgagtactgtgtactcttagccctaagacagctttccagttttttgtttgtttgtttttggagacagggtttctgtgtgtatccctggctgttctagaactcactttgtagaccaggctggcctcgaactcagaaaccggcctgcctctgcctcccaagtgccgggattaaaggcacccggctccaagggacaaatcttatctccccctttcagaattaaacccttattttttttataccattctgttatatgcatgtgtgcaaggccatgcttgctggagctgttgggggtggggtggagacaaccctcaaagtctggttctctcctgaatctcatgtcaatccagaggatcaaatcaggacttcaggattaagggcaagagccaaaaccggctgagctatctctagatttaaaggttttgaaatcatcacaaccccaatgccagcgtcctctgattgagaactatacgcatcctgagcagatcctgtggcttccgtcaagcaagtccataagttagaaacaaatacatataccacccagccagtcattctcaacgtgtttaaacagtggcttactctgttaagttcaacagaaaagaataaaccaggccaaacatggtagttcagctttgaatgccagcactcaggagacagaggcagatagatctctgaaaatccaggccagcctttgctaacacaatgctacccagtctcagaacttaaaaactattaagaaactatgagaagacaggggtggtaaaaagtttttaatcccagtactctggatagttgagacagagaccagcctgggctacataatgaaactgtctcatttaaaaagggggtgctgaagccgggcgtggtggtgcacgcctttaatcccacactcgggaggcggatttctgagttcgagaccagcctggtctacaaagtgagttccaggacagccagggctatacagagaaaccctgtctcgaaaaacaaagacaaaaaaaaaaaaaaaaaaaccaacaagaaaagggggtgctgggggagtgaagtgatggttcagccgctaagagtgcttgatgttcttggagataaactgggctccatttccagcacccatatgtgacagctaacaactatctgcaactccaatacccaaggacccaatgcccttttcagacattcataagggtaagacatgcgtacggtgcatgcatgtgcgcgcacatgcacacaaacaaaatacatacagaaaatttaaaaaaataattaaaagagggagaaagggaagctggtgagatgatttagtcagtagaaaatctgctttgcaagcctgacctgagattgatccccagaatccacacaaagacgcccaactaccctctaacctcctcacgtgtgctttggtctgtatgtatgcacacactgcataggaaaaaaataagtcaggctgagtggcctataaaatctagtatgtgagacgaagcagaaggatcagaaggttaactcagctctggcccctgagagagaccctgtaataaaaggaggcatggtaataaaaatgcctttaattggggagggagaggaagaaggatctgtgagtttgaggctagcctggtctacacaaagagtgccaggataaccacgactggagagaccatgttttaatgaaaccaaagccaagaaaccctatgtaaacaaaacattaaagaggaggcaatgctctgggcagtggtggcccaagcctttaatccgtgccctagggaggcagaggcaggcggatttctgagtttgaggccagcctgctctacagagtgagttccaggacagccccaggaccatactgagaaaccctgtcttgaaaaacacccccccgccccccggggaaatgcccagattttaaaaagacaccttttcccttttctgtcagtgatttacttgaagacatctaccaccagaattgcacagctgtccaccactccaaaagtattttgggccaaagcaagctagtgtcaagagcccaaatcaaggttactggatcttctcctctttagcttcagcggatgttgtgggatctgtgattagcaggatccagacctatgtcaaatttgaaatctccaaagtaggaaaccacacggcagaaacccccaagtcggacaaaaggaaagctgggtttttgtttttgaacctctcctcaaccactggacatcctgggttcccacagggtgaacagttggaaggcggcaggttctctctaggttcctagctaccccggggtttgaaacctgacttttaactgttaattcttggtccagcgaggtcttgggagtttctcttgcgaaacccacttccaggataataacaacacagcacctacctggcgggtgctcgctgaacgcggcagcgtccccctgtcctcagggacacaacaatctgatgatcagagagagccacactgtcacccggactgggtccgtgtgcggatgcacgttcaagggggaaagaacgctggaggatggatggctttgaggggagggtggagggggtaggaaaatgcagaagacggactctcatcgcactgggacgtcgtcctgccaagccaagtccctctgatgagtccttggactccagatgataaatgtgaaagcaaggacaggggagtgataaaaaataatggggtccccaaacccggaggcgcttgtatgcgcgccccagatccaaagcggcttccgagaaaagaccggcccctccactgggcctgatcccccaccggccgggcctgccccgccacccacccgcgcgccgctcaccttccagcagcccgttggatgatgctgtcgatgttgagtttgtcgatatccgccatcgccgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggggtttgagcgcgtaggcgggggtggggcggagcccgggcgggagacggttgagcgcgactccgccaccgcgcgcgggatccttccgccaaacgggcgggggaaatagaccccctgtggcgggagagggaagttgtgaagttggcgcgcgcaagttgaaggtggactttgtcagtctactgcgcgctgcgaggctcaccagctccttccggctctgctgaccgacatggcggggtgggagttcaacactgaatcacccctcggagccaatctggggtggggttgcttgcctgtggagaatcataaagaggaggaggttggaacgttggggattcaaatactctggcacattggtgaacaagaagagctagatatacggctccgtggtgagaatgcttgtcgagtatgtgtgagaccttgggttcaattcccagcactggcaaaatttcataatactgcaataaagcatctacgatacaatatttggaaaaaagaagcccccaagataagccaaaaaaatgttaatccactgtgagtggcacattaagtaatttgtgtgagcttcttgtgtgcgctaatgctcttttacattttagagagaggttgggagaattctgtaagggttgctactacctatcttttgaattatctttcttgaactcagaaagttatataataatttaagagatttcccctgtatttagccggagctgggttgaatgagcgtgccggagcagataaaatgggaatttgcacatttcctgggaggttgctgtgcgtgcgctctgggcctcagcgcattcatctgctgcttgcctctagcttccttgactccccaggggcaccccttcacctgaggggtccccaactctgctgcctcgcaggctagctgcctatggaagaaaaatgcacacccatctgacccatttatctcttcccagtagcacgccagaaaatttacaaaatgttctccccccagccccacctccagttcatgtttctcaaagcaagagggatggatctgaggattcctttccatgaatgccttgcaaggttgtctccccatagagagactcattttctacaagctctgtcttcccgtggccccgcagcatggtgtgtgatgcacccatctagatctgagcccttttcctgatgctagcccccgacagtggggtttcaggattctccccagctctcctcagccctctgctccactttgcccactcaccaactcattgtcccaagctatggttttgcacaccattacacaaatggtcattcatcaccccaaggcagctggtgcaccaggcttcttgacatcctggggtcgatgctaagccctgctgtgaatctgtggaggtcaatgtggtcttcactgagtttttggaatcttggactccctccagggcagggtagcttcccagggacaccatagggccagggatatgtaagactgattcacaaggagtgtctattctgggtggagcaggttgagcaagacagagaaagcctttctctcccccgggagactcattttgtgggatggagagacaaacacacaccactcttactagtatgagccaaaatctgtctctttgtgggaggctatctaaacagctctgcagacaagagattccctccatgcctgccaaccaattagagttccatgccccacatcctaatggagagagaggaagctaccacaggttgtcctctgaccttctagcagacgtacatataaaataaaatatgatgaagtagctgggcatggttagataggactttatttccaggactggggaggcagaggtaggcagatctttgagaatttgaggcaagttccagaccagtcaaggctaacagcaaaatcttgtctcgaacgaaacaaagtcagctgatggaatccccgatacaatcctagagatgatatattcccaccgttcccattttacagataaagttaggcacggaaaggctgggttgtttgctgaaggtcacacagttgctaaattccaggaggaggactagaactgggcagagcctgaaacaacagccttttgtttaataagtccctaaatggagccttctgagcccagcagactttggcacatagggtgtgtgtcactcctggggaagcaatagaaagatttaaaatgtttatgcacacacattgtgtcataattatctagatgccaagtgacaggtatgtatgtcatcccatccatgtggtgaggggtgaaggaaaattacaaaccaagctgatgatacaggggacatgttccctccagagttcatagccatgccccagagtccatagccacaccccagagaactggctctcttgtgagtaaagaagctcacattagagagcctgaactttgtccaggaacctgtagctatcagagggtgaccttcaactactgatcctcttgcctgcacccccagaatgttgaaatccaatgtgtggtccctgaacctgctgaatgtcatgctggagacagaaaacagggctttgggcatgctaggtgaacattaccagctgagccacatgccagtccctttaggaaatatgaacaaaacaggtttttagtgcgttggtggcccatgcccttaatcccagcacttgggaggaagtggcaggtagctcttggagcttgaggccactctgctctacagagtgagtgccaggagagccagggctacacagagcaaccctgtctgaaaaacaaacaaacaaaaaaaattgaggctggagagacggctcagtggttaagaacactgtctagtcttccagaggacccaggttcaattcctagcatccacgtggcagctcgctaagtgtagcaatgcatgccttaatccccttggcaagcagaggcaggcagagatctgagttctgtgtggtcctcaaagcttctaacacctgtctctgaaacttgtagctctagttggttagaaacttgctgtataccccagactggactccaactctcagagatcctcctgctctgcctccggaaagtgcaaggattaggggatatgcaaggccaccccatcccaaccccttcttccaatttttttaaatcaacatatgctagttgtcattgcctgtcagcctgagtggcttaagaagggcctgggacaaatgaagtcaccttgatgtgtccttgaggctctgggctggcttcttctgtgattttctggccaccacgctgcctgaggggaggaaagagataatgactcccaagctaaggtggactgaaggaaccaaccagggtaggaatgtggacaagccactaacaactgcagccagcctgcagccatgatccagaaaaatcgtgataaggaagtctgaagtggcctcctaaaccatagacaggctgatgcagcctgtaaagtggggtgttctcctaaactaaggaacctcccctctgccaggggaacttccacccttccggataaggctgcaaccatccagcctccattgataattaccgccttaagactgcagaataacaaccccacaacgccctctgcccataaacccccaagggcacatagttctagttccctcccagtgattgtcaccctccattattcagattgaaggtcatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccctgttccattagacgttgaaccccgccccctgcccccactgcggcggctctgcctcccgccctccccctccccctgtcttctagcctctctcctaagaatttccgacctgtttcctccctctgtctttttgtctattctggatattgaatgccatgtagtaggtggcttttcgcatctggcttctcagttattgactctgtggcacgtatccttttcgtgggtagtgacaatccctgtttggttgttcaattgttggttgacagggtcacatcctgtaggaacctatagtccagattttttttttaagatttatttttattttacggtttatgcctgttgacctgcatgcctaggaaaggctgaagaggggatgggggaaggggggggagaggaggggagctgggtgtgacgtgatgactcaggtaattgagtactcccctagcactcacaaagcctaggggcacatttgaaggggggggggaacaaaacaaaacaaaacaaacaaacaaacaaaacatgaggcacggtggtgcaggcttatagttctcaggaagagtcagtaggatcataaattcaaagtcatccttggtaatatagtgactttgaggccagcctgggctacataaggccccgtttcaaagcacacacacaagaaaatatactctaggatcatttttaaaaagaagaagaaaaagaaagggaatgtgaaaaaaaaaaaaaaagtcttatgaacaagcactcccaggtcagccccctgcccttcattccagtcatttggggatgctgcagtcctatgtccaggcttcctcagcagtgtgccacaaaaccatcaaatgccggccacagagagagcagcctcagtctccaaggtcccgggaggccctgtggtctgtctgctggccaggcctcttttccaagaaatatccattgattgaggcgaaggcgccaagttcagccaggttcgtgccacgggttctggggtaagtacccttcagggtcccaaggttaccagccccatgctcacctcctgcagaatcagaagaatgctttcagggtctcctttgagcaaaatattttctgctcataaaattcatgcgtgtggggcaggagagatggctcagtggttaagaacactgactgttcttccgaaggtcctgagttcaaatcccagcaaccacatggtggctcacaaccatcataatgagatctgactccctcttctggagtgtctgaagacagctacagtgtacttacgtataataaatacttttttttaaaagtcaccagtgtgaccccagtatttggggatttccttccacactgtttgcattttttaaagtactaaaccaacattatttaaaagtcaaaaatttcaggccataatattggtcttaattgtttttccaccttttaaaaatatttagtggaagctgggcagtggtggcacacacctttaatcccagcacacagcaggtattgcagagtgagtctacagagtgagttccaagacactcagggctacacagagaaacccctgtcttgagaaaacaataagaaaatcagcaggggccgggcgtggtggctcacgcctttaatcccagcactcaggaggcagaggcaggtggatttctgagttcgaggccaccctggtctacaaagtgagttccaggacagccagggctatacagagaaaccctgtctcgaaaaaccaaaaagaaaccccccccaaaaaaaaaaaaaagaaaatcagcagggactggagagatgtctgagcagtgggtagctcactatgactccaggggtccagtaatgcctcttctggcccccacaagcatttacatgtgcacaaaagtacacacagatagcaaaaacaagatcttcaaaataagacaaaaatactgggcagtttgtatgtgtgaacgttttgcgtgcatccatgaatgtgtaataagaatgtgtgtggtaccctggtactagagtacaattgtgagccaccatatggatgatagggatcgaacatgggtcctctgcaagagcaacacgcgctcttatctgctgagcagacaactccagtcccgaccgtgtgttttttttgttttgttttgttttgtttttaagatttatttatttatttattatatgtaaggacactgtagctgtctttagacactccagaagagggtgtcagatcttgttacagatggttgtgagccaccatgtggttgctgggatttgaacttcagaccttcggaagagcagtcgggtgctctaacccactgagccatctcaccagcccctgaccgtgtgtttttaagttttgtatgtaaagtctgtgctaggtcagggacaaaactgagtgtttcccaaatttttgtgttgggtttcctcactttcccagtgcctcgagatgtggctgccttctgagatattagtgtccttattagaagagtgcgttaggggacaaatgagatgcctcagtaagtaaaggtgcttgccaccaagctgtgtgacctgagtagaaaaggactcagttttgacacagctgatatggacagatgcacaagagactggaagatgaaggaggctggaattgtggtcacctgctagctgaggagaggcctcaggaggaagccactctgcccagccttggcattgccacctagaacggaagaggagcctgtctctctgggttgtgtctgagaagacccaagtcaccgagtcaggaagcacatttgatttttattcaaactcacgtgttaactgtggtttttttccctccattggttggagtccaatctcacaattttatttgattggctagtctgtaaagaatttgtgcgcaggaaatgaaggaggaaagggagagaggtcactgttccaaagagaaaggggtcattgctccaggtcatcaaattccttcgttatagcagtggccttgtgcgtaaacacagccacctgccctgtccctggctgggacagggatggagacatttgcataaaagtttataccatgacttttgctactttatgggttcttctttcttccacccatcttcaccccttttcttccaccctttcaaagaaaagaagaatggaaagagatccctgaataaagtcaggggtcagaaaggggttgattccacaggctacctcctgctgtttagggtcattgagttccttggggcaagtttgatcatttctgtcaggatagcttacttgtttcttcttttggcaagactacttaacaaacttcaaccatcaactaatcttttggggccctaacacttccatatcctccaaaaagtccgcagaattccaaacatcacataatccgatctgcagctggcaaaatcatacccccataaagcaagaggcaaatcacagtcacctgctgcgggcagtctgaagcagcctcgtatcccacacccggggttaaaccaaaaacatattcttataatacttctgtgttttttttaaagaaaccaaaactccaaaattgtcactacaaaagtcttacaaagttggaggtgaggtaaaaagatttaaatcccttgtcctaaacacaagttttatagtatttgatagaaaagactcaaggcccaggcagccaaagtccatattcaaatgaggcattgtggcgttgttcaaataaaactttatttaaaaagcatgagacaaacctgggtttggaggagtggcttactttctaactgtattgattgtttttcgttagatgcagttctcactgtatggagaaatggtgataggttcctaactgatagtttcttttttttttttctttgcagggctcagggtggaagcaggacctcaaaaaatcccaggaaaggctctgccactcagtggtattcacaggccttgaccatctgaagaaaagcagactatgtagcagactggccataaatcctcctgcttcaacctcccaagttgctgggtctgtaagtgttcatcttcccaccactcaagcttttattttttaagaaagggtttcatgtagcccaggctgtctttgactccctaagtagctggagatgtcactaagttctgatgctctgaccttcacttcccaagtgctgggatcacaagtgtgcatcactgtccttggtctgtgtggtactgggatgagccctagggctttgagcctgctgggcaagaactcggatcattgagttacaactctagcccaaattttgtctttaaaaaatacttatttttagccgggagtggtggcgcacgcctttaatcccagcagaggaggcagaggcaggcagatttctgagttccaggccagcctggtctacagagtgagttccaggacagccagggctacacagagaaaccctgtctcgaaaaaccaaaaacaaataaattaaaaaaaaaaaaagtcttttcagggaacatcattctagaaacttcttgtaaaatcctgataagcaagttctgacttcagtgatgaaatgagccaattcaaaccagattaggttaggttatataaaaggcaggtttatagggtgagttcactgacccagaggaccgaggccaggaaagtctccacggagagagagggttttgtagtaagaggcaagaaagggcatggtctgagagggagagggatagagaagagaccaaaatgtctggattatatagggaagagcctctaggggaaggacagcccagcccctggcctggaaagttaagggttgggggcagggtatgccaggtagggactcagggatgctgggagaaccgggaaggccagttttactttgatatgtaaaatatgagcctcagtcccttgggggagggggtgctaaaccaaacttttcccttcaggcttttaatctgttaaactttgatccggaagtggtggggcacgcctttaatcccagctctggggaggcagagacaagcagatttctgagtttgaggccaggcctgatctacagagtgaggtccaggacagccagggctatatagagaaaccctgtcttgaaagactgaaaaaaaaaaacaaaaaaacaaaaaaacaaaaaaaaagaaaaaaagaaaagaaaaggaagaaaaaaaaaaaaacagtttgtattgatgtcagtgttgaccaacaaggaagacaggagccggggactagctggccactagtttctcacagtcacactggcattcctgacttctggcagtatgacttgggccttttgaggctttgtgtcttcctcagtctgtggggatggtagtgatacacaggaaactggagttaacaaggaaattcatggggaggccccaggacttgcctgtccacagcaagcaaccataaccagtaagttatggttgctatggtgactacgctgtgagggaacttggaaagatggataggctttgcatctcggggcttccgatatacagggggacagttagctaacacactcaatcacacagagctgcttggctgtgttttccccgtctgtaaagtgaggcatgggtccgagggcagggctccctagtgtttaactcagaaaaacattccttaggctgaggagatggctcttgtgaaattaaagtgcttggtgcacatacaagggccagagtgctggccctcaggattcactaaaggctgtgcagactcggagggtgcccgtagccccagccctgacaagctagctgaagtggccagctccatgttcaaagacagaccctgccttgggaaacggagtcactggtgatgtatttgaccaaatctaccttttgtgttagtcagctttccaaactgtagcacaacccccggggaccaatttgcaaagaagaaaggtttgggttcgcctatagacacttttgtttggtttcagaccccagggaaagagactgagatgtgtattttacacatcaaaggagatctggtctctaggttctcccagcatccctcagtccctacctagcataccctgcccccacccctgaactttccagcccaggggtttgggctgcccttcctcaactgtatactccagacattttggcctctcttcttccccctccccctcctcttccctcttctctctctgtgtatgcatgtcctttctctctttctcttccccctctgcctcctctctctctcccctaggtgacttcctgaccaaggtccttggaataagtgaactggcccgcccgagagcagcttcccaataaatttgcatttaattctctctaaactggggcgctggagagatggctcagtggttaagagcactgactgctcttctggaagtcctgagttcaaatcccagcaaccacatggtggctcacaaccatctgtaacaagacctgattccctcttctggtatctgaagacagctacagtgtacttatatataataaataaatcttttaaaaaaattctcctggtctacagagtgagttccaggacagccagagctatacagagaaaccctgtctcgaaaaacaaaacaaacaaacaaacaaaaaaaacaaaaataaaaaaaattctaatctggcttgaattggctcattttacttgtggagaactaactactttattggctgggagagctgaaggttctgggtggaggttggggaaggtggctggggagtgagatgaaatggagggggaaaaaggggggtagagggaaaagatcaggcttcccagcatcctctctaagtatacacctccaaagatctttctcataaaaggctccaccctcccttttttattctcaagacagggtctcactgtggagccctagttatcctggcctcaaactcacagagatctgcttgcctttgcctcaggagggagggctgggattaaaggcatagccaccacctaactaggctccacctcctttttttgtttgtttggggtttttcttttgttttgttttgttttttgagacagggtttctctgtgtatccttggctgtcctggaactcactctgtagaccaggctggcctcgaactcagaaatccacctgcctttgcctcccgagtgctggggattaaaggcgtgtgccaccacgcccggctaggctccacctcttaaaggacccagtagctctccatgtttccaaagaccagtgatcaagcctttaatacatggaccttggactaggacactcatacaaaccagttttttattgttgttttgtttgtttttgtttttgacagggtgctgtggcccaggttggtcttgaactcatagccattcttctgcctttggtcccagaatgctggaattcaggcatgtgagtctggttccttaacatcctactgttaaccttctccatttgtaggagtctctctttttctcctgctgagagctttctcaggactccctcccagcctggctttgcagtacaatccaggcctcctcccctccacctcagtgacagagagaagctctaggctgagtacaggtacagagggccctggggcagctgggagggtgtgagctcagtgctattcacttgtcctgggagctgagatggagctcactgccctgccctgcctcatctgggggtcttgctggctggttagaccctggagctgggagtttggtcttaggagcttggaactcctgggggcttccttgtctgtttctcttacagggggggccaggggtatggctggctctcccagcagtctgtgcctcctttagtcctccttcctctttttcacgtcctccttcccggcatccctccaggtcatatgaagatcttgggacactcgtggaaggtagccaagttgcttcatcagcaccgggcatctcggctggattaggtaagagagtgggaggcttcggagcacaaaatcccaacaggagcctttaaaggatgctgttggggttttatggaacaaggggcttggcacccaccgctctcagagagctgagagtgttcacatgtgtcctccagcagacggaggacatccggcaggggatgtttgggggtgggggaccaggaagctgtttgattatccagctgtttcagtctaaatctgttgcacatctggtggcctagaaattgcctgtgatttcatagtcactgacttgctgtctgggtttgagcttggctccagggaagtgggggaggaggaggaggagacgggagggaggagggagggaggaagggaggagggagacaatccagaaaagaggaagaagggcaaaggatgggggaaggagcagaggaaggaaaaagaagagaggcaggagagaggaagggaaaggaggaagggaaggggggagcgtgggggaggagcgtgggggggaggaggagtctaatttcttcacagggaaggacaagcttgcttgcacaaccagccactagtttcctccgttctgccaaaactggagttggcttgtgccaggtcttaacgcaaagcactgatttcctccgaggaaataggggccttggagatgctcttgacaaagatgatcgctccccaaacctatttcactctgtccttaccacagtagaatgttctgagagaaccgggggccagcgatggagccgttaccgactttcttctacaaacgctgagccagcagcagttccttcttaacaggatttggggaaacgtgtccaggcatgagtagggcctttgataagagttgtggggcacagagaagattaccatgtggaaagttctcaaacacggaaggaaaatccctcgcccctccaataggtgctaagcaagcagtagaggaggaggtctgcagtcccatctcagggtgaatgagttcgatgatggattgctaatgtctgctatggcagacagggccaagctggatgggtttgctgcttcacctctgcagactcaaacagctgcctgttggaaatatttagaagcagtaattgaagcagcaaatttgagatagaagaaagaaagttcgacccagaggtagtcttactttatgatttcttgtagtttctatggtgtgtgtgtgtgtgtgtgtgtgtgtgtgtgtgtgtgagagagagagagagagagagagagagagagagaaagagagagacagagacagagaccatgctggccttgaactaactgtgcagccaacgatgacattgaattcctgatcctccttgaagggactctagccagcttacacaaggcaagcatggctctggcaggccttgcccttctccccataccttctgcctcgctaaaaaacactagagagccctttcattcttgcctacacctcttaaataatggaattccaggcatgcaccacttcgccaggtttacatggtcctgagggattgggactcagcaccttctgcataccagccaagcacactactgagccacatccccagctctctccgccaccttttttttttccttttctttctttcttttttttttttttttttttttttgggttttggtttttggtttttcaagacagggttnnnnnnnnnnnnnnnnnnnnnnnnnnnnnnnnncacacacaaagctatctaccctgtctggctgctgcctcaggtatcattgtctgtcagggttgggaatcaagaggcccagacctgttggatctccctgtctcaggatctcctgcccatctgcctgagacagacagaggccggcaggacaggacttgctaatgagctgcacttagggtctaaattcccagaagtaggtcacattagaaactaagtatgaatgaggtacagtggcacatacctttacccccagcacttgggaggcagatctgtgagttcaaggactgcctggtctacagactgagttcgaggacagccagggctgcatattgagaccctgattcaaatataaaatataagaagttaaaaaaagaaagaaagaaagaaagaaagaaagaaagaaagggaagggataaagaaaagaaattgattgtggtttgtcctcacgttcttggcccacagggtcaaggggttaaacctttgctgggcagcctggccacagggcatacccgtagccactgtatatgctcccaggaggataaggcaggtgggtactagctcttcagacctgggactctgagaggtgaccagccttgaagaacttgaggggcctcagctcaggatccccaggctctttccgaatgaccgtgccgcagacaggacccggtcccaacatctttggagaggcgcactggctattggcaggcatctctttccaacctgacgtcagctgagtgcattcagcttcaaagtaactgcatgctttcttcccgctgacatcatttccaggaatagacacaccaattaccaccccaaaacccggtgccgagcaggaaatgaagtggcaaaggatgtgatgctgacgtgtgaggatctgtgcagtgcccagcaggcacgggcccctgtccatgatgatttcccagtgtagctttccaggcagatgccaacctgctgggtcagcagcattcagaggctgctgcggctgcggctgcggcacgctatgaacggggcagttggccttcctttcctttaagactggggtaggggtggattagtccaaggactgtgggagtaaaaaagtttgggaactgtttttgttttttgtttttgtttttttttttttttcgagcacaaggtttctctgtatagccctggctgtcctggaactcactttgtaaaccaggctggcctcgaactcaaaaatccgcctgcttctgcctcccgagtgctgggattaaaggcgtgccccaccacgcctggctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttagcctctgagtcatctctccagcccccagaaaactgttttttaaaaaattttactagccaggcagtggtggcacacgcctttaatcccagcacttgggaggcagaggcaggcggatttctgagtttgaggccagcctggtctacagagtgagttccaggacatccagagctacacagagaaaccctgtctcgaaaaacaaaaaaaaaaaaaaaagaaagaaagaaagaaagaaagagagtgtgagtgcttgcagtaccaccagtgcccagaagagggcatcacctgctggaatcccaggcagttaaaatctcccatgtccctgctgagaaccaaacgtgggtcctctgcaagaactgcacgtgctcttaccaccaagctatatctctagggccctccccaacatcttttttttttttttttcctttttgtgacaggcctcttgtagctcaggctggcccggccacccagggagtccctgtctgaaaattactcttattttctaatgaacacaccccacaaggacacacacagaagccttctctttcttcttatctctgatagtatctgccaaaagggagggtccggagtcttttttgtacctgccagacctctccgtggccctggccagcctggcacagaggagacaggaggaaggcagactctgactggctggggacgtagcaatatctgacttcctgcttcttcattctgggtgctttgtgtggccgcaggggctttctcttcagtatttctagaagattccctggcttgatcatactttttctcttgttcctttctccaaatgggttaccagcagacctcagagttccctccccagcctcacctctgttctccattcttccctcacacagatgtccagttgttctgaagctggtattgcccggggcctgtgccctcactgcccagacactcaccctttgccaacaggtacttgagtcgctagaccaggctgtctggtggcctattagagtctcacagagtgtctgccctgtggttgccctagcttctgcctaagactggggaaacagagtttcagacagaggagggcaaagctgtgtcttggtggagatcaaagctccacttgatggagcccagtgaggctggatgtcttggtgatactgttctaccctgggggctccctgagtcctgagccagagactcataagtaaatgctgagcgaatgcatgatagctgtatggctgaatgaggggggagtgggagggggagaatgagggggggagatctttcccgggtgagtcttgcctcttgggcccaggactagggcttcctcacaaagcagagtggagctaaagtttcaaagacaaccttctacacaaatgaacaaccagggagagaaaaacaaaacaaaacaaaagcaaaaaatagcaaaacccaaccaaccaaagaaaaccaatggatgagcaagactactaggggagtgtgtgtgtgtgggggagcttgtggccaaacctgccgacctgagttcgattcctggaacacttgtgctggaaagaaagaaccaacttctcaaattgtcctctgacttcatgtgcactgtgcccacgctaaataaataagtaataaataaatgcattttttcattcagattaagagaatgagataatgctgagctttggggagaaaaatctgacaagaggaggtcatgggtggaagcatgaaaggtccactgtgaggtgaggatggggtttctaccaggtgaatggcagaaagaaacctgtgggttagaggagtggaccccagggcaggaggaacagcacatgcgaaggtcctgaggttgatggaggcagctgtgttgagagcagagaacactcaggctgtaaccagcccccagaccacactaagacggaccccacattatagacaccgttctgaccttaaaacctatgatgcagacctgggatgacaaagccagagggagccatgctatggggaccctgcgatagctaatctccattgtcaacttgaccatgtccggaatcaactaaaacccaaactcctgggaaggattatacttgatgggatcttttcaggtgggaagatccacctcaagtgtgggccatgccttctggtggcagcccacatgaacgaacacagaggacaaagaggaaaaggtttgctttttgcctctttgccttgactcttgctggcaagttcatctgttctgttgctgaggcgtgcctttgctggtagtagaaccaattccaatgcagaccaacctgctgagacattcagcctcctgggttggacagctaccaggtattttggtcttgtgaccaggagacagcctttgttggacagccaaactatagcccataagccattctaatccatatccatatatacatatatatggatatacacacacatacatatatgtacgtatatacatacctatgtacatacaaacacatacatacacacacacacacacacatatatatatatacacacacacatacatatatatatatatatacacacacacacacatatatatatatacacacacacacatacatatatatatatacacacacacacacacacacatatatatatatacacacacacacatacatatatatatatatgttgcttctcaaaagcagtggttctcaaccttcctaacactgtgaccctgtaatacagttcctcttgctgtggtgacccccaactatatttaatatattaaaattatttttgttgctacttcctaattgcagttctgctaccatgatgaatcagaatgtaaatatctagtatgcaggatatctctaatatgtgaccccaccccccaaagtggtctccacccacagattgaaaactgtgactagccaggcggtggtggcacacgcctttaatcccaacacttgggaggcagagggaggcaaatttcttcgttcaaggccagcctggtctacagagtgagttccaggacagccagggttatacagagaaaccctgtctcaaaaaaccaaaaaaaaaaaaaaaaaaaaaaaaaaaaaaaaggaaggaaaaaagaaagaaaagaaaggagacaattgtgactaataatgaaccctgactaataggggctgtcactgtgcaggattcaggcaacttcctgccagtctttgtacttgccacagttgtataacacaatggcttgtatcgagccaaggctcagagaggttaattcacttgcccaagtcacagagcctgcacatagcaaaaataggatttgagtatgggtctattaaagcctgacccattggaggacaaaacatgcatttaggagtgagaaaccatgcttggggcctggagagatgactcagtgggcaaaaccacttgctctgaaggttcaaggtcctgagtttgaatcccctggcccccacataatgagacctggtcatgcatttctgtaatcattctcagtactaagggtcagagatgggtgaatcccgagagctctctgaccagccagcctagatgaagtcttgaattacacacacgcgcgctcgcgcgcgcacgcgcacacacacacacacaggagacatactacacatgcagagatgacatgtaaaagactaaccttgagttaaagagaaatgctggatgtgtatagtaactgcctagcccagtgggaggccctggggttcattcccagcacccaaagataaaaccacaaagagacagcaaaaggaggacactggccctcaaagggctgcccactctctggaggatgcaaagccttctgggaccctgccaaccactctcattaagtgacctctgacttggtctcagcttttattattctgggacattaaaatcagtttaaggtgacccagatctggagcagggcgcgtcaaggcaatgtgggatgacaactgagtctcagtgacctctgcatgaaatcaaagatgttccccagtgccgccccaccattccccagccaacgccgccgctaccaaccccgctgggactgattattagcgggtgtgcatgagtgaatttcggggtcacagtggctaatcggatccagccaggctgaggcaggtgacccgagctcttggataaggagattaatctaaatctgtcagagaaggcatcttctcagggcggcttgggagccaggaagctgagcttgagagcccctcttcacgtacacagcttctgtggcatgtgcaaatccatcactgaggccaagcccctacactatgggtcgggaaaccccgattgcaaagcacctcggggaaggagcagggaagcagggtatgtgtatgcgtgtgtgtgtgttgaactgggccaccttctgatccatgccagctgatggtctttgaacagagcctggtccagtctgggttggggaccatggctttgcctggtggtctgtgtgatgtcattgccctatgctgagcctgagttggccaactccaccttggctctgatgttttatgcactttgtgttttcagctttctcagccctgtaaagtcaatggtcagcatggttggctgactcccgtttccctaccaagataatggctgacatccctaggactgcaagcagaatcagatgtttcaccaggctctggcactgcccacaaaggggtcactgggtggtggtacaagcagccgggaggcctcagatctttctagaattatttggttgttccacccacgatcatgtaacccaagagtctcctttgagctatgggtggcacacacatgcccagtactgatgagtccttggaaagagccacaaatacacctttttcctcacggccaactcgacttggcccttaattcgacttttcccaacttcttggctacttcctgaggtgggtcatggtcaccatattttcaggagagaaactgaggctcaggcatgggaagtgggtaccaagctgtagaaccccaggagggcagggacacaaaggatggaatggtcaacagagtcttcaggaaccggaagtctggaagtagaagcttccaggttccacttgtcaccaagccccgagtcctttgctcgattttgcttcctctgcttgacgtgtggtccaggtttctctgcatggttccaagaaggctgccatagctccagacatcacagccagaatccatactagaaagaaaggtggaccagttaccgatgatgtccatggactcagtcatgtcacagtggctgcaaacaaccacacgttattggatttttagtctttctgatgctgtgagtttagctatttattctgtcccatgggcattggctggggctatttgctaaacagctgtgctgtgctggggctgggaggttgaaggaggcttagttttgcacacatgtctaaggcctcatgtggcttctctggttgtctaccaggagtttcctcacaggtggccttatggccatttttcatggcaactggcctctcctctctaagccctagccagaaactgccccagtattccccacaccacaaaaaggtatctacacagttctgactccaggggagagagtcccttttctctcttggtaggactgtgggtttgcagcgaaagcttaacttagtaggtctgccttgtccaaaccctgaacattccaaaggaaagcatgtccctgccgagtctcctggaagataacctcccagtccccagacaaacattgtgagggcctccggccttgtatttgagctgggtctctattgtaggtgagacccagtgactaagattggtagtctatgcccatgtgaccaactctcaataaacatcatagatgccaaggtcaggtggcattttctgtcagcaatttgtgtctcatgacaaagccttgtgaactcagctctcggcccattgtctcccggactctgacccttgtctttaatcttgcagcgtttagtctgagccttgccaccatgataagccatgggcagcttctaggtgttccttcagtcttttctgatggtttgctgagcacagctggttccagtcaccttcttcggaggtggtctacaatcaaaaaagtgatagcaggagattctagccttctcagggtgctcctcccgccaggacacatcccccaggcttctctccaagcctcccttgcctggacgcttgcccagctttgctatcttaggctgggtgcggctaaatggtcacagtaatctactcccaggactgaacattctcagcaggagctggtgagaaagataagccggaggttttgaacgtgataccaagagagagttagctttcccagaggaggagaccaaggccaagagatgtcaagagctatgtccaaagtctcacagtggatggtagcccaggtctgtgtgactcaaggacccagacattcaggcagtgatgaggatggcaagactctgtggaagtaggccgggccaccagagtgtgtcacaggcggccatagaagggaggggacacggctgatggcattctcagagttctctacattcttagagggctggagagaaaaaaatctttctcctctatgaagagaagctgacattgacctgaaaaaatgtttatgtcacatttatttattgatcggggcagcagcaagcgtatgtcacagcacacgtgtggaggtcagaggacagcattctggaatccattcactctctctgcctcgcccagcaattgaactcaggcttggcagcaggtgcctttactgggtgaatctcaccagcctggcattggctttggaaaataatacaagggctagctagggctgaggggcctgggtttgatggcagcacgtgtgtaagaagccaggtgtgccctggtgctccggagtgggtgggtagcaagaggctcgaaggagcctgatggccagccagccccaggtctcagaggaagaaaaaaatgtcttaaaaagcaaggtatgggattagagctttagctcagtggtagggtgcatgccctaagcccctgggttcagttttttgctggggggggggaggaaaagaaaaaaatcaacttaactgggactgatgggtggaatcacaaatcaggaacttcctcagaacctgctctcaggggatttaggaagaggaaggagaaggcatacgggccgtgggctgagccattgcctgatttgtgtggagtggctcaccctgacccaccagggaagacagactgcccctggtgtgctgccccatcagaccctggctaactagagctggaagaagtcaagctcttctagagttggttcagggcccagttctccattagcagcaaagaggggcagggggagttggggatcgagggtagggtggggtggtgggagacacttgtccctgctgttgaggtcttggggtttcagctgaactctctaaactgacaagacctatctcctgcttactcttctttggaggcctgcttctgcaaaggagcctgggagctgtagtttttaaagctgtagttttaagttcttcccgtgccatcccaggagaaaggagaaggaagagaggggagaggggagaagagaggagagagaatggctcagtgcccttgctgaggagggcagggccaccctttcctcagagcatcttgtccctcctacgacctccagatggaggccaggtgtccccatgtccccagtatcttgcagggtcatggaccacagtgtggtgccaaattgaattgaatgctggcttccctcccaggctggtccccatcactaccctctggacagagtccctgcagttcaggacacaagaaggtcacctctttgtcgtagagaaggtggggagggcatatggtggagtggttgttagcagagtttttggataaagctggggtgaattaggggctcaacatggctgcctgtctcaacatgcaaattagaaagaggcttgggcaaagacatagacaatgtctttgtgtcagtcagtgtggctaccctgggaagaagagattaaaaaaggggatttgatgacgctaggtttatctcctgacggaagctttcggttagattagaggaagatttggtcaaggggctggcttgtctgtgagttctgatgttcctggtatccaaagcggctgcaggtttagggtaagagggagaccttcatgtccctttgtcagggctggaggtgaggggtgggggtgtggtgacagtctggagcaatgcattgtgggagatgaactttatctgcctcttcagtctcaatttttgcatcttcagacttccaggccctgagctcagccagatggacggtgtcctgagggatcaacacactgagacaagcaggagtctgacctcaggcgaggggacaataccgtgaagacttgagcacagcacgcgggtgcacctgttcagtctgagcactcagggccaaatggatctctatgcgtttgaggtcagcctggtctacatagtgagctccgagacagcccaggctgtagtgagatgtatgtagtaagaccctgcctcaaaacacacaaaccaaaaggatcaagtaaatgtactctagcctgcttcctttaatagatatagtgcagctcacttaaaaccctcctttagggctggtgagatggctcagtgggtaagagcacccgactgctcttccgaaggttcagagttcaaatcccagcaaccacatggtggctcacaatcatctgtaacgagatctgactccctcttctggagtgtctgaagacagctacagtgtacttacatataataaataaatgaatctttaaaaatatttttttaaaaaacccctcctttagctggcctggtgaggcatgcctttaagcccaacagtctggaggcagaggcaggtggatctcttgtgagttcaaagctagcctggtattccatagcaagttcaaggacagccagggctacatagtaagaccccatctcaaaagaaaagaaaagaaaagaaaagaaaagaaacaaacaacaacaacaacaacaaaaacaacccaaaaacagtcaacgcaatactgtgggttagtgacaaagggccacaccagcagcaggtgacttcacagtcttttagttagctccagtacccaacacttagactcagtaacagctagtcaatcagtccggagctgtcctgcggtgggaggggttcatgcccagagtaaagtttctggcttgaagatctaattggacaaaactgagccaagccttcttttcctgtccagtcagaatgagagcagatggagaccaccgcacgccacagaatgacaggcagagggccctgtgtggacatggcctctgtacctcagttccctcgctgaacattaaagtgctgggatccaaggctgagctccccttggcttgaccccagtgcctgtgaactcagtttaaagaattcaaactggggtgtggaagagaggcacgtatatcacagagcgagtggagaacattctccaggggtggtagttttcagggtggggggcaagtgatcaaggcacccacctacccttcagacaggctctgtacaattcctaaggcccccagagcccgccaggttggtgtcatgttcaggggactgactggccattctgcatccactgttctgggaagggataatcctaacccatgttttttgtttgttggttggttttggttttttcgagacatggtttctctgtatagccctggctgtcctggaactcactctgtagatcaggctggcctcgaactcagaaatccacctgcctctgtctccccaagtgttgggactaaaggcatgcgcccaccactgcccggcctaacccatgttctttatcactaagcacactgctagataagggtcttgtaggatgtagacagttgcttgggtttgaatgactcgtaattaacagactcgggaagttctgagacgactctaccgtgggtcagaactgtgactcagagtccactcttttggcttctaataaaagtcctgaagttgcagctccaggttttcccaggggccgatgaccggggaggggtgccctatacttaccctatacccgcagtcactatctgaggagctagccaacattgtagaccatcagccactggtctcccttaggcttgcaacagggctgccagcaaccaacagaggcagcatatctcctatttccttttcagcgacagcaaagcaccttcctcttctctaaccttgggctgtgggaagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccagagaggcatgtttctaaccactgcccacccagtggcagacagtggagagcagccgaaacagcaggacccgagggcaacttccagatggtgaagggcggaccggggtaaagtcattgcctaacctgccccaggtttaatctccaaactctgaaaacaagtcgttttaggtcactgtgtaacagaaaggaggtatttaatggtgaagcgagaggaaagagagtagtaacccagggagggagggaatggaagctggcttggtggccaaggtggccaaggtgtttgacacagggcagctgagggtagcccaggaatgcgttgccctgtcccctctggtaaaatgcgggttctccgtgggtccggttgtctcggctgtccttagagaacgcgagtcgccgctgtcacaaaggcgcgggttccagggcggagaacgcggggtgcggagctggctgccacttagacacacgagccgccactaccgggagccgcgggagccgtgggtggtaagttagggtacacacagcgccccctgccggggatgagcagaggtgaggcaggaaccagccactgccaccataaacgctccccaaactcaaagagctatatgtgctctcaagcgactgtgtatttatttattacgtatccattcacttacagcacagactgaccttgaagtaaagctacagccaaagatcttgacctcatgatcttcctgtttccacctcccgcgtcactcaggccagcaccaccacgcccaccttttgttttctttttaaaacaaattgatcacgtcgtgagggtggctgaaccacagctcagttccccacaacactaagcacacagtaggcgcttgttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagcagcacagatgtacctgaggtccgttagaggctgggcaagaatgtgaatggagaacctggaattccacataggacctcgcagtttctgggacacagtgggcctaacaaccctttggggcttgtctgctaatgtccccactcctaagtgcctctgggcaggtagcattcaagttctgatatgataaaatgttcctctgggttgctggttgctggttcctgatcctagaagtggggtatgggtggggtaatcacagcgtaggcagggtttcaactctgttgtgtgtgtgggtgtgggataggtatgtatcagtgggtagtgctggcctagcctgcatgaagtaccggatatggtagcacatgcctctaatcccagcactttggaggtggaggcaggaggatcaggagatcaaggccagccttggcagcatactgagtttgaggccagcctcgactacaggagactctgtcccaaagtcaaaaaaaccaaaacagctccatcaggttgatcatcagaggcctctgtgcccctttcctttagagatgtgaggagaagggtaagtgacaggctggagccatctgcccaggtcctaataataaactggggagcggaagaagttccggtgcgatcggatcttggggggaggggctcttgttacacccggcgccatctgctgtgtccccttgtatgccaagctgtgggtggaaggggactatgggagggaggagaggcgcatgggtcctcactgccagcagggtggcccacttcctttttcctctctcattctgggcaggacattgcagacagaggagacaaagagagacggagaaagaggtgggcttgctggctttgacctccaggacccagtgtctaagcagaagggaagctcagatccatctcaatgccagtggtaggtgacaacagcttgtcactcaatgtcccttcaccctaccccatcatcccctaccccaccatcctaactttatagatgggaggccagagatagtgactttctcaaagtctcccagtggtgtaggacttaaacttaggaacctcatgacttctcaacccagtaagacactactccatcgagtttgacttgtcacctggcagcccagggtgggtctaccctacgacagacaggcacatgccatcaccccagggtgggcttccctttgtcctgggaaccccacctggagacttctctggtcacctgggcctcctctttctctatcttgccctgaagaaaaaatacagatggactaccactgtaggtcgtgtgggcatcctctttctctgtcttgcccagatgaagaaagtcaggaggaagggctcttcaggcctttcggaactttccgagaaggccagggagcagctcgcccaggcagagctacggaaactgaggcagcagttccgcaagatggtagacagccgcaagtccttcaacttccgccaccagcgtatgatcgccggccaatagtaagaggggtgtcctggtgtgggtctctagggtactgctcgggctgggggagtacactgaacccacctggggaccagaggcctttgatcctatgctctagagcttcacgggaagatatccagtgagcaggatccaggagtctaggagaccccggagtgggggcgggggtgggggcgggtggccctcaaccaagccccgtttttctctcagatgccccttgtctagtccaataagctgtagcagtgacggggcggggccgaaggatcccagaggggcagggaatgttctggtgctgctgcagcagccttttgcaattgggggaacctgtctgtaagcctctttctgcatgagcagaagccagcctccatcgaagaggacctcgctgtcgggatgtttggagttcaaagaagggcgggtgcgaagggatctttcctttcccatggattcctttactcctgggctaggctggttcctactctagtgtacaacactgtcaaattttaaaaggcatttgtttttccagagcactttagcgccctctgttggaaaagcgctcattatgtagaacaagacaaaatgttttgggttggtaagaagattcagctagtctgatggcctgagttcggtccaagagacccacaaggttagaaggaaagaactgacttccacgttgtttcccgatttccagatgcacagggtggtatgctaacacccatacatatgttcatacattcatgcataaataaatatatgctgacaaacgaaagtggaccctggagaggtggctcagcagtaaagagcacttgctgctcttgccccagagaaaggccttggccaagggttcaaggttactgtacacttccacgttgatacagacttcagagtcctcctccaggttttgttcatgcatgtgtacatatgtagaggtcagaggtcaattttcagtagctcctcagcagctgtccttcttttttattttttattttattttattttattattttttttccgagggtttctctgcgtagtcctggctgtcctggaactcactctgtagaccaggctgtcctcgaactcagaaatctgcctgcctctgcctcccaagtgctgggattaaaggcgtgtgcaaccatgctcagccgtctttttatttatttattttttaagattttatttatttattatatgtaagtacactgtagctgtcttcagatcttattacaggtggttgtgagccatcatgtggttgctgggaattgaactcaggacctctggaagagcagtcagtgctcttaaccgctgagccatgtcaccagccccatctttttatttcttaatgacatttttatttagtccttgtgtgtatgtacaaggctcgtgcatgggggtcagaggacaaactcacaggaatccgttctctccttcctacacgtggatttcgtggatcaaactcaggtagctggccttggctgccaccttcactcagggatccattttgcaatttttgcttttttttttttcgagacagggtttctctgtgtagccctggctgttctggaactcactctgtagaccaggctggcctcaagctcagaaatctgcctgcctctgcctcccgagtgctgggattaaaggcgtgcaccaccactgctagcagtttatttcttttcttttcttttctttttttttttagactgtttctcattagcctggagcttccagactaggtgtggctggctcgacagctaacttagggatcctcctgcctctctatcccaaacctgactgtgtgcataggtgctaggatggacctcaggtctacaggtttacacagggaaacacttcaccaactgagccatctccccggagccactcagtgaaggattgtgactggcaccagggcagccttcccctagggaaggaggagcaggggagatggagacaattgaagtcaggaatgtagggtttcagatctgaacctgagccccctgccctgaagttctcttcctctcacagggaccctgatcattgcctggcctcctttaggggttgggacaccctgtaggttttgtgaaggtggttttaggggctctcgggctaagctagagctccttcctgcagcaaggaaatagagactctgaaagctgaacaggccgagaccaccatgcttctaagcctcgtgaagtctccgaagaacctggacatcaaccagaaaaacttcatggaactacgcttcctgctgcagaccaagggggactacgaggcgctcatctcctccatgaaggtgctgctgggagaactggatgataaggtgaggaagcgtccctggaggggacataggggataggggacgccacagccacgatgccctaggcagagtggaacatcgaatgggagctcagctccgtcaaccccgcatgtcccctgccacctcaaggctcagaaccaacctcagtgtccttagcctcgggcgacaagggtaaggtttgggtgccgtaatgaatatcaccttgcgattcaaacaatgccagttcttccctcctccatgctgtgcaccaggttagagaggggggccgttatctttctgttatctttggattgagatggtgggtagcatctctctgggacactgccaggtgttatggcagaagaaaaagccttctgggaggtctcatgtgggccatgagatctacatgccattctgagcgtgattcgtctcttcaaaatagccccccgagaccatctatcattgctgcagccctcctggatgagggcgttgcctgtgtctctctgtgtcccaaccattcctcttagggaagggagacttaccctgagccattgtgttggaagtatgtaacgccttaatttatttgcattgacttattttttgaggcatgtatctatagccccggctagcctggaattcactgtgtagaccttgaagtcacagagatctacttgtctctgcctccttccgtgccaggagtaaaggtgtgtgttatcataccctgccatccttaccctctttttgtttctttgtaatactttgtttttcacggagtgttcatgcctgtgtctgtatatgtgggggcagaagtacccatgaaacccagcagagggcagtggatcccctggaactggattgttgagaggactgctgtagatgctgggaaccaaactcaagtcctccataagttcccctgggaacggaacttaggaccttgtgcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctgtgccacacccatccccttgtatgttctgtccccctctgccctgtcacttgggaccatgttgctaaaagtggctctgagaaatcttgtgtatgtcttactctctaaaattaatcaaaagccacaaagacatttttattttctttctctctctcccttccttccttccttccttccttccttccttccttccttcctccctccctccctccctccctccctctctctctctctctctctctctctctctctcttccttccttctttctttcaccttttggactgtcttttttctacccattcacttgctcttcttgctcagttaaccatccgttcgtccttccacccaccccttacctgcccctttgccacttgtgtaagcctctcttccgggtgcttggtatgcactgtttccatgaggtcctcaggatggcaccgaggactaggcattcctacaacactccagaatactccaaaaaaggcactcctgcagtccagagtggacacgtgtaacccagcccagggccacaggaactaagtggaagatccaaaattccatccaaaataggtcccacgagtcatcccctccttgtcttgggatgctgacaagcttcaaccttatctcaaggacaatgaaaagtcacagcaggtcagacattgcacagccagaagtctttagaaagatctagaaaattccacccaactgccatgcagaagacatcagaaagatgtcagacatgttcaggagagcctggcctgcaggctgagcaaggctcagaacttttggggttcacccagctaaatgagccttcctaagaactctctccccagggtgctccttaacctttacttgacctctaccctgctcctgtcacctctgcagagagaccctcccacccatagcatctgttgtgtctccctccagccacgagtgtgatggtgggtggatttttttcttctcttcccttggccatctctttggctctccatgtctcaaccctgacagcagagtctggtaccatgttgggcatgctgtagtgctctactaagtatttttaaattttatgttattttagtttctttgtgtgcgtgtggaaaggtgtgtgtgtatgcagggttttactaccaggtgttgggagtaaaggcctgcactactgtgcctggctcttgatctccttttatcattttattttattttattttattttattttatttatttatttagtttgagataggatttcactttgtagccctggatgttctggactcactctgtagaccaggctgcccttggacggtctgcctctgcctcctgagtgctgggactaaaggcatgcatcatcactgcctggctaatcattttatttttaaataattattactttttttgagacaggcacagtgacacatgcttttaatctcagcgcttgggaggaagaggtgggtagatctctgtgagttcaaggccagcctgctctatacactgagttacacagagaaaccctgtctagaaaataaacaaacaaacaaacaaacaaaccaatgaaacaaaaccctaaccacttatttatttttctttttaagatttattttatgtatatgagaacaccgtagtatcctcagatgtaccacaagaaggcatcccattccagatggttgtgagctaccacgtggttgctgggaattgaactcaggacctctggaagagctgtcaaatgctcttaagagcagaaccatctctccagcccctatttatttttgtgtgtagtgtttatgtctgtaagtgtataccacatgtgtgagggtgctggctgaggccagaagaggttgtcagatctcttagaatggagtcataagcagttgtgaaccatcagttaggcctggccgtgaacttggattctctagggtgggaggtgctcataactaccgagccattttgccagtcatgccttggtttttgaaccaccgtcccttgcactggagagtactagtactctgctggccggctgctgaactccagggatctaagtgtctccacctcccaggctggggttgcagggacaccatcgccaccttcactcagtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaccgaggatttcctggccaaggaggagaagaattttgctcgtttcacttatgtcaccgagctcaacaatgacatggagaccatgcacaagaagacccagcggatccaggtgtgtggctttcaagggttttccccgataccttagtctgtgctgtagataatggccacaacaggtttcattaactctggactgttagctaggaagggattttttgtttggttggtttttttttgagacagggtttctctgtgtagccctggctgtcttggaactcactttgtagaccaggctggcctcgaactcagaaatccgcctgcctcttcctcctgagtgctgggattaaaggcctgtgccaccaccgcccggcccaggaaggcacttttaaaagtagttttatgtatatggatgctttgcctgcatgtgtgtctgtgcatcacgtgcatgcagtgcccacataggccagaagagggcaccagacccccatctggaattacagatggtatgagctgcccccgtggttgctgggaatcaagcctgggtcctctgcaaaagcagccagtgctcttaacctctgagctgtcactccagcctctcctccttggcctctgagacaacatctgtcaatggggttttgagctcaaccattaattgaattatgccatctaggctgtaagcccctagggacctcctgtctccgctcgggagacatactggggttacaaatgaatgccatcaggctggagagatgacacagcggttaagagcactgactgctcttccagaggtcctgagttcatgttccagcaaccacatggtggcttacaaccatctgtaatgggatccgatgccctcttctggtgtgtctgaagacagtgacagtgtactcacgtacatgaaataaataaatcttttaaaaattatatctaatatattaatcaataatacttataattaattaataacaattaatagttatataatataatacatatactatatagcaaatacattacatacattatataatatattacatatattatatctatcatatattatagattatatactacatatatcacatatattatatatacatatataaacacaaatgtatgccatcacggccaggtatttttttcaggtgggttctgggaatgaaactcaggtcccagcacctttgttgaccaaaggcttcagagtggaagggacgtaaatggtcaatgcttaattctggacaggcctggtgcccatcagcctagtaaaggctctggccagtcctgaaggagcgacacttggctaccttcactgaatctgtaatttctcacacctacctggctcctgggcctcttcacatgaacagcttctggaacacttcacagagtccaaaccacgcgatgccgcatgccagtccagacaggctgactgctgtctctatggctcagaaccaggaagaacacccagcgcaccagcagatgccatgcctagccgtgccacgcccctcctccaaggattccctctgactgagccctgccctctcctcctccgatgacatcatgaccctgtttcttcttgtgtgggtatggaggacagagtacattggaccttttccttaactctcctgccattctgggagttctgtcctatccagccaggtctcgccacaggagagccgcggttactgatgtgcaccgccacagcggactttgtataggttgtccggattcgaactcagggcctcacacttgcgcagcaagcccctcacccacagagccagcccctcaggagacaagtctccctctagcaccaggcttcagccttttcctgaggcccattgtctcaatggtctgcgagccacggggagggacttagcgactcttcggcctgacgtcactcctgccaggacagttatcctagagacttggctgctttcttgctttgatgcatttttttttttttttttttttgagactaggccttgctcagtagcccgcgctggtctgcaactcgcagcaatcctcctgtctcagcttgggggatgctgaaatttcaggcatgagtcattagaaaacttctctgctcaaactaggattcaggtttttaagttttttggttattttcccccctctggtacacccagtttcatccctacctaggaacgggggtcacaggcccgtgttctctgatatattaagatctgtaatggtcaacatataaagatcaaagtgttcttttttttttttttttggtttttcgagacagggtttctctgtatagccctggctgtcctggagctcactttgtagaccaggctggcctcgaactcagaaatccgcctgcctctgcctcctgagtggagggattaaaggtgtgtgccaccatgcccagtaaagatcaaagtgttctacaccaatccccaaacttttgtttctctggggtacatttgtgtaggccacagtgggtcgtgagtgtgtcgccactgccccctagtggttgtctgtggaatggcaggaatgatttttgtggtccaggctgctccaggacagagcatatccctagtccctgtgggatgcagatgcacatggatgaggagccctgagtgacctatgactggagtggaaatatccacacttgacccttgagggcttggtataaggtggacttgccctctgtgggcctcagtttccccatctgtaccatgatgttgggaatagcacaggaaccccaggcttcttgttttgtttgctttagtgcactgtaatttagaggttggagcccaagtgtctgttggggaaattctccaccccaaactgcagatgtccaggtcctaaccagcagttagccatctgtgtgtgagccatcatcccccactagtgaattcactatcagtggctgacctgtcacctcttagcaaggttgtcccctcactggagtggccacctgtgctgaaatcttccattatttccacctgaaatggcacccgagggtgggaggggctatgtgaaggagcttggacaagctgtactgggaactagcctcgctccagtcctggaacttggagtgagcctggtcatctgaaggggtgactcagattcttgggagagtttgagggaccctagactgagctgccaggtctagtgcagtagccactagttgtccaaatatattctttaccctgtaatacaagagaaacttcagctgccctgtctctggtgccatgttgcaagttctcagtacctaggcgtggccatgacatggcgcggttagtgcacacaggatgtgagagatgatgctgacttctctttctaggtggttctgagcccgtgtggatcatgaccccgttgggggttgaatgtttctttcacaggggtcgcctgagaccattggaacacacagatgtttacattacaattcaaaacagtagcaaagttacagttatgaagtagcgacagaaataattttatgtttggggagtcaccacgacatgaaggaactatattaaagggtcgaggcattaggaaggttgagagctgctgcactagatagttctagatgattctcagaggatgaagaatagaatgcctgaggagaaggtggggacaggggcgactccttgatgggttaccccacatggagtagggttggatacagtggatgagggcaactcccatcttctcctactggttctcgtctgtctgagcaggatgacatcatcaacttgcggtcacagcagcagacctcccatgagggcacccggagcatcctgaaacagatggaggtgagctgagaagggtaggggtgagggggaggggaagagacagggacaaggagcatcctgcatgtgtccgtcatctgtcagatggcctgttcagacacaaccacagaacccttgtctgtaagctctgtttattgtacaggtgctcggaggtccaacctaagcctgggactgcacttccattctgatgcatctctgcctcagtttctccttttgtctcccccttggctcagttccactgtttttcactaacgaccacaaaccaacagtctgtcttctattctttctcctcccctctccctttctgtctatgctgggaatcaaacccagggcctccagtatgttagttctgtactgcaccactgaaccaagcctacatcctgcatgcaaatgcgtcctgggctaggcactagtcagtagatgccaggctatgtccactcctctggccccatctcccttcaccaccttcaggagaaggtgttatactctttccattttttttttcagggagcaaacagaggctggcagaggcaaacagtacaatcaactctagggagccgagttgtgggttttttttttttttttggacatggtctcactatgcagccttggtgtctagaattcactatgtagcccaggctggcctcaaactcacagcaatcctccttcctttggctccccagtattgggtttgaaggtttcttcctgcctcccccgccccccagacaccctgggagcccgagcaagctagaagcttattttttgttaaataagctgaaaattggcactttcaggattgggggagggagtgtctttgtgatgtcatctaccacccaggctcttcttggtgtgtggtttccatcccaaggatgcctggtggtaccacggctcccaggaagaaggttggagagtgtggagaaggccacactggctgaggcaggaagccccagttgcttctcaggacacttgaataatgactctttatggggtttgtgtgctcgtcacactgccatcccagggcaaacaggttctccggtgacagtatctgggcaatgaacagccaatgctcagcaagatgtgaatcccgcccctgactggctgggtgtggtgcacacatctttgattcgcatacttaggaggctgaggcagcaggatctggagttaaagggtagcctgggcttttcctgttcagaatcatagctccttcccctgagcgatttttatttgttccttggggctcattttcgtccttcaccctgaccaggctggtggtgctattcgtggctctaccgcggagggacagcaaagcccaggaagagcctaggaaactcagagccaaggggtgtcgggaagggaagccgttgtgattcaggctggtctccgcaggtggtctccagcctagatccacaggctctacttgggggccacctagaactcccgactcttccctgggtttgggatcaacagtgttcatcagggtctcctctgcctggctctgtctttattgttttatgccttcactggactgtggtgctagctaggatagcattgtgtctgcgcgcatgcgcgtgcgcatgcccacgtatccccctccgaaatacaaataccccaaggaggagacttcatccaaggagctatgggttctcagatacgtcccaccctgctaagggctgtccccaacttcctgcttagaaccctctccacccctggctcttcaccatctcctctctctccaggagtccgggttcggcactctgaggaatcacttagttttgatacagggtctcatgtaccccaggctggtcccaaactcactacatagacaaggatgaccctgggctcgcgtccctccttgcccccatccccagagtgcaagatttacaggcatgcataccactcctggtttgcgcaagcactccacgcaaggaacccccatccttagctgtctgtttttttcttaaatttgtttgatgctgtcaggaagctcattccttggatggcacaccgcctgcccccgcccccccgtcacttgcacaaaaagtccctcagcctcaggctgggcctggtgtctgtctgtcccccaggagaaactgagaaagaccacgcaggaagcggacatttatgagaccaaatacaaggagatgagcaagaccctggagtatctcaagaactcggtggagaagatgtttaagaagatcaactgcgatgccactgagatcctgggcaagctgggcgagtccgggaaggtcacggacatcaatctgcagcagtattttggtgagcctagtacctcttaggcactcttgcctgcacggtctgtgaccaggcacaagaacgctttcttggttggtagtgagcacagccatggtgcggcctgccttggtttgaattctgagccttcacttactagctgtgtgacgttggccacattcccgaccctctctgtgctcgggttctttgagctctgaaatgagggtgcaactcaggagctacaccaccggatttattgggaggattaaacacgggttagttggtggtgaatctcagtgaacccaggagaggggtttggtgaattcccttcaggagaaaaactaaagctagaaaagagagcttccttacacacattcacaaacaccgtaacacttacatgttcacacacacatgcttacacggatgtacacacatacacacacatgtacaggcacctgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcctgcacatatatgcacacgcatgcaaacacatatgcacacatgtatgcacaaagtgtgttcatgcagacgtatacacatatacgtacagaggctcacatgcatgtgcgcgcacacaccacgcttttcatatctgagccccatgggcttttttctccaagattaggaagaaggcaaaaatgactcctgttaagcttattcagttctgtacctgtaggatgctttgccaaagcaatacagcaagaaaaaggaactaaaaaccctgattgaaaggaaggaaatgaaatgttcagagtggggctccggatatgtcacagacgcttgtgaaactgccttctgcatttccgggtttagctcccagttcagggtacagaggggacatggccacccagactgtggtagcttggcatgaatggtaccggctgttcttatgagtgtgaatgtgtatgtgtgtgtgtatgtgcacgggcgcgcagagagccgagtttgaatcttagcacccaccccaggcatcccaggcagaaggaatggcataaatgcaggctggaaaatcaggctactgctggctttgatgtctagtggaacactggtttttggccttctcattgtcaatatctagggaattctttttggaccatgttttcctagaaactgtcactcacagcgctttcagtgcctcagatctaccgtgtgctcctgtgagcagctctgccaatgtgcatcagagagatttcggtgcctcatgatgtcagaatttcccacacccacggcccgtggccaggaggaagccagcatcctgcacaaactcccatccctccctctgtgataatgagggctgcctgggctggcggtcttaacccttgaccccctgaccccgttttttccttccagctatcatagaaaagaagacaaatgacctgctgcttctagagtccttccggcgcctgcaggaggcagaggggcccgatgtcgatgtcccacaaccctttgtcaaccccttctggggcggctctgccctcctcaagcccccagagcccataagggttgtgctgcctgtgtttggggcagactccttcagtgacaaacttgaagagggtgagttcttgccctctgccacccaggcaggccactgggtagggtcccttaaggaccccaagtctctatggggtctgtgggcctcagtttccctcatggccacgaatcatcaccacagtatagccacttgtttgaacaaaatgagaataggtccttagggaacaatagggtcaggaagtgggaacatgttcactgcagccccaaactggaaattagcaaaggaccctacacacacacacacatacacaaatacaatgacacttgtatatacacatactcacatacatactcataaacacacacatacacctatattcaaacacatacacactgacacataaacatacctacatacatatacatactcctacacacacactcatatacatgtatacacatacatactcacaatattcatgtacactcttacactcatatgcacatactcatatagacacacttatacactgacatacatacatactcataaacaaacacatacaacatatactcagacacatacatactcacacatatactcatatacacacacaaacacacacacacacacacacacacacacacactcttatacacacgtgcatgccacgcaccattcacttagtcagaacttacccaaacacataatggagtactatgtagccactaaaatgtatgttcccctgggtagcaatggcttagcaatcaaaccgaggctgtgccttgcagcttggtctgtgggtattaaaccagctatgtctcccattcgtgcatgggaatcccctgagggtgcttctctgcttggagctctaaagggctttccaaccggtgctcagcccagcatgatggcgtgacactgtccctgggaaggaagtgagctgggcaccaactcccagttcctcacagagcttgtcctgggtgcagtggactctcctctggaccacagtaccctccagcagatggtcttggagaacttccttcagagggaacgcacaaaagaactacaggacaccatgtcagagaagggggacgagataaggctcaagaagaaggtgataggctgagcctcgtgggtgcctgtattccacaccagagagaataaatgttttcttgctgatcctagggcctttgatgtgctgtgctgagtagctctgcaggctgcaaaccagcttagaagtggggtgaggggcgagaagcatgggcctcaagagtggcccgaggtctatgtggcccttgataaccctgagaatgtggccagcactgcctcctactccctcacccccacctcccacaactgacaaggtctgccggatggaacagggcagtttagggggtggctcatgttgaaatattgatctcagactctagggtctactggatgaggcagagactgggcaggaaccagggtcttggaagctgagaacccctttgcctgtgtgtactttgggagtgagtgtccccacagaactgagctgggtcctgcaggccttgctgccccctctctagagcccaggtatctgtggtccccagcctcagtgtctctggaagagcccctagaagacactcccagaaccacaggaagggtatgggtcacccagagtttgagggttctgatccttcaggaccccatcccttgaaccgcagcttcctgcaaggggcccacatcggttgcagggctggatctgaccctgggtgtgggaactgtgggtttcttctctctctcagacagggcctcgctctatagcccaggctagccttcgatgttactaatgcttggttctagtgattctcttggccttggcttcctgattttagtttagctatggggactcagttctaaggttaagcaaaggcccaggtcaggggagccaggaactgtcactgccggtgtgttatttttattcaggatctcattatgtagcccaggctagcctgaaacccactatgtaaagcgggctaagtctggaagtcccagagatccatccgtcttttttcccaccttcaaagcctgggcccagaaagcaaccagagctaagggaaggccacctggagagagtgacagaactgccactcctggatgcagatgctcctgaagtccgtggacttcttggaactgactctgtagaccaggctagcctagaactcagagatccacctgcctctgactcccaatggctggagtgtgccccccacaaagtgccaccactgccaggtggtgcctgtttgctgttcaaactgagatccctgcagccttcacagaacccaaatactttgtgactttggctacttagagccaaatgagccaatggtcaccacagccagagccaagacttcctgtttatttgcgcacagccctgggatggagagtgggctgtgggtcacctgaggctgtggttcagggctcagtccttctcttctccgtgggtaatgatgtggaccaaattcttataatcaagattgccggtgacgtcagggggaaaggctgcgaacatctggtcgatctgcaagcaagagtagtgggattcagagatcctcagaatggcaaggggggcgcagagtgggcctgagatcctgggaaggaccccaatacccccagccaggctgtgactgctgtcagcaggacttgaggtgggagggaagtcagcaggcccaaaagttacctctctctgggaactaagcccaggctactgtcctggattaacttctgggtccacgtgttcttgtgtcttcaccatccccacctttactcaccggggtgatctgaagtcccctagacctccccgcaacctcccagatgcccagcaggggaaaatggagatccagctgttgaaggagctgctgggcagggctatgctcaggggcgagagggcttggtggggactgtggctgaatgcacgcctgtgacccattgtggtcaaatggtcagagaggccgtattcttggagggaaaccagatattgaggtagcttattttacatgcagttttcctgtctaaaagtatttggatgaagttggatgtggtggcccacgcctttaatcccagcacctgaggggcagaagcagaggcagaggggcagaggggcagaggaggggcagaggggcagaggggcagaagggcagaggagcagagaggtagagagagaggcagagaggcagagaggcagagcggcagagaggcagagaggcagagaggcagaggcagagaggcagagaggcagagaggcagaggcagaggcaggtggatctcccatgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactgactctgtagaccaggctagcctcgaactcagaaatctgcttgcctctgcctcctgagtgctaggattaaaggcgtgcaccaccactgcctggcttaagcttttattttgtgatgggactttccaagtttcccaggttggtcttgaactcactttgtagccagcctgtgctggccttaaacctgcaatcctcctgctttagcttctctagtatatgggaccggcaggcctgagtcatgagacctagctggcttgaaccaaaagacactgtggcccggccctgtggtggcaatgggtattgtgaccaccatcaagccttgtggcatgtgacagcagatgtcgtcatccctccttgacagacagggagaccgaggtacacagatacagtgaggtcaaagacggaagtcccgtgagtgaggggttgatagctggctctcactagaaccactagggatgtcactaggtcgagacggggtgtctataaagggggctgggtggtgggaacactggagaccctgtacctcctctttggagaacctctctgcttgtgtggtcagcatctcccggacactgtaggaaaagagagagcagatgatggtgacatatgttgggggtgggaagtagggacccctctcccttagagcccacttactagtcagccttcagtgaccctttgccctcgggatcaaacaccttgaatgcgttgagaatggtctcttcaggatcagcccctgcaagagaagataagcccacctgtctgctgggaccggagctgctggggtcacaggaagtggacctaggtccccctgagccagaggggccaggacaaggttgcttcccaagagggcttgctgttctcgcaaaggaccagtacccacgtagaacttcagctcccagcaacgccaacttctctgcccttcacaggtattacacgtatgtgctatgcacacaacacatacacaacatagaaattaaatcttaaagacaacaggagccaacaggaagtcaaatgcaagagaggcctcactctgggacttttgtgggctgtgaggaggagcttcaagcaagttgctcctcagatgctctgaaagttgtctcaaaggtctcagtatgtggagtgcattagcctagggctatagtgagaggagtgggaacagcgccccctgctggaacagccccacccccagctgaagcaacggccctgatttcttttatgctattttttttttttaccttttattatgtgtgtggctcttttgcctgcatgtatgtctttgcactagatgtgtgtctggtgtccagagagagagagagagagagcattggacctcttggagactggagttaacagatggttgtgagacaccatgtagatgctagaaattgaacctgggacctttggtagagcagccagcgctcttacccactgggctgtctctccagctctcccatgctaatttccaatggttccttgttgagttgtgagctacccaccttttgcctatgtctcttctagggtttaattcatgcccagaggtgaacacgcgcatacacgcacatgtacacactcaaacacacacacacacagagtcacatgcacactctctcacacggaagctcacctttaagtttctccccaaacatcgtgaggaacacggtgaagttaattggacctggagcctctttgatcatttcatcgatctcttcatttttcacgttcactcgtcctggtgggagagacagaaactctgagccggaagcaggcagctgccaccctttttgaccctgcttctaggaagcataagggactgtcctctgtgtgtgtgtgtgtgtgtgtatgtatgtgtgagacagacagacagacagacaacagacaccaggacagatgtttccagcagtgttttctagccagatgtggtggtgactgcctgtaatcccagcactggggaggatcagaagtgcaaggttatcctgggctacatattttgaagttgaggctaacctgggctacatgagacctgagctcattaaataagcaagtgtcttcaggccctaaacctttcatgcaagttaatgctttggttgcaatgccattcttagtcagacctgtgagccctgcaggcagagagctcatacccagtctctgagggagctctttctgtcagacctgctgccgcccacagctgcacacaccccatgccagctttccctccttccaaagcacaaacgagacaaagccgaccccttccttcttaaaacgggaagctgcattagtcacaaagatgaactgcgcggtgcccaacccacagagctgttcgtcgcggctctgagtcctgaggacaggagcgggtggtgctggaagccaggctcacactgcggagatgttaaataagcccaagtcccaaatgggatgaccccaataacttgaaaggcatcgatctggaaggatttcaaggattgagacggaagtgttggccggagtgtagccttctgggtaattctgttttctccccttttcttttcctagtaatttgagttttctatttatgagccaggaatgtgtttaaaaaaaaaaaaatcctctcctctccccctcgccccgggttgagaggaaaggagaaagcataaagaccactgactggagttgttccaaagggctggtagcagctgagccacttcggcagataacaaatgggttcttggctttgtttgatgcccgcattccccaccctccacccccttccctggtgttgtcactgccacatacctagggcagcaaatgtgtcccttaggtcattcttgtcgatgaagccgtctctgttctggtccatgattgtgaaggcctgtggggagagtcactgctcagctgagacagggcagggacaagaggttcagctggggaggggaggggacatggcaggagtaaaacctggtgacctgcaggaggtggccttcctgccttttgagttggcaggggcagaggtacctccttataacctgcctaggtgtgcctctatgatggccgctgtccacctattcccccaagggccaggtgagaagggaggaccacacaacactgcgaggacaggactctgagcctgtccttcttggctgtggccggtggctatactttgccactttagttaggcacatgctgtaaggcacagccccactattgagggcaacaggtagagcagtactcagttgcccttcccgctttggtaggtagaaaggaaattctccacagctaatacccagggacacaacagtgacagacacggatggatgctatgctgcccagccccgcgcaccaggaaaggagagtcgggaaacgtcataggatccagaggctgggcttggtcccaccatccttcctcatgcctctcgtcttcctctgtggttcatatttttgcctgccccccacccccaagtataggagggactgaggctttctctcaggacaccagcaaccaaagtgctagtgagacagccctgagcagggatcgctacccagcgcctttctgagaaatccctgcatttcagcaaaggggtgtgctttcatggataacccacacaagtgactatgaccaagtgtttctttgggggttcacacatggtctggatgagcctgggcatgcagatcatttcccaggtctggtgtcattatatcgggggaggagggggactctgccacactcacttccttgaactcctggatctgggtctgctcaaacatggagaacacgttggagctcccgccttctatccgcttcttggctttctttggtgcctggagaggaatatccatcagacactgtggagcctctggatcaggacctgggccaggacctgtcacctggggagtgagtctctggtacccagacaacatgcgaggcgaaatgataccccaaaacctccaaacattatctaatgctctcctctgctccactaaggagactggaggctcagagagggtgagtcacttctctagatcacacagccacacacacgtacactctgcgccccttagctgcagtctctagcagctgggggctacctgttctggggaggcgggcacaaatatttcaaggggaatattcaaaagagagaaccagaaaacctcttcctggccacctgaattgggaaaagaattacaattcgacccttaaaagctctcagtctccgtttggcaagctctgggtggggtggggggtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaggaaggggaggagaaggaaggggagaaggaagaggaggaaggggagaggaagaggaagggggaggagggagaggagggagaggagaaagaggaggaagaggaggaagaggaggaagaggaggagggagcctgagcttttggctctggatccaggcacccttgcacctcagggcctttgcacatgcacatcttgggcagcctctggcacattcccatctttgctcaaatgtcacccacgcttgtcctctgcctctgcttctctgctttttgtccccacccagcttcacggggacagcctactcctgagggtgggctcttctccctggcctctccctgtcccatgtcctcctttgaacacaaaaccaccttggaggctgccatttgttcacagactggacaaatgataaccacttcactctcaagtctccagtcaccccatgggagcaaggtcaccttagcagttgggtccccatgttatgaaaaaaatgaggctcagggaggcaggccggctgctggagacagcagtggagtagcctctgtctcccaagtgctgggaggacgggagtatgtcgctacactggctccttttcttttttgaggcagggtctcatgtagcccaggctggcttgaacttgatatgtagctgaggatagcctcaccaatgatgaataaaaaaaaaggaaacatagggttaactcctccatttttcttttcttttcttccttccttttcttttctttcttttcttttctttcttttcttttcttttttttcttttctttcttttcttttcttttcttttctctcttttcttttctttctttctttctctctttctctctttctttctttcttttcctttctttctttccttacctttctttctgtctttctttctttctttctttcttttcctttctttctttccttacctttctttctgtctgtctttctttctttctttctttctttctttctttctttctttctttctttctttccttccttccttccttcctttccttccttccttccttccttcctttctttctttctttctttctttctttctttctttctttctctctttctttctttttggtttttcgagacagggtttctctgtatagctgtggctgtcctggaactcactttgtagaccaggctggcctcgaactcagaagtccgcctgcctctacctcccaagtgctgggattaaaggagtgcggcaccacgcccagcttaattcctccatttttcaagacagggtctcatgtagcccaggctgggctgactttgaactcctgatcccccactccccttgattgctgggattataaagatgagatccaggcaaccttcaggaggcaactgttagtcatttcgtcctcaggtcaagatggttttaatctgtgaggcacaaacatgtggccacacattgattgctattagaagaagggtagggagtgacccacacctgttatctcaacacccaggactctgaagcgggaggatcaagagtttatgatcgtccttggctacatagtgagttcaaggctagcttgggctacactgctgtaccagttaagcaaagcccctattcccttggcttcttattgtgttgaggcacacgtgacttgccaagtgccacacggtggctgagaagcaaggtgacccgcaaatggctgtgggaggctacagattgaggttagagtttaccgtgagcctgggcccacagaggtaacctgtccccatggtccactggcccaccgtgctgtatgaggaagagctggtttgtgttgctgcgtgggaaacatttggtgatttggtgttaaaaacccaagggtcctccaggagtccttgttggaaaggcctgggggaggggctctgcactcctctcacagttcctgggggtaggggtgggggtggggggagacgtggcgcacacaggagctgtcaatgctttgtccctgggctcttggtggacatccaccctgggactctaagctcatgcgcttgtgagatttctgcagcctagaactttgagagccagccccgagtaccacggagcagagactcaggagtcctggaggggaccggcagagcttctggaacaattgagaacaaagcaagctgatcacgctttcccatgctagtaggaaaatacaacggcaaacccaggcagctcagagcagccaagctcgctacctggcagagctggtggccagaaatagaaatcgggcagagggctgcgtccaccgtggatgcggagacagtcctttcctttgccctttccagctcccggcagctgccagcattcccgggctcacatccccatcagtgaagcctcggcctggcctttctggctgttcagtgtccctcccaggtagtcacaaaaaaaaaaagcttaaatgcacagaataatacacagcaaagaacaaaacaaaacacaccctgcacccacaaaaggaacaaaagccagattatatatgaattatgttcagtggctggggagatggctcagcaagaggtcctgaattctactcctcaaaacccagacccacatcaaagctgggcatggtggtgtgggtctgaaagcctgtcgctggagagatggagacagaccgtctctctcggtctctctggcttgctggccagcaggtgtaacctaaaaacagtaagtccccggcctcagtgagagaccctgtctcaaaaaataagatggatcacctctgagaaatgacacacaaggttgacttctggcttctaccaacatatacatgtccacatgacaggtacccaaacccacttggatgtgagtacacacacacagacacacagacacagacacagacacacacacagacacagacacacacacacacacagagagagagagagagagagagagagaaattactctgacaattttaaaagatgagagaacatgtgggtcatatttataaacacaaaaatgattttgcccccattctaaggactttcagtatttattggagccctactgtgtgcaggatccagtgtacaccgggagtcaggggatactggggtttacatttgtctccctaaagctcctgggttgaaaatttgatccccaaatcagagattggtagcgataggaggtaaggtctaggagaggtgaacgaggttaggtgaagtcatgaagcttccccctcccccccccaagatgggattagtgagttagtaagaagaggaaaacggagttctaaaccctttactctcagtagcatctagcctttgtagaaacaaatctctctcttaagatttatttatttattttatgtatgtgagtacaccatagctgtcttcagacacactagaagaaggcatcagatcccattacagatggtttcgagccaccatgtggttgctgggattggaactcaggacctttggaagagcagtcagctctgagccatctctccagcccaaaataaatcttttgtatttgtaaacgaaccagactctagtgttgtgttatagtaacaacattaattaactcagtggagatgaactttgagactcttggagaatgtatccccaacagtctacagtataactataatatacagagaagaaatatcaattattttattttttgtttattttagattggatctcgtgtagcccaggctgaccctgaactcattgtgtagcaaaggatgaccttgaattctgaccctcctgtctatctcctgagtgcttggttgacccactaaatgcctttgctattaaaagcctaagcattgattattcctctaggcaagcaaagaaacaagccaaacaaaaaccccaaatgccaaacctcagggaaattcaagtgcagtgcagaagagagcagacggagggagcctcaagtcctgacgtctgtactggaggtggagaagcgggttacaggatccgatggttccagcatccatccaagactgaaaaaaaaagtttcttcggcatgagaggaagtgcagttgtgactgatgatggttctggttgtgggggagttggcctgtgccacatgggggctttctgctgagaggaaacagctcccaggcctgaagagatttctactcagaacaagtttgaagaatcctgaagatgtctgacatattccttagcagaaagccagggccaggtgaatggactcagctatttaggtactatctggggttctagggaggtgaaaacagaggatttcagaacatggacccaaatgtgacggtgacagagcatttgtcatctgcaagactggagcctgcgggaatattcacttttgattttcgttgcttagtcattgagcagcagtgtgacatcaggtaggtttttgctctcagcttcagtattctaatctgtagagtgggcatgatgacgattttattcgcagggttgtcataaggacaaaatcaaaggcaatatcttgtgtgccctggggactcctgttggggtgaagagcctgctaccgtttcccccagatctggagagtggtctgatcaggtggggcaagcttggaagtgaagggtcctttttgcacaggctgtggacactacatctgaacctggacctgctacctttacctgggttcacagtgctttctgaagatgaccatggaaggagggtacattttcttctagcctcaggccctgggtggtggctcagcactgctgggggtcaaagtaacaattgctttctgaagataagagtcagcccctggcagagttggagatgtcagaagccatgagggcagagtataaaagactggggctggaactccctagctttggcaaaaaccaaccaaccaaacaaaataagggctggcaagagggcttgggtgttaagaggactctgctcttctagagaaattaagtttgattcccagcacccaggccaggaggctcaaaactgcaggggtttgtcacccccttctggtcttccagggcacatgcactctcgtgggcatatccatgcaaagacatacatacacataattaaaaagattaactcttaaaaaagaaaacaggctgagcatggtggtgcatgcctttaatcccagcactcgagaggcagaggtaggcgaatttctgagtctcgaggccagcctggtctacaaagtgagttccaagacagccaggactatacagagaaactctgtctccaaaaaaaaaaaaaaaaaaaaaaaaaccaccaaaacaaaacaaaacaaaacaaaaaaaccaaaaaaagaaaagaaaacaaagtctgagacagggttcctgttaaggtagaatttgggataaattgtgagcagcttggggacctagaggggcagaggtgctttatgcttttattttcctctctgtgtcgtcctggctggcctggaactctatagaccaggctggccccaaaactcacagagtttccacatgcctctatctcccaaggatcagattaaaggtgtgtgctaccactgcctggcttgttttaagccttttacttgtctgtttgagacagagtctcagtatgtagcccaggctggccttacacttgggatcctcctgccttaacctccccaagtgggtgctgggatcacagacctggaccactgtgcccagggtggggagggtttgaattcatcttctctgcaggtgcctttctcatgccaactgcagaatgactgtgtgtggctcagctgccaggagcgaggccccttgtcccgggcctacatggctgggtttgaaattcctcagcagagactacaaaccctgtgagcaggaggagagcaaaggctagtctatgtgctctggaaggcggaaccaggtgaggcgaggcccctgcgttgtctcactagtctcttctggaggtggccttaccatgaccagtctgccttgcgtgccgggtgatggagtccatgtctctgtagaagtcgctgccattctagagtgtggctgatggctactgtcaccaaggataacgtatctcctcctgtcaagattcggaaggtgttgatgacagctgcccctgggagtggcagccactcaagctagccagagggagtcaggggaggtagacctccttccgggagccactgggtgctgggtgctgagtgctgctctggcaggcaccatggctttgtgctccatggaagatgggcacgcaggactaccttgaacattctggaaggctcctcagctcagctgtgttcagtcaggtcagctcttacacccagcgcaggctagacctagaagtgccacactgaattcctttttttcatcattgtcctcagccctttttctttttgtatctctctcactctcttagatctccagacccaaagctcctgccaccttgattcggcccttggcagaacgttttcctcttctgtccctaggaaaccttgagaacacagtcccctcacgtctggccctaggtctagcctatggcagtagctgccaatcacattgggggtctcccctctttcgccaccctacccccacttcacacactcctaccccaactctttcctctctgtcctgctctgatgaccaccctcccccccaccttagcctgacagctaagatcacttagcaaattcatcttccccggctagactgccacagtcattgagcgctggggttccaggtcagctttcctgggagcccccacccgcccccggacacatgaattcaccagactgaacctcggcgtctttaccccatgaacagctccagtcttgggacgctgttgctctgacgatggccaacagctgatatgtacttactgtgtgctgtgactgcgggtggcctgcgcagatccaggcacgagaggacggacagacaggcagacacacatcgtgggggcgggggtacagagagactgagattactgtctggccttcctgaccccacttcccactccaggctgtggacactcaactcttaagggcagatgctccgagttcaaatggtcttgtccgtttggtttgtgctgggtcctcagaagtggaagagggcttcacacagcgacatccccagcctctgcagcgatcttccttcactgaggccccagaaacaccaagtgcatgtcaccggcttgcccgcctcccagggcatgccgggcactgcccaaactcctcccggtctgtgccatcccaaaccagaccgtaagcagatgtgtatataataaggcccatttctcagataacaaaactgagtgtcagagatgatcctttctgtcggccccacaaccagactctctgcttgggcaacactggatttggtccaggttgttggagttcctctctgtgtacttccttttggccagcagtccccactgtcccccactctggagcagacacccccacacaccccgcccccaggagccagacactgttggtctctttttcccccaattgcattttcagcccaggctgcctggctggctggggacacaatctcgggagatcctctttttaacagtgcccttcacatgccctcgggcgctgtcctggcagtcgtgcctgacataccagggcattgtcctctgtgtgagactgagatgccagcgacagctgtggcctgacctgtctgcagccccttcgctgaggaacttggaaccatgacagtccagagggtttatgagcccagtgatctatataaaggccatggtctgctcttcagtcatgcgacctggggtcacggggtgaagggcctttcagtgtgtcttcagccaacactctgtgggggctctgagcctgggatcacaggccggtgtggcctcagctctgtggacactcaggacagcgcctcctggctcggatggaagccactccagaagggtgaggggccagccacctttgtggtccccactcagctgtttcctgggacaacttctctttgccacagggccacaactaaaatggccccagatgctgccagccatccccaggagaatcagtggctgggatggtggccaggacgacatgaaatggctctgttggtgcctctgactttatgaacctgttcctgggtgttaggtgacagcagagtccttattctcactcagaagtgcaaggctccccttccctctgccccttgtcactgagtctataacattatctcctatgccaccatcagaactcaattagctccttgtagttcctgcagggcacagccaagccttccctgtcccctggatgacacagccactatctgtcattttcatgactcctgttcttcctctcagcattcaccttcattccggatttgggatttgactttatttctgcaagtatctgtctcccaccagaacttcaggagtgttgagagaattgtgtgtgtttttgttggcgtgccccacccccacctccagcacctagaactctaggaaagtctaaatccttggaacccccacccccccccagccaacctgtctctgtacagctctcctggtaaaacggcttcctctctctgcacagctctctctaaagtagcctccctttcctctcctcctgagagttgggcatatcctattctgtcaaatctttctctgattcatcactttgtctgccactcaattaggcatcactttcaaactggctgctcccttccacaatctaacttttccttcattgtttgggattaaaggtgtgtacgaaagcacgtctgcgttctagtcggagggattaaaggtaaagctaaggccgaatcacaccacaattggaaactggttttgccagtcaataacacagtctcagggttcacaatgtgatcaaataaaatacctcgcagcaggttgtcaacttggctcttgtgggaagaggcgctcacctgaagaattgtcccattcaggtgggcacatctgtggggtattttcttggttgctgattgatgtggagtaatgggtagcccactgtggcttatacaagaaagcagcccgagcaagccacagacagcacggtagtacatagcttcctcctgggttcgttccttgagctctggcctggcttccagcgataacagactaacccagaagccagaatttgtcctttcctcctcttgttagcttttggtcatgatgcttatcacagcaacagaaagcgcaccagcacaacatgcttaaatggaaagcttaaaaacctgtgggaaaccagagaatttccagaaagatctctggggagttggacttgactgtcagctgaaggatcttaaggtaagatctgtctccgagaaaggcccatccccagctctaggaggtctgtgccctgacccaggcactacaggcaagaggctatgcctcctcccgcctagaaagtttcggcaggctgcctgtcctgtccatctctagcggcagttccgcagcctgccggcagggggaacacggccccaggctctgcgctgcttaggggactgtgcagtcgcgtgggagagggggcgtggaggggattgctgttagatttgtccccgccgccttggtcatggcatctggctcaccagtagttgaggcttttgggagccagggatcggagggccctagggttggaactcaggcctagcggatgctacacactcataatttgattctggatgtaaactctagcagggagtgtcactcactatcaaagcccgagagacctggtgtcaccacaggggacccccaggacatggtttatttgttttaatttaatttaataattttttagatataacctcctaggctagccttgacctcacagccctcctgcctcagcccccctgaatactgggctcacacttccttggtactgagtcacttgttctcagagtggccccttggagtctgcaaggctggcctggagtcatctcctcctcctcctcctcttctttcctctctctttctctctaactttctcgctctttctttttttgagacagggtttctctgtgtagctctgtctgtgttggaactctctctgtagaccaggttagccttgaactcagagatccacctgcctctgggatggaaggtgtgcaccctggctccaggattttttcctttacaagtgcagattctatgatttgtctgccacaaatctttaccacacttgagctgtgaagacagtctctggtgttgcttctgagacgtttcattgtttcagggtttgcctttatctatcatccatgtcaaggtaattttgtagggagagccaagtgtgagtgaacaaacttgtttttcttatttactttttacatagggaagaccagtgtattgtactaccaaattgtataggcaacttccaaattgaaagccagttgcctataggtgaggaggtccttagtttcctgtgtgcctctgctacccacaccacgcagctctaaggtgacccttgaatcaagtgatggggctggagagatggctaagttaagaacacttgtatcaggctgtggtggcacaggcctttaatcccagcacttgggaggcagaggcaggtggatttctgagttggaggccagcctggtctacagagtgagttccaggacagccaaggctacacagagaaaccttgtctgaaaaaaccaaaaaaaaaaaaaaaaaaaagagagaaggaaaagagtgatcagtactcttaattactgagctacctctccagcccctatattttgtttattttaaaatgtatgcgctgtttctgctgagacaagttctctgtattatgtagctttggctgtccctggaacgcactgagaagacagcagttctcaacctgtgggtcccgaccccccttttttcacaaaggtcgaatatcaaatatctggcatatcagatacttacattatgacttataacagtagcaaaattaaaattatgatgtagtaacgaaaatgatttttatggttaggggtcaccacaacacgaagaactgtattaagggctcttagcgttaggaaggctaagaaccgctgatgtagactaggctgatctcaaatgcacagaaattcatctactcctgctgggattgattaaaggcataagccaccacacctggctttttttttttaatttttaaaaaaagattatttattatatctaagtaccctgtagttgtcttcagacataccagaagagggcgtcagatcttattacggatggttgtgagccaccatgtggttgctggaatttgaactcaggacctttggaagggtagctggtgctcttaaccactgagccatctcttcagccccacacctggctttttaatgtttttgagacagaatttgcagctcggaccagccttgaacttctagcaattctcttgcctcaggctcttgagtgctgttccaggtttccaggcctgtccccctggaggccttcagggcctggtgtggtctcaggaggccactactccctctgttcctccacccctgtctgccctctctccctgccctggagctccattaacaggaggtgccaggagcaaggcccatccccaggctggaccagcagagctggagggctcgttcgcattgctagtcagaacttctccacaaggtggcggtatgacacagcccactgttctccaggagccctgttttaagccacacttagacacaagccctgctcggtcctcttatgtgtcccagactactgaacccaggaactgagacatgggtgtcgcctctgtatgggagcatggtggagcactgaagaccacctcagaaactttgatgtcacaggatgaggaagacgcctgtattaaaaaaaaaaaattcttcatggcttacatcagaaagcccctcatgtctcgtcattaccgagtgcgtttcttttgtctttctagaagtatctctggggattttagggaataaaactggtgttcgtgaaaggtggttctgaaattctggggatttagaggctgatggctaaggaagtgtcttagttattgttctagtcccgtgacgtgaatccatgcacatctcggcgggggcacagtggcaggcgagcgtggtgctggagaggtagctgagagctcacaccatgtctctaagttataggcagagagagaggagagagacagagagacagagagacagacacagacagacagacttggcctgtcatgttcttttgaaacctcaaagccacatctccagcgacacctcctcctccaacaagtccatacccccctaatccttcctaaacggtccatcaactggggaccaaccgttcaaacatatgagcctacgggaccattctcattcaagccaccacacagcaattacttcacaccatacaatctctctttagaaatagatgcctgtatgtttttaatgtacatgggtgttctgttggtatgtgtatcagcgcactggaagaaggtatgggatccatgggactgcagttataggaagctgtgagcagccttggaggtgctgagcatcgaacttcagacctctggaagagcagccagtgctcctaaccactgagcaatctccctaggaccttacatcatatcatctcaaacttgaatagactaacttaaacacaggtggtggtgtactggctggttttgtgtgtcaacttgacacaggttggagttatcacagagaaaggagcttcagttgaggaaatgcctccatgagatccagctgtaaggcattttctcaattagtgatcaagggggaaaggtcccttgtgggtggtgccagctctgggctggcagtcttgggttctataagaaagcaggctgagcaagccaggggaagcaagccagtaagtaacatccctccatggcctctgcatcagctcctgctttctgacctgcttgagttctagtcctgactttctttggtgatgaacaacagtgtggaagtgtaagctgaataaaccctttcctccccaacttgcttcttggtcatgatgtttgtgcaggaatagagactctgactaagacaggtgtcaaataacacaaaaactcttcttttcattttattagggaagggttttttttttttaactgtgttttacttgaactcatgattctcctaccttggcctcctgagtcacagggcagtggaagtgcaggcaggatgatatcccaccaaagcttagtgtgtgagagtgtgagtgcatgcatgtgtgtgtatatatgtgtgcgtgcctgcatgcacgtgtgtgtgcatgtgtgtgtgtgtgtgtgtgtgtgtatgcatgtgcacatgttcctagcatgtcttagcagtcatgtctttgctgggcacaggggaaatgccagcaaggctttctgaggctcctgtgaccctcattactggtgaagggccccagcagtgacaggttctcagctccagtacctgccttttcttctgctacattagaagcaggcttacccatcatgcctaagccacgttgttgggccccacctgcgggcttagattttgttttcaagcctattttatttagggttcttaaatgctttctagccttctagccaacctatcagaggtaggagaaaagaaagatagataggaaatgggagttgtggccctgtttagaagtagttctttggggggagagtccaatctgtgttgtcaggatattaacagtctaatccaaaacatcaaatatgaatccatagcagcaactcgatccagaagaaactgcgaggctctgctgagtctgtagcagtccgtggaagcagcaagcagcagccagggtaccaccagaagttctttgctgagcctctctcaacgaagtcacgagcgaagatcagagaccagtggagagctgcaaggtggatttgtgtacgagggtctcgttcgctgtctgtggggttctacttatgctccaaacaccacgtgtcctctcaagtgtctgcgtcagcaaaacatcctctcataagacagcttccagggctggagagctggctcagcggttaagggcactcactgactgctcttctgaaggtcctgagttcaaatcccagcaaccacatggtggctcacaaccatccgtaatgggatctgatgccctcttctagggtgtctgaagacagctacagtgtatctacatataataataaataaatcttttaaagacagcttccagaagaacatcacgtgacacaactgagtctccaaaagaaacccgaaatttccacttcaatcctgtgtcaccaatgctgtgtctgcccccagtgagtcactttggggcaactgtaccagtatcttaacttacagatgtcaaaacactgttagaatgccaggcggcccgtgtggaaaacccaaccataggaagaatttggagccctatacaagccagacagtgcctgggccactgccaaacactagcctgtttaaagttttaatttaggctgtgcacagtggcacatgcctgtcatcccagcactcaggaggtggaggcaggaggtgtgtaagtttgaggccaggctgggctgcagagggagactcagtttcaaaacacagaacagccagaaactcccaaggtcgcccaaaacaaagttggagaaccccacagccaggaggaaggggaggggacagtgaactatttggaacatttctgggacttgatcccaaaacagaagaggaaagttagggagaaactggaaatctgatcaattgcgggctgcagtgggtaatggagagccaatattcttctgttaacagcaatacacttgctcccttggcataagatgtcagagtaggggagggcgttgcagcctgtggcagctccctaaaatgtgtggccgtgcaacatccgcaggggacagcatgagtgcctcacagttgggactctactggaagccccgtcccatttagcaatcgcctgtggtggtgaatgtggtggtctctacgcttatcacctagaccgtgtgtgcttcgggctctccttgcttgccactctgcagtttgtactcaaaagcaaaatttagtttcagtttgtcagacacgggcaaggctgggatcacacaggctggaaagcctcgtggatgatttttctgtttttctcaatactcgtttgagttgtaaaaccctcttctcctctttctgcctgttctgatgcttcagatgtgaccctaaatcctgggtattttgggacatgcaatcatgtcccttagagaagcagctgctgtcacaccgagtaagcctggggcagctgcggagaggagagcggtgggtcctgcttgcatgactgttcggaggaagctgtgtctgatcaacagagtgatcagtagagacttaaagatggttcttgggaacatgggatcaggaactgaactgataggtgcctatcaggaaaggttgcttgttgatacaatgaacaggcctctgtcttcaatttaaaaaagtatcatgtcagaggggtgctatttgatgaccggacttatacccacacatgtttaatctgtctcccaccttggataactgtgtaaccgcatctgcaatcagctagctatgtgctcaagtctgcaggacatgcctggctagacgtttatttttggcttgcagaaattgtgctttggaataaaaaaaaaataaggttagggggctgattgacccagcaggaggggggaaggaggaagggaaactattgggaggtcttttgtaatgatggaacgtttataatgctgatgttatgatttcttttaataaaataggcaatgatgtcactgctcatatgagcaggattgtgatggtataaataaagatggcctgatctattcggggccactggcttgaaagtcagcaaacaggtggtcaatgacttcatttgtgcccgatgccccatccctgtctcaggacctgaaccttgcagctagagctggtcttcagtactataactgctacattttgtttttttcataaagttagtaattgccttgtgatactttgtatacacttggcccagggagtggcactattagaaggtgtggtcctgttagagtgggtgtggccttgttggaaccggtgtggcctctttggagtgggtgtggtcctgttggaataggtgataatggactgaacctctgaacctgtaagccagccccggttaaatgttgttctcataatttaaggggtttgcaaccccataggaagaacagcaatatcaaccaaccagacctcccagagctcccagggactaagccatcaacaaaggagtacacatggctcccactgcatatgtagcagaggatggccttgtcaggcatcaatgggaggagaggtccttggtcctatgaaggctcgatagatgccccagtgtaggggaatctagggtggggaggtgggagtgggtgggtagaagaacaccctcacagaagtatggggagggaggatggaataggaggtttcccgggagttgtggggaacagggaaaggggataacatttgaaatgcaaataaagaaaatatccaagaacaaagaaaaaagaacgtacagttgggtggaaagtgagggtctgggaggacttgagggagcacaaacaggattgaaacatattgcatgaaaagtcattttgataaaaacaaattaaaaaaaaattttgtccttataagagttgccttggtcatggagtctgttcacagcaataaaaccctaagtaagacaggcctttttaaaaagtatagtgttttaatatagccaagcatattaatccttccatctggtgtccagcggtgcgcaccactttattgtcttcccgatgctctctcaggcaaaggtggcaaggattttgtgacatttaaaagaggcacttaaatctcttttccaaaatctttttttttttccttttccttttccttttttaagacagggtttctctgtgtagccctggctgtcctggaacgcactctgtagaccaggctggactcaaaatcagaaatctgcctgcttctgcctcccaagtgctgggattaaaggcgcgtgccaccactgcctggctttcttttccaaaatcttgctgagtgtgatggtacctgggaggttgaggcaggaggatcaggagttcaatgttaacctaaaaccgtatgatgagagttcatctttaaaaagaaaaaaaaaagcaaaacaagcaaaaccaaaaccaaaaccaaaaccaaaaccaaaaccaaaaccaaaaccaaaaccaaaaccaaaaccaaaaccaaaaccctggggtcagcaggatgggtcagctggtaagggcacttgctcctgagtctgaaaacccaagttcaatccctacaacccaatgtggaagaagagagctgtctcctgcaaattgtcatctggccttcacctgtgtgctgtgtgacaagccactgctgcaatctgtggacacacacacactcgcactaaataaaggtgtaataaatgctattaaaatctggattttaagctagaagaatttattagcaatacaccaggacctaaattcatcatctttcattccattccaagtcaccagcctgctcatgctgctgggaagtcccaggactgtcctccactctgagacttagccctgtcttgaccaggtcacccattggctgacagacagccactgtggtcataactcccatttgcctgagttccaggtgtggggcccagcatacaccagatctggagccgtggcttagttaactatgtgggtctgtcacccaggcagggcccctgtctcttatggtgatgaactgtcacctacatccttgggttacatctatcagctctatccatgtaccttgtttattgtgtttggttgtttttgtttttccagataggggttctctgtatagaccagtctggccttgaactcaagagatttgcctgcctctgtcttccaagtacctggattaaaggtgtacgccaccactgtccagtgtccctctggttccttaaaaaaaaaaaatcttgtgtctggggagttggctcagcaggtaaagacctgaacccaggggaaaagcagctggcgttctcaacctctaagctgtctctccagccgtcttatttatttggaagtagggtcttactctatagcctttgctagactggaacttcctgtgtagaccaggctggccttgaactcacagagatctgcctacctctgcctcctgagtgctgtgattaaaacatgtgcaagtccattctctctctctctctctctctcacgcacacacatacacgcacgcgcgcgtgcacacacacacacacacacacacacacacacacacacgcatgcacacacacaatgtagcccaggatgccctttaactcctgatcctccagactcagcctccccagagtttggccgcaggtgggcgtcgacctggggtcttcctctggacaactttgaatctgttgtcttaactttctaagttgatgtacaaaggtatggggcttcatggacagatcttttatttaaaacactttcatatgcacatttcttaattcctgagacatggtctcacgtatcccatgccagtccgcaacttcctatgtggcaagaaatgactttgaacctactctgtgtgtgctgcctgtgcatgtgttgagcatgtgtgcaagtcagaagacaacttcctggagtcaagtctcttattccaccatgtggatcctggggaatcaaactcagatcatcaggcttggtggcaagcccctctacctgctgagccctctcagtggccctcaccttcatactgcacccgtatgtgtcagcaggcttcattcatacacacctctttatttctcgtcttcatttccacctgctgagtttgagaaggagtttgaggtcattgctgatgggcagttagtcaagagcagacagacagtcattttccagctgaaagattacgagaagagatgtggatctcggcctgtctggaaagatccccggcaactggaggctacaagtgactggacccacgatgccttctccctccctcaaatcctcacatcctgcctgtggggaaaatgcacatgtacgcatgcgcacatgcacgcatgcgcctaggctgggaccggaaaggggacttgagcaggtctccagtcgaccctgagagagttcattaagtccgcccctacgtaaagttttatcattttctatctaaattctgggtgcaagagaaacctgctgaagggtacaaaagaggctttcgtggatttctttttgtttgttttgaaggcagtcttgctaggcagcccaggatagccaagaactcatcatgtcacctaggctgacctagaactcacgacaatcctcctgcctcagcctcccgagtgccgagtgttgagtcaccacacccaggttaggaaagggcttattgatgggtgtgaaaacttggaaaaacaacccagtcccagattacccaagagtctcaggcccccagagccaggtgtcccggctttaagctccggacagcatctcaggaatgggagttgccttgcaccgtggaggagagatggccgggtgccagcattgggctctgctactaagaacatatgactccatatgtccacaggctgggctggctctgggccaccctccccagatggttatgtataattcacgcgtctgggatgccgtgtctgcttcactgctcagccttcggctaacagactgacagtcccgatctctgagctcacggtgctgcctgggaggccaccgaggatcctggacaaccagggaccccagcatagaaaacaggccaaaccagttccttaggaagcttctggaaggtctgtgtttggatctccgctttaagctcttttcttggatatctggtggtaccctgatcagccttgtgctgagcccacaggtcactgtcatttacaccaggagtctccatccttggacatgggctcctgtgttgtggtgaaagagggaaaaattgggcctggaaaatggcttagctggcaaagtgtttgccacataggcacagagatcctgagtccatccacaacacctacatgaaagagatgggcgtggcctgaaaagatgtctcagcggtgaggggggcctgctgctcttacagaggacctgagtttgattcccacttcaaaccattcacaaccacctgtaactcaagctccaggaggtctaaatgccctcttctggtttccacaagcattgcacttacctacaccgtccctcaacacacacacacacacacacacacacacacacacacacacacacctcaagttgatccctgccctcatacatgcacggacctgtctttctgatgtgctcctgcatgcacacaaaaaaaacggtgagatttttcagccctctcttctggagttttcccatctgtgtactaggtgagggatcaatggcgtgtggctggccactgctggggggccctgtgtttggctggcatagcctggtgtgtgatgaggtggcccaggtaccagtgacttgtcagcctcagcaacttagctcctatttcaaagcacaaaagtgaccagtgggttcggggtggagcacttgcctggtgtgcaggaaggatgggagttctggtctcagtaatgtgaaaagtcagcccatcaggcactggagagaaggctgagctacagaggacctggattgggttcctgggcacccacgtggcagctcacaatcatttatctataattccagttccaggagatccagtgccctcttctggccactgtgggcactgcatgcgtggtgcacagatacacatgcaggcaacacacacacacgcacacgcacacggagccaagacagcagacaccaggacatcacatattagtaatgactatggtagaccatcccctctctgtctctgaccttccggatagatagttctctattcctgcttatctagaaccttctgccccaagctcaggctgaagacatgattttatttgatagtgggaagctttgtcattttcccttcctgggaagctgtgtcaagcatctagatgactgcggtgactccgagccctgctcctcccacccctccatccttagcagcacccactggagcacagaggaatgaacattctgagatgcagcagctcggctaggaggctgcgacagacctcggtcatgtggaacccgctaaattgaaaagatcttgggttaatcaaatccttttctcctctgctttttatcaaagtcaagaggggccgacctactaattagaaacgccttttcatgttaaacacaggcacttcagagacaaggagggaagaccctggactctgaagttcccagtgatgttccaagcacggcgtactcccagactccctgtgctcttgggagatgtctctgctgtcagtcaaggactggaaagcatcttctacaggagaagaggaagcgagtacgcgatgctgacaaccacagagcaagctttcatcctgggacgccctacccagtcacgaaggctgagttctattttcgtaaagtctattttgtgtttttgtgtgcatgggtattttgcccgcatgtatgacagtgcaccgtatgtgttcagtgcctgaggcagagggcaggagagggcatcctgcctgcctgtatgtctgtgctctggatgcgtgcggtgcctggtggggtgggggtggggcagaagaggtcgtcaggtctctgatgatggttgtgagccagcgtgtgggaactgggaatcaaacctaaatattatagaagagcgacaagtgctcttatccactgggccaactcttcagatcctgtttttatattttcactgtgtatgtgtgtgtgttagttagggttcctattgctgtgatgaaacaccatgactaaaaagcatgttgggaaggaaagggttcattcggctcacacctccacattgtagtccattactgaagaaaatcaggacaggaactcaagcagggcaggaacctggaggcaggagctgatgcagaggccatggagggatgctgcttactggcttactccctacagcttgctcagcctgctttcttatagaacccaggaccaccagcctagggatggctccacccacagtgggctgggccctctcacatcaatcccttattaaaacaatgccctctgagcttgcctacagcccaatcttataacgacattttctcaactgaggttctttcttccctcatgactctagcttgtgtctgtgaagttgacagggaactgtcacgagtgtgacctggaggaggccagcagaggatggacgtgtcctgctccatcttgctccactttattcccctgagacagggtctctccttgaacccagagctagtctgccatcctcctggggtgccacccagcactgggtggggggcgcggggacaggtgtttctgctttgggtttgtcactgatcatttcaactccagctcacccgcaccccccccccctgttatttaaatttaaacaaatggaatgaaacttcagtttttctgtatcactagccacattcgcaagcttcagtagcagggctgtggctagggggtttccatcattccagaaaggcttactggggagttgtttctttttaaagagctcacaacacctatttgccattggggaggaattaagaataaattggtttctgttttgttgttgttgttgttttgttttattagaaactgtcttactgtgtagctctggctggcctggaactcaagagatcggccttcctctgcctccttagttctgagattaaaagtgtcacaggtcagctggtgttgatggcgcacacctttaatcccagcacttgggaggcagaggcaggcggatttctgagtttgaggccagcctggtctacagagtgagttccaagacatccagggctacacagagaaaccctgtctgagaaactggttccacctcttctggtgggttggcagaactgctggtacacagactcagagagggcagggcaaagtctagaacaggtgggctcctgatgtccgccccttccctctggggcatcagacattgctgtataccagtctgaggagggtgaagcagagttcaggacgaatagggtccacagggctcctgtctacccaagaatgctggaagtggggtccttagaaaagcaataaagaggctcagggagccagcgtggggtaggtggcctggctcctggctccctttggctgcttctgtggtggaaatgtctgaggctagcgctgctctaatgtgagcctctgtgagtaatgggagcctagccaggcaggagggttcaaggtccattcaaccatgaatgtttcaggggagggtctcctccctaagtgttacagctcagtaaaaacagccagtctcagacgatccttggtgaaataacttgtgtgctttattccatgtggacaggggccctatgaaccccggggagtgggatgggacttgggaggacaatgcattctattggctaaggctaagaggttggtgatgctctatttgcatggagaaggcttccaggtgcaccacttcatgactgactacctgtgaccatctggttggggttgtggttacatgacccccaaacaggcatggagacagggaggaaattaggtctacttgtgccctctcaaacctgagatctgtggggtttgggcacactccacctcaccagtcccatgctcattcattcctctcctggcacagtccacgtgccctgcagaaaacacacacaagtgtcacaggtctaagaacagattggaaaggctcgtgtgactcataactctctactgaagggaaaacaaacaaacaaacaaacaaacaaaccagtctctaccaaagttggatgctcagtttcccagatccacccccacactccatgctttgattatatggaacatagcaacaccaggaccttatccccagccctggaactcctagagccctgtgcatgctggcagtctcgagtcttgactgttctgtcatacaagctctgtctcccgcacaccattactggaaagattatgcagagtcacgacctcattatccctggactgaacctccctgctggttccggataggaattcctgccatgtgaacttcctgcctgccacccactcctcctcttctctgcacacatctttctggaactttctaggactcatctctttcctaccctctggccccatggctcagtcccttgcttggtgatggtttcagacactggctcaatggacctgagccctgggatgcttatgctgaaggtgaggctggggtgggtcccaagctgtcatctggagagatgcctgtgatgacaccatgggcaggtgaaagggaccaacagggatttcagagagctttccagtctctccagtcaggtcagtttgggttgtgtcttgtccttcgggacaaaggtaggtttttattttttaagatttatttaatgtatatgagtataccaccattgctctcttcagacacaccagaagagggcatcagatctcattacagatgtttgtgagccaccaagtggttgctgggacttgaactcaggacctctggaagagcagacagcgcccttaagctctgagccatttctctagcaccaagactggatatcttaaagaatctttgcgggctgagagattgctcagtggttaggagcacaaaacccgtgtacacataaaataaaaatctttaaataatttttttaaagagtcactgaaaaaatatttaaaagatttatttgtgtatgtgtgctcatgggccacatgtgtgcagtaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttggagtttattacaaccacggaaaactacacttactgtggcctgccagggttcatcggctcactacacctgcctggtggtggtcatggtcggtcacctggcctctgagaggagaatttggggagagtgaagctgagattgacccaggagagcggggtcaggtccagggaaccccctgctggcatgttctgaccatggactggagcccagcccgaagctgctctgcctgctgtctttctactaaagcatcctgactttgggctgaaagacactgatgaagaccccctctgaggttgaaggtgcaggcacagaaagacatcacaaggtgtttgatgcccttgatttgcctggaggggcctgggaagaggctgggggcaatcaaagaggctggctcaaatttcaccttttttattttttaatttttttatttttgtactaaacagcactcttgggtaagacaccactggcttcctcccttgtatgaattattgaacaatgatacttgcatcaaaaactgcagaaccttgcagcaggttaaaatatggggtgatctgggaggaccaagagtttcctcccttaggagaaaatgacaatatggaacaacactgctcttagaaagaggctctgtcccttctccctcctcccttccctgttctctccctcctccctctctgttctctccctcctcccctccctgctctctcccccctcccctccctgctctcttcctcctcaccctcccagtaggtttagggctgactgtggagatcagatcctgggttgatcttcacctagctgtgtattctgagatttgtagctgaaaactgaagcctcgctttctccacttggaaagtgaggataatacgtggtgggtagcagaaagcttgcatggcctagcaattttatttctcagtataaagtaatactggttgaaataggggtgggatagatatctgctgaccagtgttggttgcagtgttgtcggttggaagacagaagctggaaacagcctacatgtccatccacagatgattgtagaagtgtgatatagcaatacattggaatagtattcagctgtcaaaaaggaagaacaaacacagattcctacagataaacttggaaatctaagtagtagacgccagccatgtatcatgtgagccaaagacaaaatacacagaagagacaaatccagaatgacaaaaagctgagcactggtcaccagctgcggggaagcaggagggacatgactagggtaattactgcttgacacatagtttctgagtggagccacggtcaactttgcaagattcaaggtgatagttgtccatcattgtgaaacaaggtaaccttggtgtcatgaatatttaccacaaatgttccagtgcctgtggggagtggaatcccttctcagacacctcatgcccactttgaatttcacagagcatttggtgacagagtcagagctaactgtcctttgatagtgggcacacccacctgcccccaggggaggcgaactagctatgggttggacttgacagattggccccagctctcagtgcgagttaaggcacaatgagcgttttcttcatgttcaagaggttgttatagggaaaatggacatctagggtgttggagagactcggggaaccagctttcctactgctctgcatgtgaaagtgacccagctctcagcagcgggaagagtgttccaggcaaagggaacagcaagccggaaggctcagagacaaagcaggcgctgcttctcctgggaattccaaccttgaatggggcagggggtagcaaggcagaacagcctcgaagcctagaggaagccacagaaagaaacggttagtacggacgtcatcacagtgttttttaaaacgatcttttccagttaacaaaatgagatattattagtctcagtgactaggggggggggggaagaaaagaaaatgaaaacaaaacaaacaaacaaaccccgcaggctcaatttttcatttgccagtgtcgcagacgctcggagcgggcttgggttttaattcttcctgctgacactatcaaagcccgctctggtgagctcagctgtgttgtagctggagactcggtgtgtttactccacacagctcccgattcccccaatctctgcaaatttgcccttaacaggaaaatacggggttcacagcctcgctctaccccacccaaaattacgccccgtgagtgtaggctctcaatccacttccggcctgagccacactccttccttctgcctcaggctggactcattcacggtgcacagggtcctgctaagacccccatttccccgaccctccccactcaaccaccaggcctgtttcataccctccaggctccaagttctgtgccactaactccgtccatagacaattctagaacgggagattcatacacaaagacccaacactaattcttcccccaacagaaacccgggtgttcccacgaatccaggcttttagagctccgtgggaattcaagaatccacaaaagatatttctctgcgcagatttatgctccgtgcaaacccacccccgaaccctccatccaaacaaaagctgtattttaccaaaatatatctccctccagcagtcactaactgatgatatttattaggatgcgagtcccattaattctgggcattatctgaatatgtatttatgatgggtgttgggagaggggggggcttctccttctccagcctgggccagtctgtggttgcatttggtacacaccacatgcggggtgggttgtaagatgtcagtcatggtcgtagtagtcagaactcagtgcgttttttcttagttgaagggaagctgactttaggaccaagcccgcggtgagcagagcccaagctataaactctgccgggagggtggctctgtgtgtgtgtgtgcgtgagcacgtgtgtgtgtgtaaactctgccgggagggtgattgtccttggtaggggtggtggtggtggaaagcccagctgaagacgggctcagatggggagggggaaagtgaggcgctgtggatcagtggatgggtgtgtgaggctgagtggagaggtgtggcaccacaacagggtggccttggggaccagagatatgattcatgttcttaaatgatgctatgtaggggtacacacacacacacacaccaccgagagatgcccagaaaaagccacacaacagttgaaacttgagctctggatgccctgggacacctatgtgttctgtatccccaggtctggaagctgcacccagaccctctttcactacagcctcaggccttgggcgacatcatcaggacccttggctcctgtgagacagactcaggcccagccaaccacagcactttcacgtctcacctctctccacataatgattaggtctctactgtgaactcagtcaggcctagccaatcagagcttgccatccttctgacttaaccatgattggttcttagatcaacacatgacctaagtaagattggttagtaaggtagccttacctccggagttaagtcaggactcaaaggccaggctgatggctgggatttaagctttgagatcctggcagccatattagcagcgtgagggagaagctacttgataagggaaacttgactcctgacaaggagcaagatagacatcacccaacaatggctgacccatgagttgtatgttccgtgatcaaagtctgttccagaccctgtggcaatggctactcatttgccccacccccacccccagccgcctgagtactatgactacttccattttacagataggaaaatggaggcccaggagctcaccgaggcaggggcggagccagaatctcagcccaagagctctgggtgcagaatcccagttcctaagcatagggcattattctacagcatgtattgggcacctactgtgtaccatgttgtgtggaaatgtgggcagcattcctggaatctggcatgcccagtactgggttgccatggtgacctgcctttggcctgggtggggaggagcggacatctatcttcttccagttctgctaactgcaagatcaaggtcaaggcgtggcccactgttgtggtgtgacctgacctccttgctggaggacatggcttctgtgtgcatgttcaggaagaggaaggctcctgaggcttcatgtccccagtcctgctgggcgggcctgttctgtggctcatcccatccttaggaaactggtatgcagacagacacagggggtgctccatggtacatggggagcaagtttcttccagaccttcaggagtaagagtgtgagagagtgggtgggccagcagtggggggagccaagggtaacccggtaggtaccctgtttctatgacttttgcagagaaactccttagcagtgagcctggcgggccctcacagaccttcacaaatgtcaggggtatttttagcccgcagagccgatgcgtccggtggcggacgcgagaagtgagaacgtctggacagacaaagtgcacagccacaggaatctctatttcaggcttgtggggcctggctcggccagagagagacagcaggctgcctggcagctggaaccagaaaccagccttgagataaccgaggcctagaaccttctctgatctcctcccgggaggggaggagggccctgtagcaagtgccatctgagtgggtatcctggggtggtgggtggccagtgaggtggcaggacaagattgccactgtcgattccctgggcaagtattcacagggcttgaggatcactgtggagtcgggaaaattctagaagcacatggtctggactaggtgctttgtcagcctgagggactgtggttacacagaaggtgggctctgagcctgtctcatagtcagagaaggatcctaaggagggtgtgtgtgatccttgaattaggggcttcagtgacactctatagcaagccagccaagatgggagtggagtgtgaaaacctgggggagggtagaggagggagttcaatcattcatagatagatagatagatagatagatagatagataggtgtgtcagtgttttaaaaagaatcatctatttattttatgtatatgagcacactgtagctgtctccagacacagcagaagagggcatcagatctcattgcggatggttgtgagccaccatgtggttgctgggatttgaactcaggacctctgggagaacaatcagtgctctcaaccgctgagccatctctccagcccagatgtgtgtttttatctgcaggacgctgtccagaatccctcgtcaacacccagaatggcacacggtcccaaccttatggacgtgttcctgatggtgtgtagtttactagtcagccatagaatcggctatagaaggagctaagggatgatgggaaatccaagcaaggatgaccaccatgtcataaaacttacctatagctccgagccgaatggagtactcccatgggccaggcacttggaaggttgaggtccagagaacccttgatcccaggagtttaggcgagtctgggcaacagagtgggatgctgtctctaagaggtatgaataaggtataaatagacaagtgaaataaaggataatatacaaaaggaggaaggacagaaggaaggaaggaaggacagaaggaagggagggagggagagctggcggcagtttcactatggcacgtgactgacccacatctgctccaacttcaacctcactgcagacttaggagtaggagataggcttttggtcccattttgctgctgaggggacaggctcagagagagatcagcctactcacctgaggccacacagaggtactggaagatgccctatccatgcaaaccccgtagaagatgccccatagtcctggagagcccaggctttccccctttctagccatagctcagctctgacttcatccacaatttgtactgtgctgggatggaccacacctccctccctccagtgttcccaagacagcccaggacactgcccttcctagcacacagccatgtgtgcaagccagcctgacaatgatcgctcactttgtatcctgctttaaatgctttaaacggactcttcccctcttccaaatccctgtaaatagatgtataggacaaggcagctttacagtactataaacgaaacgccagtttttctttgcagaaatagaacgcaaactaaaaataaatatataaatattaaagttttcttttaattcccacgttcatctcggcacaatcccgtgtcccatacacaccccccagcccccaccgcacaccccatactggttccttattccttccaaaggcagagagacagcagggattacaatgatacacagtatcaaagaaattggggtaggaatgcccgaaacaggacaaagcgacaccaggaacctgtcgcatggatggaccaggaagtacccaacattggcatctgtggtgctgcccaccctgcccatcaactctcatccgcgggaacacaagatgcacacacaaagtggggcgtcacctccaaagcgggcactcaaaaaagaccatgttggggaggagagatggctctgtggggaaggtgcttgctgcacaaggccagagtagattctcagcccagtgtaagaagccagaggtagagaggcggcctcgggaggtgaaacatagttgctttctctgtgggtccttcccttcccagaccctgaggagcctgtgcctgggcatctctcccagaagagtcttggtttctattttgcatattgaaggctctgagaagccaggcagtcccccagcagtgtcgaaggtgggtattgttggcagcttgtgccacgtggagcctctgtgtcagcagccctaagctgacagcctcgagaaggacgctgcctttaaatatatttcacaggctcccaaggcagagcggcaaaccgcttcttctcacgattccaagaccggaggtggtgcagcaagaattaaaatattctgccttaagaacggagccaggctgatgccccgagccgctaagccgttgctgggaacagggtggcggctcaagaccagggcctttccatgtaaattccaacccaaacctgcgcaccagtctcagctcggccactcgctagctgtatgacctgggacagtccgcatgcgcagagcacttagcatctggtcattctgccagggtgtcacagaaaggggcacagagaaggtgagcagctgggcctgggtcacgtgagaagtgccaggttcgggatttgaacccatgagctgcttgaaccccagaaccccttccagcttgcccagcatagacaagagcctgtagcccattgatgacaaaggtacggttttctcatcaggggatggactctgtgatccaccccaccagggagagaaattgcttacaaatcttgtgcttgtaatcttgctcatgcttcctgtcactaccactgaaggaatgcaggtgctgctgatacctgcacagcggctcacgtggatttccagaatgttttttgggctcaccacctgccttccttcaggtggactgtgctacttcttagcattgtgtgagatacacactcaccaaggcgaacagaggactggcaacattggccatggtgacagggtcagaatctgttctggcctacgggttctctacatccatggacgggtttggctaacatagcctgtgtgtaggacccaggttgccatcccagctgatgtaaattacctctgacccatatattttcctggaaatcaatgcattttaacacgagataatatttatgaaattgaattttttattgaagctaatgcaattctattctatcttatgcatttttattaaactaatgcattttaaattaatccattgtatattaactacaacagacacgggtacttacaggcaaatgatatacgcctgccaagatcaatacggcgggcagaagtttccacatgagtgaggactgctgagaactcgggatgtgaggccatgcaagaaggggactgtctctttccaaatcactatcgagaacaaacccgaagattctgagtcttcctgactcagaatgggaggtgaagcacctttagcaagtagacgactgattttaattttattatatatatatgtgtgtgtgtgtgtgtgtgtgtgtgtgtgtgcgcgcgcgcgcgcgcgcatgcacggggcagtgcctggtatgggtgtctctgttgtggattttcgtacctcttgtctcctgggggcagggggcattgggtgactacatcagctttctgtgggagctaggaattggaactcaggtccttacatttgggtagcaagtgtttgaccctctgaataaaccctctcatatgacccctccccacccaccttcaaattcatggctctttgttttacacctaatttttactgcgtgcatgtaagtatatgtacacacacacacacatacacacacacacacacacacacacacacacacacattggtttttcgagacaaggttactctgtgtagccctggctgtcctggaactcactctgtagaccaggctggcctcgaactcagaaatccacctgcctctgtctcctaagtgctgggattaaaggtgcgagcaaccactgcgcagacacacatatgtttttagctataacttgctcagtcggtgtaatactacctggatgtgtgttttgggtgctgaccacttggttctggaaaccatatggtgtgctcttccctggggaagatgcccctcccagatttcctccagtgcctatagtttacgagggcctcgtgggcttgccccctgtccagtttaccacatttgttggcgtcacccttgttcagcgcacggtaaggcagtcgcattggtgaggccttatggttccagctgtgacattactacaagacacagtctcacagcagactctctgattgtctgtttcttacagtctttccgcttgatcttctggatcgtcccctgagctttaggtgttgtgtagatgtatcccactggggctgggctccgccatgccatactttgattggctgtgtgctttggtaatggtctctgtgtctgttgaaaagagaagtttcctggatgaggggtgaggactgcgcttatctgtgggtgtaaggacgcatgtgtatagagtgttgttcaggattatgctggtttcgtaagttagtggctgtggatcctctaacaactgtgacttcaccagcgctgagtagttggctaggtttccagtaccagacatggtttccctcttgttgtgtgggtcttaagtctcattagggagccgttggttactgtcgaggtacctgtgccactactgcagccttagggtgatggcatcatgctggtcatcatggttcacgggcatcctagctgggtagggctgatggttgcttgcctcctttgcaagcctgtgtggtgccctctggtcctcacggtggacagattcaggtcagtttcagctcaggggcctctgggtcctgttctaaagtccatgatgtcttcagcattaaagacttgcacctctggcattaaaaaaagaaaaaaaaaaggatgtgttgattcggtctggctctcatcagggaaaaccaatggactccacctggcattcagagaagagtctcttcacagacaaggatgtgtctcagtgggtagcatgctcacttagaatgcatgaagccctgggttccatccccagcactgcataaagcaggcacagtggtacctcctgcaatcccatccaggaggagaaggcaggagggtttcaggattccaaggttatcctctgactcacaaagagcttgggatataggagctcctgcctgacaaggcctgacagagctgaggggagggtcttggggctcctgatctagttgttcccatcaggcctcgctgttacctgaggtggacagcagtggacagggagaggctgttgactgtcctcctgacagtagaaaaccccacgggggttggggggacaactagaaacagacacccaccaccccgaccccagatctcctgaccaggccctttctatacaaatgggtcagaagacagagaacaggtatagacccagggaggaaggacttgctgaaggtatgagaggccctgacagctctgtgatgccatcggggctcctgtggttcctcctttcttgctcagtaccaggcaaggttcattctcacacctggagaagatgcaactgtccccttctcctgagttggcaaactgaggcttatcagaatgaaatggtttggacagaggtgtgttcaactcgtctgaggaagatgacatatgatcttaatatgatctttctctttaaagaaggaagtcgaatctttttgttcccctgccatgccttcttctttgctagatggactctgatctaaggaagtaagctaccactaacaggctgagcagaacagaacatgaacaacaaaggggctttgggtccttgctgactgatctgtgtctctcaactatgctccacattaccacgtatgaagcctcatgttaattcacagcgaacacccatcttttatgcaggtgttagtaggctctacggtgacaagcgagatgtgatcctgataaatgatcacatataatgttgctgccctatgcttggacttgaacccaggtcctctgcgagaacagccagtgctctaaccactgagccatctccccatccctttaaccctctttttaaaaataattaattaatcaatttatttttgcattttcccttatgttgctcaagctcccagtggtctcttctccaagccatttgctttagggacaggagtaaccacaccactgagtccgacatggacatgtgacacagtgctgaccaatgaggttggaagaaaaacgtcctagactgggcttctgagagaagtctgagtgagaacaacccttgggactgattttctgtgttagccatttttttctgtcactgtgacaaaataaccgaggaagtcaccttacaggaggaaaggttttttttggcattgggagccctgctttgtcaggatctgaggtggggaagagcagagccgctcacttcttagttaccgccctgtggagagagctactgggtactgcagcccctcgctaaagcctgggaatgctgcgcgcgcatcgtcagatcaacccagttcaaggttgaagttggagcccccgggatcttgtcctcctcggaggcctctgtaatcagcctgctagggacctggcatccatcacacgagcttatgggacatctgagattcagattgcgttcatcctcccccgagacctacaggaacgcttctgagagcgccgtccccaaggggcccttgtaaccgatggatgaccttgctttgccatgaggacgccagggtccctaatgacacaggcctgtgatcccagcactctggaggtagaggcaggaagatcgtcttcaaggtcatcctaggctacataatgagttaggggccagcctgggctacatcagatcctatctaaaaagaagagagggcaggggagacagctcactggataaaggtgcttgccctttgaccaatctctggagcaaggatttggggttatctaaatgtcagacctgagcagggaggtgtctataccatctcaaggagggagttgggggtgatgtaccccagaggaaacctaagtcattacctcaggcagcccctgaggccacaggtgggacctggcctgccccacgcagggcctgctgggcccgctctccccaagagccgcctgtgaggagcaacacacccagcctctccatctcgggtttgcataaaaacccacgtccatgaagtagcaactgcaatgttttgcagtcacatagcaaagatatttaaaaatatcacccatatgtgttttaaatacaggcaaatagctggcgcggcagccggcttcacacccgcgtgccattctgagctcgtttcttctcgatccaactctcaaaaatcgcacattgaaggccagacaagcccagaatgttgcgagctatggcaccagaatccctcccacccacagcccgccttttctcgggaataggggtgggggttgtcagctatgacctggggaaaaaagcaaaatgtcccgggctaagacctcctctccaagccgagagtggtcaggcattgctataatcctagcgctcaggaagctgcggcagggaggtcaggagttcaaggccaccttcagctacaaagtgaacttggaaccagtctgggctacatgagtccctgtctcggaaacattccaaagctttcaatccatccgtcatgaagtcacacttgacagaacattgtccctgacagcacagagtgtgctgagcttagagaccctctttggaaccggtgagacggctcagcaggtgtagatgctgctgccgagtctaacagcctgagtttgagccacatagttcaaggagagaactgactcctgggagctgtcctcagactttcatgcatgaacacacacacgcactacatagaatagaaaaccgttaagtcccacttggtgtgcgattttatgacacgagcctctcaccgttttattgtttcccaagtttatactttaatatctaaggtaatatccgccaccagcagtgtgtattacagcagggataaacgccacaaaacaattctcagcatcctcacgctgacctctatgacgtcacaacgtgatactccggactctgtcccgccccccagtctattgtggatgagagtgtggttacatcacaggtggctgtggtcagtcaggttttgcggagatccatagctctgttacattagcctgctcccctactcctctgtggcccttcaggcagggcaacacatctagatacagtaaacctgctcctcccccctcccctgccatcctccctcctccgctgtccgtccccccgccccccagcactgagcatcaaggcgtctaaatatagactgcagtaaatctttcctgtaagggctttgaccattgtctcctcgtatctcactggctaggaaggcaggaggaaggaaggaaaagagagagacagagaaataatacacaaagtaacgaactaacagcccccggttaaaggcgctcgctccgaagcccgccccctttctagtttaggagggcaggtattgtgtgggtcccagagcctgacttagtcacctgacttggagtcctgggaaagcttatagaactggaaggagggtcagcataggcgtggacatcagacagtgagaccctttccttctccaggagtggggcggggtgccaggtggatgctgagttattttgctaagcactgggggacgccatttcttgtgcacctgaactgtgtcctgagatttagacaaccccgtggagagacagctggcatcctggcctgtccctcatgtccccaggagtcagtggtggtcctgactctcctcttcctccatgctttttttgtccctctctttggggctcctggggtggccactgaagtgttacctaagagttctgggcactttccctcattgagacgaacaagcctggggaagggcagaggcgaaatgagtaagagcagttgctatgcaagaaagaggacccgagtttggatcccagtgcccacagagaaagctgggcaccactgtatgcacatctgtagagctggcactgccggagtgggaggtgggaggatctttggggcttcagtccaggttcagcctgaatgctgtaaagctaagaggagaaaacgggacatcagccatcttcctttggtctcccgatgtgtatgtgcatctgcacacagacacacacacatgcacatacacatgcatgcgcacatgtactcacatgtatatacatatgcatctgtgggcacacacagtcacacatgtattcacatgtacacacatacacacatatgcacgcatgtacccacaaaaatacacacatgcatttatgggcacacagagacacacacgtatacccaatgtgcacacatgggcacacacataaacacatatacaattacacacatgcatgcacacatttatgtatatgggcatagacatgaacacagatgtatgcacacatgcacatatacatgcatacacattacacaaacacatatgcatgcacacacacatctatggacatacacagacatatgcacatatgtatcctatggaatgacagaccacgtaggacctcctttctggaagccctcctcccacttcccagttatggctgctcacaagattgtgcccagcaagggacagctctgtttatctgtgtgagaaacggggcctctaaggggctcagggctggagagcccacccagagccacacagtattgtgactttggatagctttccccaagaacccggagactgcagagcccgggtggggtcaaataggaggggagggcagcctgggaatgtcaaggggttgggggcggggctcttagggcaagagaggaagctaactctactgtcgtatttcattggttagagtaggtcatgtgaccacaagctcacatggccatgagaaggtcacttggagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggggggggggggcggggcaaacttggggatcacccgaagtggggtgggcaacgtagaggaggaggcaggggtgaggggaagggagtcatggccttcccccacagtattctgaagaaagaagctcaggcccagagaggttgcgagtctgccctgagactgagccgccatggattcaggattcaaacttgattcagccatgctaggtagtgagtaccttctaaagagtttgaagaggtgctgtttcctaagcctgtatctcttttactgttgtctcttgcctgcgccacctccttcacctgcagtacttagtaggtgtccaaccagctgccttattcaccccccaccccaggctctctcaagccctagggggccattgtattgctacttctccccagggttggaaggaagggcttgattgtcaggcaccccaatccatatctaaatacagatttccaacactgaggagccttctggacctcctctggggtacctgagacagctcagtgggggaactgggacaaggagagagacagccagctctgaactggcttgcctggattcataatccccatccaaaagccctggtcagtgacaactctgcctcagtgtttccatctgagaagtgggttcaatccttgtggggtcgtgaaggtagtgagttagcttgtacttagagcagtatctgggatcataattaattcgaattgttgcttcggctcctgcgggtcactgaccttcaagcaccaaagtccagatggcagcacctgctcgtttgcgttgggctctggacacttttctctcagccgtagcacaccgaggttctcattgtgcaaatggggaaaccgaggctccaggaagtggggtgagttcttcaagcccacacctaagaagtggtcaagccaggacttgaattggattttggagcaggacccctctattttcagtcctttttagggtcactcggaggccatcctggactggtttggagaaataacctgaataggaagtgggcgtggcttccgtgcgattccgattcactcctccaactgtcccacgggggatttagacccattgtcgggggtcggggtggggggggggaagatgctcagagatgtggagtcccttttctggaacgcagctgggaaggggtgggggctgggatcaacaccgtccttgaacttgggtctgaggccaagtgccgctcagcttcaccaggagccgcagctgctttgcagcccgcgtcatgacgtcacatgcttgctctaaatgcgtttttttgtttgttttgttttgttttgttttttttttacttaacccagactgtcagccgggcagatgaggtcacggaagagtcgccagctgtgcctcccgtctgagttctttgggtgctgctgcgtggggggagggggaagggaatagagcgaggagagcccctgaacaaggcagagggtcctccaaatgtccagcagcctctggtcaaggggccctgcgttggcgtacagtcggcatttacgcgaagtgtccaccaggtggggcttgtgcccaagccaggtgctgtaagttctgggagggttgcctagctccacagaggcgggtagaccctggggttaggggtgaggaggtgggatggagtggggtggggtggggtgggggtaccaacacgtgccctgtgtgcttgcaaggctgcggtactcgggtatgtccctgagaagctgtctctggctcgtgtgttaacttgcgtgaagagttatgcgcatgtgcgtgaaaacgtgcaccttttgtacgtgtgtgcagagcggcctagacatggtgcctgtgggcgcagctaacgcaaagtgtgggccgcatccctgagtgttcgtgtctctgggctcatgtgtgtgcctgtgtgtgcagagatgagtggagagggtgtgggtgtgtagagatccaacatgaatctagctcttgagttcgattgagtctccctcttaggtagtttggaggccggggaatagaaaggctgaccttttgggacaccatctgcataaaaacattgcacaggtaccccgagtcaggcactgatgggggtgggggttgacctcttcagccttgcgtcttcgaaggtctctggagtgaaggagggcttctagaaccttctttcagggtttgttgagtcccttcaaggggagccgcagacaaaggatacagaaaggattggattcctaaccgggacagggacagtgttccaggaaggagtcagaggtgtaccatgtgcagagaaaacagacgtccctgggaggctgacgggctgtgactcaggaactggctgtctgggtcacagacatgtgtccctcccacctttcattccattggtggccacagcctcaatggcttctttatccccttccccctggcccaaggctagtgtggctgggagtgtgcctcctacccaacttccaaatcatgctcagcttcatcctgatgagctagctgtgcctgtctctctgggcctcagtttgttgacctggaaaatgggcacagccgtgtctgctaataaggggtcaaggcaaatcctggtgccacctccatgtgaagcaggcacaggagcctgtaatggtgataacttgaaggtacagaaactaggtgagagacattcttctcatcttagtaaagcagtcacagaattctcccttttttgtttgattcacggccggtccccagttaaaggtgagcccccccccatatgcttcaggagagaggacagagggaatgagggagacggaggagctgggaagacagtggagagaaggcatgtgtggttggagagaaattaagaaatagaaatgagaagctgggaacagtggtgcttgcctgtcatctcagcactcaggaagctgaggcaggaggatgacaagtttgaagacaatttggaatacagagtgagactctaacccctcccctcctgagactggagtagctccatgttcctcatcccagggtttctttggggatgggtagaggttttcctcagaggacagggcaggttcatgaccaccctgcaggctgacgaggggtagaggccactcatgccagcggctagtatcttggaggccggggccttgtgggtgtcctgtattcctcagatgctgtctctgttttttgtttttgttttttaatagatttaccctttttatttatgtgtatcgctatgcacacatgtgtgcagtacccaccaagtccagaagagggcgacagaaccctagagttgaatttacaggttgttatgtgctgcccagaatgggtgttgggaatcaaaccctggtcccctggataagcagtgagtgctcttatccacggagccatccctttaaccccttgatggctgtttctgaggtcatctgctatagtgtgtggtttgaatactcagggacttcagtatgatatggagccagagggtacttctgagactgaagtggcctctgtgtacttaagagcccagtttagtgacaggtaggctcttaggaggctcagtgagctgcccctcaagatactctggaagctgccagtggctatgtggcatttggtcctcagggtgctcaatggatgcccagtcctaattctgattacaaagcagaattctgggcagaatccaggattcttatgttacaatggctactacaacgttgaaaaccaaagagcctgagggtagagctctggggtagcgtgcttgcctagtgtgggcaaggccctaggttggacctctgcggtgcaggtgccatgcagtgaagatggcttcctaaggatattctctctgttctgcgctagtggaagagaccaatagtttgagctttaaactcactaatgtgaagctgggcgtgctgtcacaggcctgtcttctcagtagcaggaaggagggccagaatcagggctagcctcagctacatggaagatttgaggctagcctgggcaatatgagagcctgcctcaaaataaacggatcaattaaagggtaaaagcagacagaccatggcatgctgaggtccccttgaagcaggtcctggtgtgtggtgtggggtagaggtctaattgagttgggtgtgtctcatcccactcccactccccgaaacccactcccacactatgcagttaacccagcttgcccagaattctctgaggtccaaatctgtcttttcctttctggtttctgggactggctttttccatctatttgagcgtgtcaactccgtgtgagcgaatgaatccttcccggcttctcattctgtccttgtccttcctcctccccctctctgtcatcctgtcggtggtgacagtcttgctatctgatgggaaagttctccccaagcccagcagccttgagagacggcccagctgcttttaacccttgtgacttcataataatttagaatggcaggtttcaggagtagccctagctgctgtttcagtgggaacagcctgaatttatggacacagttaagaagaagaagaagaagaaagacggtgtcctggctgtgaccacagcagctccctgcttggctttcttatgggctggggccagcaggctgtggcatgggtactgggcagggtcgcccagagaatgcagactctcttactctgaccacatgcagattcctcatgacaaaactaatttatgcttgatgtgttaaaattgcagctccgcgtctgaacacagcacactgggcccaaacagttccacgtgtaagaggtttattgggggtcggggggaggtggtggcagagaagggggaaagagagagaggtaggggcattccccacatatatatatatatatatgtggaaaatgaggtaaggcaggtaaaggtgggaggtgagccaagtggattctgggaacatggtagctgttgtcttggcaacaggtctgtaggatccgcctatgtgatgtcacaggtttcggaggtcctgatgccaacattgctcatacagaagtaattaatgaggctggtgagatggctcagttggtaaaggccctagctgccaagcttggtgacctgagacccatccctgggatccacacggtgggaagggagaacacagtcctgcaaattgtctatctatctatctatctatctatctatctatctatctatctatctatctaatttattttatgtccatcagtgttttgcctgtacgtatgtctgtgtcgggggcgggggcggggatctgatccccaggaactgaagtaacagacaggtgtgagctgccatgtggttgctgggatttgaactcaggatttatggaagagctgtcagtgctcttaaccaccgagccatctcttcagccctgcaaattgtcttctgacctccacatgtgtgctgtggcacatgcccacccctcccccaataagtagattggtagcaagtttttttttttttttcaaaatttatttttaagtgattaagggccgagagtgtagctcggtagcacattgctggcctatcatgtgggaagcactgggcgagctggactggctccatgtgccagtgacaggtcgtgttttaaaaaatatagtggatggagtctgaggttgacttcaatcctccacacgctcatacccacgtatgcgtgggcccttgtgcatgcatatgcacacaaattcaaagaaacaaatgagatgatgtggaatttaagaagccaccatttttttttttttttaaatggctgtttgatgtcttttccttcgtgtccctctgggaatgtccacaatcctgctccaaacccgcagacgtctagctgatcagtgatatttcacagacatctaaacacggcctcagcacacaaataaattgcctttgccttcttccatgatggaacaatactcttttgtccgctcagccaggatgtttcgttggatgggtgcggggagaccagttctccattcacttggactttgctgtttgttaccggtggtcgaaagagttctgaaaatataggatggaaaaattccagattgtataccgggcaggctcttttatatcagagggccattatactgactggctcgttattttatgacagctttggctaaactcgtcacgtctaacaaacaaattatgctttctcatagctaagtgtatttgatcagaggtgtctgggatcccctgtgggcctcggaaagtgtcccctcacacctagggcatgatatgggtagggcaacgttgaggtcttgtgtgcctgtaagaggggaagccacaaaccccagacctgaacgggacgcctaggagcaggtcttggagccagtgaggacgggaggggggcagatagaaaagagctgttcaaacttgaggggtatagagagggacactgggaaccaatagccccaacttcctctctttccaacctttaagctccaaacaggcattccattggtcaatccaaatgttagtcagacagcaagggcgcctgggagatgtagtccactgaggtcagcaggtgcagagcgaatgggggaggggaacttaaaagggaatagtcaacacacagataatgctattgtttatttatttaagtagtgttggcctgggaggggagttgtgcccagagagcctatcccactagtgggggttcctcagcagttctgatggggtcatggggaattggcacctggctgaggcccggatcctggctttgtggcccgttcttccttcccattcatctcagattactgtggaccagcatggaatttctcctcaccctgccttcatcaccttatgtgccctgagaccttctcaggaccttaagagtcccccctgcggtgggaccctgcacccatccccgcctgtgccctgggataccacaagccgggtggcctctgagcattctcagtgtttcacacacgtccttgtcacaacacgggagcttcattgcactggcacccacgaggaaaagaagccacaaaggtaaactgggtggcccaggtctctaagcttcaagcaggcggaccggactcaacacccagtctatccacactcaggggaagcgactgacatttatctgcggttgatttgcgaaacgctggcaaccactaggcgatttataaggtggtggctgccagcgtggggcagaaggaattgctggcttggtccttgcagccagtctaggcagaggctcggaggtggacttgacggtgccccagcctccctgaacctctctcttccaggcaggcggctgccaggctgtgatcctctcaccctggctctcccagggtgttcacacttccagattaattccaaggcttgctccactccttgcctggcagctgcggtgggcgacgccggcctctcaaagggcattttccttttgtttcagctttgatgtcgagatgtctcgaatatcattatgcgtggggctgaggacctgccgggcgggcttcccggggattctcgaacagtttatgaatttctccaaggatcctggctgcttctgctttcaggatgggctgccccagaagggcgtctgtgttctggtcgtaattttctaacattgatcccagggaatgggtggggctgggagtccagaatcaaccagggacctgcttaagtttctcttcattaataaagaagtgaaaagcaattatttttttcacaacagaatttaaaattgtattgccttagttccaaggacacttggttgctgtgaaagtctgaatttcctggctttcgttgatcacccatcataatatcacttcctcaagctaactccattcaggggtaaacacttaaccgcttaattcattattgctgagtctgagctggctgccgatgtggctggaacgggagccccccccccccccccatatctaataaggctcaggctggcgatgtgctcggaacgtggctgcaagagagacggctgaaatttattttgtgaataaagcaataagccgctaaacaaagctaatatgtttcagccgagacagaaagacacgatcattcagtatttatgtagcagccctgttcctcagtgggactgcaagttgccgccattaaaatggtcggaattcttcagagactcagctgtattaagtcatttaaaaatatcacagacttaaaacaatctgaattattggattttctcgctgctcctgggtaagcatgtttgctgtggcaatttcctgcttggtcaaaggtacagcctgactcctggaggacagaagaaaagttgtgggtaggctctttatgtggttccaaacggctgaaatgaaacctgatctcgattgtgggtctatagttctgacttttaaaaaattttgacgtaatttcagattccctgaaatgtctggaagaaatgtaaactacgtgctttgagagacaggatctttaaatgttagcagtgcgaatggttcaggtctcaggttctggatagagaggaataggtaggtcttgtcttcatttgcgctgtatttgagatagccgcagacatggcttctccccccttttcccctcttagccacgtctgtgtgtgtgtgtgtgtgtgtgtgttttaaacaaaaaaacaaagctattttgctacacaggacccaaggcaaggattcaaatcagagagctactgttaacctgttatctgttgactttggtccaaatttgctattgcgtctagttgatggcctttggagacaaagaaaacccttggttgtccccttcttgttgctttgtcaaattgcattggcttcctacagcttggaatatgtgcttgatcctcctgttttgagtaacactgatatatatatgcacacatacacacacacacatacatacatacacacannnnnnnnnnnnnnnnnnnnccatttgggaccctatgatatttcttcacaattaaatttagactctgcactttgggcaggaataccacacaggcacaaagtccttctcaatacagcatccccaaaagtcacaccccagcagtgtgtcccacagaggcagagtcagacatatgttaaaatatattgaagctctgtttgttaaacgggtttggaaaaggtctcacaatcgctaggttcttctctctctctctctctctctctctctctctcaaattctttattacaggtttttaaaagagcagactcaaagacacgggggctgcaagccgtacagagattcaagaagaaaatgtagtcatttaaaaaaaaatcacaacgcattagttatgaaatttgcctaaattcattttgcggaatgagagccgtaatttgaaggcagagttatggagagaggaaataaaaccacatgtcacgtgcaatttaatctggcagggaaatgggccactcggaattgctaactcggcctgattcgtttcctctctggaaaaagctctacttttggtctgaggagtcttttcagctcctgcgttaatgtatttgcacagacgtcacacggaaaaaaaaaatgtatgaggacagcaagagaaatactgtatcctactttaaatcacactgcgggttttaaatggctcgacggatggctcggagcgctcacaccttcccctgaagcatttaagaaacagttatttacattacattaaaaactttaattgccttgaagcacgtgctgggagacgcaaatattggaaaatcatcaaaaatatccatcatgattctccctcctttacaactcttctaaacttcatcttttttataacccacggtattgatctattgtcccagaccgagagtgatgtcagaagtccaagctcagccataaaaagggaatataatttcggttggccgtccataaaagctagtcttttgacagagatgagggggggactaggcctcttcttttggaagggaagtaagtggggggggtgatgtgcaatagggtgtggtgtggggaggtgggcaggcaaggagggtgacttcagggtctggaggtttttttagggttttttttagggggtaccgaggcatgatgggtttctgagtcccttctttaggataacaagttgggagggctcatagaaaagaagagggatatgtgaaatacgcccccttttggtccagggtctgaggaactgcaaaggccgggacctccccgccctgggttaaagatcaaggagaaagcagaaacgctatactcaaagggcgtgtgtgtgtgtgtgtgtgtgtgtccgtccatgtgcgttggccatggtaatgataacatgacaccctgcctagcccccatagtgatgttagaggtccggagctgctacagcgggccttggagaacctcaactgatccaagcagctgttggggaaaggctgcttccgcaaaggtttctctaaggacatcctgcagcaacattcacttcacgccagggacttgctttggaaagttgtggggtgcgttacgcccactaaagaataacgatcagagccctactgtaaagacgcaaagcatagcacacacaggttccccaataggacttccttcggtgctgtacagcaccatgctgggcgcccggagactttcccacggctccggggcgccccctcgcggcggtcacccgcagcgcagcgagcgcgtggcgcgcggggttgcgaggggggggggtggacctcggccggagggtcgcgcgtgtgtgctccgtgctcccctcgcgcgaggccacgcgaggagagcggccgcacgcactgcagagcgctcactttgttctttacggtccccgtcgcccgcggcccctccgcgctcccgccgccccccctgcgcattgatccgcgcgcgcggcgctgtcgataagtttgcaaggagccaaagtcaagtgcgagcggcgtgcgcgcagagccgggccgcgctcccggggtccagcccgggtgttggcggcagccgcatcctcggccgcgcgcccgcccccaagatggcggccgaggggggaccgcggggggcccgggggccgaggccggccagggctgtacgggcgaccagggggccgcgcgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcgacacacttgggtgctcattacgcccgcatagctccctgcaccctgcagtcgagcagagtcgcggcaggtgctgcgatggcctgggcggggaagccttgtggataaccacgctctgagagcattttgcttggccagtgacattctcagaattcgtgacaacacgtctggagataaaaaaataaataaataaaacataaagggacccactttccctttttaatctgtccgcagatctcgttaagttgcttctgataagtggctcgctccagcccccctcacactcctcgctcccctcctccctcaaagccaccgagccgagagaaaatcggggcactcaggcatgcagttaataactgcaggagctatgcaattcctagtccgcgcccgagttgaggttacagtttggtggccggctaagacgggcaaggctgtgtcctatgctagacggtttaaaggatgctaaagtggctttggaggtggggagcaggggccgggagggggcagagagagagttgggtagccacattgggcctggcacgaaggccaatggtaatcgtattccctgctaatgtttgtaaatgagacccgggcaggctgggggacagcgtctttatttatgattgatgttctgtaacataagggatgacaagaacgcggcagactagaggggagcaagcggctgggctgacggaagctcttacccgggtgctattgttattctcctggagagaattgctacggtgagctttacagcggccccgtatttgcccatagtcgccggaatgccagttaacacgattctcattagataactcgctttccatccaagcgcctgggctgcaggcttggtgggagagagaaagggagagagaggctgccctggggctgaggcctgggtgcggctccccgcgttggtttcagagctgattggggtggttctggacgctccctgtcccgagtcttggtggggaggcttttgtggagctgtggaaggtcaccccagtcttggttccagctgactcctggtggtctgcacgccttttgttagggtctcaggacacactgagatggaaaaggagatttgagctgcaagggtggtgagtgagggtggtggacacaggcctgtccaggtgacagggaccaggaacaccaagaccgctcccccaacggggaacatacaagggtgtgtgtgtgtgtgtgtgtgtgtgtgaactcattaagacaatggctgtgtgtctggcacaaacaggctcccagggaggggggctcatctgaatcgatataaagaggaggggatgctcctccagggagtttgaaaaggctgcatagttccagagctcagaggattgactgtggaagctgcggcatgcatcttgccaggcccaggctggtgcagctgcccactctccaaccccgcctcagcctctcctgtgatccctggcacagcgtgcaaagtccagggtcttccggacatccatctcttagccctttgccagggacccttttctggtccatcctcttagtgactcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcctgctgtagcagctcaggaacgagaagaaataaaatcccgtcctgagttaatgctggtatatttcatttggttataggatggttttacagtgaacatcactaatgcgggcgtagtttatggcttttctctgtgttatcgtagtaactggattcatgggttcatggtttttcttttctactttcgtttaccccctactccataccctttataagagatgttctgagtcccggcccccacaccatctttcctttcccctctaaagaagaggaggctaagctttttgggcatccgggttgaatgaggggattaggggtgctcctgcccagctgtatttttggggggagggacgaggtggggctggtggcccctcacagaagactcgggtagaaaacccggccattcctcaaggaggaatcggcaccaccctcaggatgagccggtgtgggtgggcttgctaaaggggtcttacggaaacttctggaatggctggaagccaggtggtgctttgatgaagactgttccgtgctcaaagttcaggaaagagtgtgaatataattaaaacattgtaaccttgtgatgttctgaagcaggtaaattttacatatcagctgcggtgtgcttaggcatccattagagcccttgacagcttgactcacctaaatgtgctatcatttaacaatgtgtcaaaatccccctttctacctgtgacagccgtaaataagctatcagccttgttggtgattcctaactttggaaacttcccgacagcctggaatcgctgtctgtcggaatggggaggcaacagaaagggcttggtgtgccacgacaggccagcatgtgtgtgtgtgggactaaacggggggggggcacggggggggcaggtatatggcaatcagaggaaccttccagaaacatctcaaggtgaagcccaaacccaggatgctttcagtaagtccagccgactggttagccatcccatctgccttcctggtttctgatacctcagggcaggaatccttccatcagaaagatgggaaacagaggttgaacttgtatttaaggatcccagccattgtttctgggcattaccccctccctccaactccctgttggagtgctggacatgaacagaattggtctgccctccacccctcagctgtgtgtgtgtgtgtgtgtgtgtgtgtgtgtgatcttggggtttcattttaggagatgaacactgttcgaggagccggctgagcactttggtgtctgggtggcctgcacaaagctggtctcatggatacggggtggtgtgtgtgtgtgtgtgggggggatgtctgcacaggcacacaaataaaataattggctcccaccatttccatctccctttctccttttcttttaaggtatccattagaagagggtcctctcctcaaacttgacattctgtgaggtaacccttcttccggcagatggtgtcttacatgtgagccaccttaggtgctctaaatttgggcctggttgatgatagtcgggggctgcccagaaactgtgggtttgtgtgcctttttttgtgcagggggatcaactgccagctggttcctgggcacctggtgctgagacagggcctggcacaggtcaggcttaggcggggtatgcctaaggtaccttttttgtttttaatttttattattattattatttttacctatttaggtttttttttttttttttttttttttttagagacagctgactagccctggcttacctcaaactctgactcctgccttagcttctcaagtgctagcaccacaggcaaacctgtatcagtctgcttttgaccctggccttggaacctgtgtcttttaggggtgtaggggtggaggtcagccagtaccccagatctcccagatgattgaacttctgtgtagggaggctgaggtagagatggagggtgtgggctcacgctggaccagttctgatggctgagtcccaccttgagccctgctgtgactgatgtagttggtgacggtgggggctgtggacccattaagcaattatggtttgggaataaggaattctcagaatggagttcagtgtatgcggagcctccctgactctctggcagtgttttgtaaattgtgagtggtattttctttttatgttgcatacactaaactttgaatgcctccgtttcggcaaatacaatgtgacctcccccactccatctctctccctcactcttcccctccagcacgcagaacctactcccaccctaccccatggccttggcacgtgtattttccctgcctggaatgtctttccgactttccatggcctccgtggtccccagtctcaataatcaccatgacttccccattttgtgtatgcgcctgtgtgtgtgtgtgtgtgtgtgtgtgtgtgtgtgtgtgcaggttcacgtggatgtgtgtggcggctggtggttagcatcagatgtcttcctcagttgccagccatctgatttttgaggcaggatgtgcgtagtcagtggacatagcctagattctcgtgtgtgtgtgtgtgtgtgtgtgtgtgtgtgtgtgtatgtgtgtgtgtgtgtgttcctggctggcctgggacttgctctgtagaccaggatggctttgaactcagagatccacctgcttctgcctcccaagtgctgggactaaaggcatgcaatacccctctcccccacatgccctcccccaggcacccccgtgagtgttttactatgcagagatatacccagggtttctaggtaccttgcatttccccaatgtttgaactcagaactttctgggtgtggtggctctacacatcctaagtagcagtggtctgccaccaaatgtgaccactgtctttcacaaaaggctcaggataatcacatactttgaggttccctggtgtacccatctggagccttagccaatgaaaattgaacaggcatggctggacgtagccactatgaacaaagatgtgtggctagccatttgtcacaggtcaataaaactttattcacacgagcaggtagtgctagccctgggttggcctggaggctgagatgtctgccctataggggatcgagccatccctggcttttcccttttcaagtacgagtgcatggcctctgttttaagatggaagcccgactatccaggatggtgacaggttcctaacctggctcggaatttcatcctcatctcacctgtcagctgtgtgaccttgagcggtgacttagcctctctgtgcctttctctctctttcagtgggactgttagtattctcctactacacggagtacggcggtgttcagcagagcgtggggcgtgcgatcatgctttgtaagtgcctcgttccttcttaggtatttttagagggtatgggagcggcagccagaacctgctggcctgcctgcctggctgtcttaaggctttttgggtgttgcagtatgtcttcccagtctcatgcagactgcctgcagaggcaacagaggttgtagcatggagcccttgtctgaccacagatgcatctgtctgtctgtctgtctgtctgtgtggaagggtcaggatgtgaactttctcccgaaagtggttggcatttagaacacgggagatttttttcactcagaaacgcagcggcttctgttctctggggatgaggggcttcgagtgttgggtgggaaccactaggaagggatgagatagatctgggaagggtgttccgagctgaaggaacagccagcacaaaaggtcaaaggatcaggaatcgacagctaggcgttgggggtaggtcaaggtcactggctatctaggttaccatatccaggttgcttagctgccttacctaacatcagaaaaggcctcttctaggagtgccacggctgctgctggttctgttgagagagacactcgtggtacagagtcaagtggtcccaaggctgcctgctcagaccccctcccacccccaccgtgtctctgccatcctctagacaaaccaaattgcagttcccggatatgtgtccgtcattaaaaagaaagacaggataaaaaaaaatcaatccccaggcgctctggtctgagttggttgtctgcccagggtgcttggagcccagcggtgtttaagactgtgcgagccgcggccgtcagtcaaactgaacaggaccaagggctcccttggagagctgaactggccagtctagccggctgcttaggtgtgggtgccgtggctggggagaccacagagattacccggctctcctcggtgaggcagatatccctgaaagaactgtcacccagcagtttgtctcagtccccactgtctctcgtgagcgcctaggggatcggtgggatgtgtggggctcaagttctctgtctgctctttatcagcagcatgacccgggttgagtcacttaacctctctgagccatggctcctcatctatagagtgtggataccagtcggatccctcagactgaggcaatacacccaagagctgggagcccagcacagagaagcactagagagagctgaaatttataactgctattgtgttactccatagacgtgagcgtaccactcatggggacactaataacgataattagtaattatataaacaatagaataacaacataattaagatagcttgtaaacgatgtggtagaggatgcagatattacgtcgatgttagcaggaaggccagatgccagggaactgtgaggcgacaggacaggccagaaggcggacacatacatctgggctctgatctggtcaccagatgttggaaaggtgaccaaggtgtcatctgaacctggcttcctggaaaccgtgagtcttcaagggggaatccaaaggccacgggcagtgaccactcactaaagtgggaacagggtgtgcaaaggccccactgggcagagagcacacagacacacagacagacagacacacacacacacatgcacacacatgtaaataacacagaaccagaggaggacagttttaccaactgttcaacaccagaaaagccttgacaactttatttttttaaacagttaactcgatttccccacccccacccccaccccctttttaatcttgtgaccgtacatggcgctgccagggttcaagtcccagctattcgctcacaacccgtgtgtccttgggcaactgctttcttgcgtgaggcaggtgggcatgtcagtagtttgctgctgctcagggctgcaaggccgtgccttgtaggactctggctttagcataggtgacggaccctagcactgtccctggaattccaggccctggcctctgcggtgagccgcggggcagctgagatgggcccagcgtgttttctatgctatgtaccccatctctatgtgtgcttcctggagacagcagacaagaaagtgaggtcacctgcctacggctcccactccctcaggacaccctgtaaggtgtccgtcaaatctccagggagctgtcgctgtccgtgtgccctgtggtctggccttacttggtccacaagcctggtacaattcagctttcctctttgaacctcttcctcttgcttcctgccttcccccgtatctggcatcttcactgttttttgagagcacccagcccatttcaaccccagggcctttgcacttaccgtttgacctgtcccttccagagctccctccttggccttgctgacctctgcttatttatttatttatttagcccccatttagacagaccctcatcttttctgaaatactccaactctgctcgcactgatttgatcgtgccttccttcattcctacattcactcctttttccttctctgcgcctcccctcagagagtcgtgtcggagcacttgagctaatagacaccatacagcctcaggccactggtgagcctggtttatctttagctttgtgcatcttgctttagaaactggtgaccccaattccgagcctgggcggtgacccccttctaattaatgtgtctgtgaattaatttctggtggccgtgggccacccgtgatggttttcgagcccctgggcagggaggcttgggggcaagctctctgcctcagtttctttatctgtaggatgggtattagatccagccccctcctcctgggatgtgagatgaagcacagaggtccttggccacagcctggagccagcttgttgctcagcacccaccccagccttggcatgtcttgctcctgtctctctcactttgggcctctcgattagctcagaagcgtcaagcctagttggagatggctgttccgacgtcagatgagaggaggcactaagttctgcgaaggcacaggtgtgccccacggcttcctctcatccatcgggaccagggctttcctccttggcccactgagagccagcatccagagatgaagcttcctaggtttggggaggtcagagttcacccttgggggaggggagtccccatgcagcttggttcttgtgtctctcttccagcccttggctcacatcgctctgtgaattggaaggtcctgtcagttctcatttttgctcagtccgaggccacagctccctcaggtggtgttgtcagggctgcagcccagggcctgctggcctctgtgagcctttgatccactatggccagaggtaccagggctgagcccagccacccatccctggcaggccggcttgcacttgccatgttggcccttgcccctccctccctctctctcctcccctcctcccctccctccccttttcttcctcctccttctttttaaagtaaggtctcatgtagtccaagctgttcccaaacttgctatgtagccaaggacgtcctttaacttccgatcttcctgcctctttctccctggtgtgggagcatgtgcccaccacccctggtttgtgtggaggtggtggggtgcggacccagggccttatgggcaagcactgtaccaactgagccaagcctgtagccctcttcacacagcctgccatcagctgctctagaaagtgatcctggccagcagaacagcccaggcagttgaagcttagtgactctagagcagccgttcccaacctatgggttataaccctttcacaggggtggcctaagaccatggcaaaacatagatacttacattgcgacttgtaacagtagcaaaataacagttataaagtagcaatgaaaataatgttaccacaacatgaaccttattaaagggtcacagtgttaagagggtagagagaccctctgctctagaacattctcacattccagtgtctggatggacagcaagctctaaccactgttctgcccaccctcccaccagtgagggactgcgtggcgccccagtcctgtggcctgtgttccacaagatgaaattccgggctggcctgataataagcagctattgattcctgctgtggtcgttatcaagatttatttagtcaatatggcctccccgctcaataaatcgtgtcgttgataaagaaggaaggagacagacttgtaggctgtattaaaaaagtttttcagattttcttttaacagctggctccatcccccatccttcccaagtggagtctgtagccacagcacctgctggtgaacctgactctcgtgggtttgacgttatcattttccttctgggatctggttcaatccatcccgccagcacttcgccgtctttgagggctgacagtgcagttaccttagacgatagatggagactctgaagtccagtgtggtccacatgcccaaggtcattaggactccatccgagacagtctggctggggtgttggctcagaatctgtcttttgtgcagtaactggcaaactgtgtgtgaactaggtgctgtgagcaggcagtagggctgggaggaggccgcggggtgcaggccaaattgatgcttacgttcagaggaggagggtgtgttgcaatctgatgcaggcgactgtccactcagggtggcgatggaggcagccccgtgtggctgaggctcaagcctcgagaagaacttgattgggcagaggagaacgcttacccatgggcaactcgctgccctggggtgggtggaccacaccacactgccagcctgaggggttgaatgcgaacggtcctccgaaggctcacgtgtgtggtcagtcctcagctggtggctctcctgctcaggaggttggagaacctctgtgagtccaggcacgggagaggagggtcactgagggctatgggtcttgagggttaggagtctggctccaatgtctgtccacctttcccctgagatgtgaggaagtcaagtcccctgtaatggtgaggccgtctgccactgtgcattcccccgtattactgactgtgctcatccagagtagcccttcctccttcaagctgcccatcaggtatttggttagagtgaggaagcagcagcacaagggtggatttgtggtggaggctagccccatttttctgttctccaagaaaggcaagaagtggccgccccttctgcttaaccgccttctggaatgtctcttcataccatttctgtccctatctcgtccgcccactctgctgctacttctagctccacctcttcacaaggtcccctgcccccaacccccacatgtcttcgaggtccccactcccccctcttcccctcccacctcttgatgtcacttcctgtttatatttcaggcccatcactctctggtggcctctaagttgtggatccctctcagtgtctcttccctttgtcccctgggttacttgtcatatccacccctcttcccagtggactctctgttctccacctctgcctaccaaatctcccaacttggcagctttcgttacacagcattcaaaatctatttatcaatatcttaaaaaatttcttcttcttctttcctcttcctcttcctttaacatttatttacttaattttatctgtatgttttacccgcatgcatgtatatgtactttcctggtgcccgtggaggccagaagagggtgtcggatcctttggaactggattctcagggtcgtgagcttcaaccttttaaaacaccacgtacaaccttccgtgctcgctgggatccaaaccaaggtcctctgcaagagagccagtgctcttcaccactgagctgcctctccagcccctatggagactttctgaccatgtgtggtaaagacgtctctagctccagatgaccagaattgagttcttctcccccggagcttcccctgggggacccctcagatccacaagacaggagctgttggctccttgtctctgccttcgctcctcctgtcaatcatacagtcaagggggttcacttcccacttctcaattctctcctcccttctccatcattggcaactggcctgagttccggtcgtctctcctggacttggcttgcccagttcgttttctggactgcctttgccttccctcatgtactcacacaatggggtgcttatagctctggtaagaaccagctcctcccagtttttgaggccccgtcctcaggaatgactgactgttcagcctccacgcgccactttctgccctcagggtttgtagcgttgttgaagttgtgcctcctgcatcgatgtctccagctattgttgtttggttgtctgtttctcatttttgcttggttgttcgtttattaggtgcctgtaagtttataatgattatgccttcctggtagttagccctttcttccattagcagatctttcattctctagtcatagaaaaaggttttttaaaagtttattctgtttcctgtttgaaacctcttttaaaatttgtgtgggtctctctctctctctctctctctgtacatgcacatgggcatgcacatatttgtgcacgtgcatacgattcccttggagaccagaagtgggtgctggactcccagagagatttataagcaatcatgagctgtcatgtgggtactggaactgagttcgggtcctctgcaagaacaggacatgttttttaaactgcagagccatctctgcagaccccatttaatacctctttgtggcactttctacttttactctacttgtatctttgactctaaaatgtctactgtatatcatctgcagtttttaatctggtctgaaatcctttgccttttgattgggttgtttaacccactcatacttagtgtgttgtggatgtaccagagcttgtatttgccgtttttcctttttgctttcggtatgtccggtgtctgctctgttcctcctgtcttttactgtttccttgagaatttcctaatgtagcattttagtttaatgatttgttttaattgtttggttgtcttagtggttacatgtggtttggtttgctatattcattttagttcatcagattccggctcgggtttaccgctgtttgattccttcatgtcccagttcctgcacattcttggtaagttctctaacactgagcccagtcccgggcttctctcctacgcctgattctcagccacattccttgttctttccacactctagccacaggcctctggcagatcctcctggcatattgacacaccctctgcactgcgacacacttttctttctcccccagccccgttcaccccttctttccctctagtgcttgcaaaattggttcaccagggacctgtcctgtgagtgtcttgtccctgctcacttcctgtccacagcgcagcgaagctcttccaccacatgttcccatggctggggtgctctgcaggcacgtggggtgaatggaaccctctgaaaccatgagctgaaacaatcctcctcgcccttcagtagcttggtgacattggtcacagtgatgaaaaaaataacaaaaatggtgggctgctgctgattaagccttacccccccctgccgtggactcctgtctccttcaagattggatttctcttgtatctcatgtggctctgaagtcacacgctctagggatccgctgtggcagttctgtgactatgtggagctgattttgcctttgtttttgttttgttttgttgtttggcctcagtgtagcctgtctggaaaatgggcaggatttacatcaccacagatggaagaggtgcagaaaaaatctggtttttgaaaatgtatataaaatatgtattttaaattacgtttgtatgtgtgtgtgcacttgcatgtgtgtgcatgtgggcatgtgtgaatatgtgctcatgccacaatacaaatgcaaacaacaacttgcaagggatcagctctcatattctttccatgtgtgtcctgggaattgaactcaggtcatgaggcttggcagcaagcaccattatccccccaagccctcttgccagctcctacatattagcttttattttgtttatttggatttaatgagtggttaaacactcagtgcttcctaaatgcccccactcaagtgttttttattccctcagcagcactatgatgtagacattgttaatctcccccgttttcagacgaggcagctggtctcagaaaggtcaaggaacttgccttaagccacacagcaaagactggcagtctgagtgcagagtctgcatgtgtaggcttgcttacctgttattgtagaaactgggaagtggctactgtttgtctagccgcctctttcctctgctcaagccagtgtgtgtggtgtcttacacaagagtatgcagcccactgaaagcaggagggggaagctggggcaagcgtctctacaagtgggtaccacctgagcctctgagtcaggggatattgtgtccttttcctgtcccattaccagctgaggccactggactccgatccctcaggccagcagtctggagcctctccaagccatcctggcccttagaggaagttctctgcggcctccatgagcgagggagttggtcccacggcttgtgccctactttgagaactaagctctggaaatgaatcctttggagcgggagcgggagcagggcagggctctgcagaggctgctgcaatgtggggccccagagttccgggaggaacagggggtcaactgccttgctgccaacgtgcggagtcccaagggaggcagccactcttccctctgtctcagatgccccctcacaccctgtccaggtggtgccctgggtggatgggccagccacagtcgactgcaaggaagtgtccttagctgaggccactccctctctaggggacctcaatgtgttgacctgagacagcctgcaggcagcgcagtcagctctctctctctctctctctctctctctctctctctctctctctctctctctctgtgtgtgtgtgtgtgtgtgtgtgtgtgtgtgtgtgtgtgtgtgctttgtcttctgcccattgttttcagggcccttggctagaccctgcactgtgtcttcttgtgcttctgtggcacactggtggcgaatgatgctttttttgggaatagtgtttcttttcaaggtggtcagtgaagcaaggaagagtgggatgaagcagatcttgcatctctgaagatgtatcagtcagccatcgctgtgtaacaagatgcccaagaataattgtagatgcttggggtctgtcagtcagggatgagggtaaaattcagttgaagtggccatcaccagtctgtgacagccggtatcagccggaagtgacaggatgccttatattttggctgatgccggatgccagatgagcctcaccagtccgcagtactaccatgtagcctgccctgttgctttcttctcacggagcagtggctgggagcagagaaaaaggtggaaatttggctttcattatctaggcttggacaatggttgtcaagtcttcaagtttgcctcaagcaatagtcagtccaaaaggaaaggtctagagttcactcctcagtgggaggagtgtcagtcatgttccatgaagacctagggaagggagagccgtggtggccagcatcttggaaaaagatcttttctgtagaaaggctggtgctgattcataccggtcaggtccaagtgtggcagaaggtggccaagggagacaggaggtgagctaggttgtgtggaatggctagaagtaacaggaagtggccaggtaggaagcaggacgggagagcccatgaggagagggaatgtgatgagaaatgaccaaataggaagtgtgacagagattatgtgaagggaatgagtatgacaggagggtatggggggaaaatgagtgtgacagggattatatgaggggaatggatgtgagacaggattgtgtgaggtgagtgtgacagaagtatgtgaggggaatgggtgtgacagggattgtgtgggggaatgagtgtgacagtgtgtgaggggaatgggtgtgacagggattgtgtgaggggaatgaatgtgacagtgtgtgagggggaatgggtgtgacaggattgtgtgaggggaatgagtgtgacagtatgggaggggaatgggtgtgacaggattgtgtgaggggaatgagtgtgacaggagtgtgtgagggagatgggtgtgacaggattgtgtgaggggaatgagtgtgtcaggagtgtgaggggaaagggtgtaacaggtaagggtgaaatgaaagtcacaggaagtggctaagaggtcagtttggctttgccgcagtctgccatgatggcacaaacgacgtaacggagatgctgagggcaccatcacttcactctctggactgaccccatgagtgccttggtgtggctgaccagttctcacgtggggagccaggcctcatccagctgcccagaacccctaccttggccgtcttccgctgcctcttctctctgttcctgtgggtcttggtacccccactcccacagcagccccccttcttctcaaaagctcgactcccacctcagcagcctggaaaccctccaactaccacacttctcttcaaataaaagcagctaattaacattattctttaattattgcctttatcaacaaggggtctgattgctccagcagggtagtcgcttccccttaaactactcaagcgaacgcttcggttcctggtgcttttgaaatgaatttgatgtcatctgcccagagtcacttaatggggacgcctgggtaatgactgaacgcactaactccgttagcagccctggaagcatgtaatttggcccctcaggcaaccgcactttgaaaatctctggatagttttgaactctctgttcttaattaaatatgcaatttttcacggtaaccaggttaattcttttgtgttgtgttgtaatactgttaggaattttcatagttcttattaaacattattcaggcattgtgaattccataattaaaaaaaatgaaaagaacaaagcttgatccctcctttcttttttttccctggctaatttatcaaatgaattttgcaaatttttctttctgtccccagacagtgtggcaagtgttttaaaggggaaggatttaattgccctgtagggaatggctggttatgaaggatttggctgtttgattagtaaacccagttgggaccggtctaatactccatgatcttaaaaattgtctgattgcaccctctcggaggagcctcgctgctcgctcccgcccggccgcccctcacaagtttgattatgaagcggtagggaagaggaggaacggtcgggttgactttactttaaattgagaatcttgggagctttttggcccccatccccccctggctgaggagggaacaggagagacaaagacagagacacagaaacacacaaatgagggcgggggtatgtggaacacacagacagacagacagacagataggcaggcagagacagtgatagatggacacacagacaccaagaccgaatgattctcagatctcaggttccgtgaaagatggagggtggggtctgtacccttgctgctgatgacacccctccccccagcccccacctcctccccacagcaagctagctggggaggcagctcctaactgaggaagctctgctctgcagggaggggagggaagacccacttccattctgggattgggacctgttcccaaaacttgcagcctgccctactctaagcgcactgttggcaaaagggacagaagccctaactgcctgtaagtgggatgggcctcccggggtagaggggcaaagggtccggcagggaaagccagacccttgccatgctgagccatgggacctttggtttccagagaggccacctgctttttgcctcagtcttccccatctgtggaatggggatgatgactcctagccctttcttgctctcctgtccctcccaaatctgtgttcacacaagcacacatgtgtccaagcccatgagtgcacacatatgcacacaggtgtatgtgcacacatacacaaccccaggaggccggcacagggctgcctgcagtgcctctgccctggtctgtctatttttatccctgttccagtcattggggacaaagagaagcggaggaagatttctgggatttggggcaaggagggggaggtacaggccatgggaggatttgggggaaattgtacagcttcaaggaatgaaggaacatctatacgaggcgtcaaatacagaggaggaggcacgacacagaagcgaggcttggaggtctgctctctctggtccggtccatttcctgtgcccaccgtgttccgtgagactatccattcctgtccagtctttcactgagcaactgcggctgttgttggttttgtgtacatcgcactggttagagcaggttttcctagctagggccctttcggccctcttccgctgtccccgccctctgccccgcccagggctcaggcgtctttgccttgttctattaagagggctggaggctcttgtggtccaaagcctggtggtagaggcaggtgtgacccactctgggcccgtttgcatcagattggggacagtggagtgaatttgatacaggacctgcatacagtaggcactctgtaagtgctagaagtatggtactcatgctggttgatcctcctgtgtcccccagggtgcagtgggcactcacctgcttcaggaacattgagctgcttgtctgcctaggctggtatgtgcatttctttggggggctcttgtatgtaatgcagtccccccaaaaggagccccgtgtatattgcatatgaatatgcgtgcacacacaactaaggagtgttcatacaaggccgttccagcggacagtctctcttaccttactgtgattaaagatttatctctggctggagaacacagcacccggcagtagataaagtgatgtcatagtgacatgagaggccgaagactgctcagcctagaggaagcagagtgggcggggctaggaagctgagtgggcggggctaggaagctgagtgggaggggctaggtggcgatgacatcattccttcacctgatgaggggccagcaagctttgctttgcatctcctcactgcgaggcagccagccannnnnnnnnnnnnnnnnnnntcaaagtagactcgctgtctgccttcacggagctgcgggtctccatgctgtttagaaataaaatatctgaagagacaacggccatgattcagataatcacacatttgaaaatgcatcctatgctgagagggcttgggtgcagggtgagctaggaagggtttaaactgggatcagatttagtcttggtgtcagggaagaactcctggagtgacaggcgatgtagtaggccagggaatcggcatgtgcaaaggtcctggggtgaggagacatgcctgtagttgtagggaggggaaggaaacttggtgtggctgggtccccactgggaggaccctcaaatagccaaatacggctggaaggatggacagtctgactctgataagactgatttccaggtctgctgaagtctgtatccgggacagaaggggacagcgtctgcagaagttagaggaatggataagggctggaggatgctgcgactcagagcctggggtgggaggaatggccagtcaaggatgccgagcctccatctgggaagttgaaagatgcagggggccaactcagggaacaggcatgaagcaccttccctgcccaggtggagaggggtggggtggcttctccacagacaactatatactttctctttcttcctgccatttattattcacttaggggtttgtaataaagggaaagatttaaaaaaaaaatccaccattgcttgaggcacctgacccatgggaccaaacattttatagatgtgtatgtatgaagtgtgctcacgcttcaggcctggccagaataggatgtcctacactactgaggctggggtacctccatccattggggtgaagctggcatagtagtgctgtgtcttagttagggttttactgctgtgaacagacaccatgaccaaggcagctcttataaagaacaacatttaattggggtggcctcacaggttcagaggttcagtccattatcaacaagggggggacatggcagcgtccaggtaggcatggtgcaggaggagctgagagttttctatttcgtctgaaaggcaaacagaagacgggctccacttagcaaggaggagggtctgaaagcccaccctcacagtgacacacttctccaacaaggccacttctacttcaaggccacacctccttcaacaagaccacacctcctaatagtgccacttcctgggccaagtgtatacagaccaccacaggcagccatctataagatggtggtacatctctggtctgccctgagaaccagctttttggacacagtcaaactggggctggatactctgtgccagctgctagctggctagaaagaatcccttataagtcgctggggttgggtgatctggggtacttggtggtggcccctgcatatgagcatcacagtccccctaatatactgattcatggtggcatcttgagctgcagacccgtggctggcatctaacggctccctctgaaccctctggactgttgatatgtactgcccatttttaagagttgggtaaatgtgtgtttatgtcaggatgtgtccagtattggccacattggcatcagggaggatccgggcaagatgctctgggacaggggaacacacacctttctagaaggggccagctcagccccaatggcgttggagacaggcttctaacatgcaggctagagttaggaagggacctgcctccaaaagtcatgacagacggcctggggagatggctcggcaggacaagcgtttgtcacacaagcactcggatcagtgttggagtcccaagtactcatataacaaccaagacatccctgtgatctcagctctggaggtgtgcgggcttagtgagaaaccctttgcttaaaaagaaacaaatgatggggcagaaagatggctcagtggttaagaaccctgactgtcctttcagaggtcctgagttcaattcccagcatgtacacccacatgggagctcacaactgtctgtagttcctgttccagggaatctgacactgtctgtttgtctctctctgtctctgtctctgtttctctgtctctctgtctctctgtctctctgtctctgtctctgtctctgtctctctctctctctctctctctctctcacacacacacacacacacacacacacacggtgggtgcctggtggtggtgacacacacctttcattccagtacttgagaggcagaggcaggtggatatctgtgagttcgaggccagcctagtctacagagtgaattccaggacagccagatgcacagagaaattctgtctcaaaaaaccaatatgtaaatagataaacaaatagctggagagagtggttaagtaagaaagctgtcattgaccctctcccagccccattctcacacacataaacatgtatacacatatgtcacacacataaataaataaaatagaggcaggaagagcctggtgcttccaggggtgggatgagaaaaaacgaccctgtatgtcacatggttggttctgacagtggctggtcattaggtcgttccttgttatattccatgctttctcagtcacatgttccctgtggtaggacagccgagggacttttgacagggtctctgtggtgtcaacaaatgcaggaagtctcgatgcagaatggcacaccatctcttcaccctgacaggccttggacttttttttttccagatttatttattatatgtaagtacaccatagctgttttcagacacaccagaagagggcatcagatcccattacagatggttatgagccaccatgtggttgctgggatttgaacttaggacctttggaagaggagtcagtgctcttaaccactgtgtcatctctccagtcccttggatgtgtgtgtgtttgtgtgtgtgtgtgtgtgtgtgtgtgtgtatgtatgtgtatatgaagttgaacaagtggagagacccatctctgtgcccgaatctttaaagatttctcgattttatggtatttgtatgagtgttttagacgtatatgcatgtgcaccatatctgtgcctggtgcctggtgccttagaagccagaaagagtgtcaggttccctagaactggagttgtgacccaccacctctgtcctctgcaagcacattgctctgaactgctgagccacctctccagtctgagtcttacattgccatcatatgggaaggagggtctgggacatgggaagcgctgggctcagtgctggacacatagtaggtgtgcaataacggtcactgctattgtcattatgagagtaaagaatggacctgccatgcatagattccgctcctgggctgcttttggaatgttatggattacataagtgggtctcagcctgtgggtctcgaccagttaggagtaacatccagatatcctgcttatcagatatttacattatgatccataacagtagcaagattagtgttacatagtagcaatgaagtagttatggtggggctggggggtcaccacaacaggaagaactgtattaaagagttgcaggttaggaaggttgagaaccactcatttagctggcaaacgccccacccatccccaggctcaccgtgttccaacacttgttctccaagtgtccagctggctgttctaggtcattgtgaaaccttttaagaggcggagccttctaggacagagtgggttgctggggggtggggttggcggttggttagctttttcccacttcctgctcagttcacttattgtcccacccagatgggaggaagcgaagaggctcctgcttccctggtgcacgccacggcggcctgcatccccctttgactgtgagccagagtctgtcttcctcccctaagttgcttttgttgtagcaatgagaaaagtaaccattacagagtctgtgggtaataagccggttctcagaggctgcctggtctgatcctgcttttgtggtaggttgtaactttggacggaaagttcaccctaggtaagatggtttcctgctgaattctataatctgggcggacctacatgccgtaagtcaaccaagtgaacatttttgattttgttacccgaataccatcttgcacaacggcttactcgactctgctctgtgggaaagcatgtgtaaataaatactgggtgagccagagatggggtggggtgggggtggaggatttggtctgggagataaagcccaaagatcagaggtcattcaccctggtggtgtttgtttttactaaacgtccagtggtattagcaagtaagaacgtttttcattaatttcctggacaaggttgtttatttatttatttatttatttatttatttatttaatctttgagacaaggtctctctgtgtagccctggctgtcatggaactggctctatagaccaggatggcctcaaactcagagacccacctgcctctacctcccaagtgctggggttaaaggtgtgagcctttaactgccccagcttggctcaaggttcttgggacctgcagcagcatctatgctgcctgggaatcagtttgttcagggccttttaaaaacctattgagtcagcatccctggggcagtcttgagcctaacaggtcacccgggtgatcccactgcaccttgtagagttccgaacccacgtgagtggagagccggctccacgtgagtgcactcacggtgcctatgtatgacctttcgatcccagtagagaattctcttgcctccctagggatcttgagcccccaaagggttttccctcccagttgtggggtcaacacatgggttaagagcagcggtccagagtctgctggtgtcaggttccgctccagctccgactttaaacaagctgtgtgttctctgcatggctctgtgcctctctgagcctcagcttgtcctcctgtgggatgggatgggatgggatgggatgggatgggatgggatgggatgggatggggtggggtggggtggggtggtggggttgcccacgcatggagaacatactaagttctcagtgtgtggccctatctgtggctggcctggccttgtaaggtagcttccatgatcatggacttggggatctctacctggtgaggtgggcagatccttgcgcacgttaggaccagcaagtgggcaggggccacggagtggcagagatgccttggcttgtccccatgccacccccactcctggagtgaccatcacacatcctatgtctccatcaattctgtgacaaccgaaggagattggggaactgtcgttcccacacccattatgtgctcccagtgattggcttaaagggaagtcatgtgacccgaaccgggccaatcagagacttgcctggtatttttcagttggctcaggaaagaggaggttttctctcttgttgagttcctgaacgaatagaaatttagaactgagcagggcagtggtggcgcatgcctttaatcccagcacttgggaggcagaggcaggcagatttttctgagttcaaggcgagcttgatctacaaagtgagttccagaacagccagggctatacagagaaaccctgtctcgaaaaacaacaacaacaacaaaaaagaaagaaaaaaagaaaaaagaaaagaaatttagaactagcacctcatttttgtgaggacaaactgaaagtcacctgcatgaagtgactgagagagtcaggtttgcatctctcccgacgccgttgtcattgtctccatatcatggctacaggagtatacctgggtcctttaacgtatttaagctgcttcatattaaatcaatattgtctataatcaaacacacacacacacacatacacacacacacacacacacacacacacacacacacttgcactaatctcccatgttttatgatcataatttctataaggataaagcagaaaaaaaaatacatggctgctgtctgtcctggtgcactatattgttcagaggtcttcacagtgatgacggggacatggggacataggggggggatagaccatatctcagcgtcctggtctccagaatccccttcccatgggaacgtctgtgcagtgactcacagtctttgtgtccaggtctctgacagcttttggcacagggcgaaggtctctatcctcatggcttcccagtgttcagatggctgtaggggctccctgagactgctcccccttaccctctagcatagaaggtgtggctctctgggtgtaaaagtagcatgaagacacctcattcctagcatctgccttctcacctactgccagtcagtgtgatctcccctgtgaccttacaaagattgtcaggatcaaggtcatttctcaggctttgttttcccggatgccgccatgtctaactctgccgggatggctcgtttctcctcgtctcccgttcccctctctcttgggtttatgctgggtttggcaggttcaaaccaaaacaactcagagggcacaggaaaaaaaaaaaaaccaaaaaaaaaaaaaaccaaaaccattcctgtgtacagagtgatggggacaaaagccagcaaggtgtcccactgctgtcctttgaaggtgcttgtcagcttggtggtgagaagtgccaggtgtcaccccgtgtgactggagatgccatgagcttttttttcccctctctctcagaaagcctgcggctcaacctccaggctctcagagggcctgaagccacatccgttttctacagggatgaaaggagaccagcggagctcctggccttagccatgggcacccagcagggaccctggggctgtggctttgtaagcccacctgctctgccctcatggctcctctctgcccctctttgtaatctatgtggccatgtgtggctggcacctccaggatgagccctgagaggaggtagggagctggccatgtctccttgctcccctgcgggtaggaagagaaatcttggggtttatgtggctcgggagtcagacttagtctgggttcagatcttgactctgtcatccttacagagacagccctgtcactttcctgagcctctgtgtcctcatctataactaaagcttcaggctgtagtgattgtaacttggatgaaggatttttttcttataggtcacagctcaggggatacagtgcagcgtggagagagaaacatggcagtgagactcttaggtggctcttcatttctacccgggatgaggaatggggtcaagatgtaacccataggcccacactgttccccctaataactctcttctcgtgaggctctgcccccttttattagatagatattctacagctgtttctccaggtctcttctccctctcttggcatggtcttttgcagagcagacaattttaatcaattttaatcttcattatttgctgtagaagactgatttttcttttattttatgtgactgtgtgtatgcacatgagtgcagtgcccatggaggccagaagagggtgtcaggtgcctgggagctacagggacagctgcctgacttaggtactaggaaccagacttaggtcctccgcaatggcatcttaactgaggagccatttctccagccctcaagccttgtaatataatgaggtcaagcaatcgtttctttcaggtctttgaccgccatgtcccaggtcatctaggcagcctcccggttctcacacagcatggtatactgttctgtccgttttgagttgatttgggtgaaggctggcaggtctcggactggatgtttctgtgtgtggctgtgggctatggatcagcaccgtttgtggagtgactaatctcttctccctcacagtgccttttctctttcatcaaagctccctcgatggcatttctattgttctttgctgggctctgggctctgtccttcctctgtcatgccgaagtgtctagaagtgacggttcttctgtcaactgtgcatgggctttctagatctcttgtctccacagaaacctggcttttggttgaccctttttctttttctttctttcttttctgttttgtttttgttttgctttgctttttgaggcaggctttctctgtgtagccctggctgtcctggaactcactctgtagaccaggctggcctcgaactcacagtgatcgggctgcctctgctcccatgtcctgggattaaagacgtgcttgatagacatctcattgagtcggcagatccagtcaggaagagctgataccttgatggtactgaatctggctgtccatgaacatgggatgtccatcagtctacttagctcctcgcctccatgcgtgagagtttcccagttttcctcttccgctcctgtgtgagatttgaaggttcagtgttttctgcacagagaaggcttcatgtgcagggacaccaccattcctcattggttgattgacttttttttttttttttttttgagtcaatgttttacttagtagtcctgcctgttttgaaactcacagtgatcctcctgccttagccttccaagtcctgggaatgcggatgactcttattctgccactgcgggacgtttgagagactttcagtctgaggctcccttagcagtgcgtgagtgtctgttgatgcagagggacttgtgggcgtcccaggcagagatcacagttcctcagatataaccattgacctggatgcttggtgacacttgcttatgggatccccatcaagtgtggggggagaccctccattaggacagacagaagtgtctccagggaacttcctggagcatcccatagggagagacactggtgtgaagggaaacctggctggctctggacaacgtgtggatagatatagctagagacgctcataatgacttccaagcagggtggcacctcccccccagctaagtatggcctccaggtgttttcaacactatctatctatctatctatctatctatctatctatctatctatctacctacctacctatctgtttatttgtttgtgtacgtttgcatgtatgtatgcatgtggtatgtgtgtatgtgtaggtaccagaagaagatgtcagacatcccattccatcactctttgccttatttcttgagacagggtctctcactgatcctggatttaggttggcagccagcaagctgctgctatcctcctgcctcagcaaccacccgcccctagcactggagttataggtgctgctctagtgagcttcagctgtcaaggtgacacagcctatggtcatgtctgtgagggattgtctcaatggaggactgatataggagggcacagtccactgtgggtggcaccatccctaggcttggccttgccaatgagccagtaaacgctgttctttcgtggtctgcctcaggttcccgccttgtgttccctcaacagtatgcagaacctgtaagatgcaatacatgctttgggtaaaagtgtgctatcacaagggatgaagggcagatgctcatgcatagaccacacacacacacacacacacacaggtgggtactggggatacaaactcaggttcttgtgcttctgtagcaagtgctcttagcccagctcccctttgatacattgtcacataatgtgtttctgatgttagcagaatgactactatgctttaagtgccattacaccatttctctttactcaagggcgcacatcttttatatcttttgtttggtttttgggtttttgagacagggtttctctgtgtagccctggctgtcctgtaacgctctctgtagaccaggctgacctcgaacccacagaaatcctcttcagagtctctgcctcctgagtgctctctctttaatttatttaaaatttgaggcagggtctcatgtagcccagtctgccctcagaatgtggctgaggataaaccatctgtttacatggctttggggatggagccagggcattgcacacgctcagcgggtactctgctacctgaaccacgccccaggtccagccgttccttaagagatagcagtaaaaggatctaagtcattcatctgagggatttgactgcctccaacctgtgtctgtgtagacgctgtactgactgtcctggctgggtgactttttttttttttttttttgtaaaaagcttcctttacctctctgtggctcagtttcttcagttgtaaaacagaggccctaaagctgctcacctcctttatttttgacgattgcatgagttgatcgataaacacttggcgtgtggggacagggctttccagtacagttgaggtgcactggcctagagggcgttctgtcctgcagaggagctgaagctaacaggagaccttcagtgagaggctggaatagccttcagttttgctgccatgtaaataaataaacacacaaataaataaataaatctacaagcgtaatggccaataataataatagagaacaaccagacgatgcccagtgaagttggaattttaaataaataactctcactgcaaagatgtcctacaggatattcgagatatatttaacagttaagaaataataatcagtgcatcgtgtctgtgactcacactgatgcgtccgtttagctgggcaacctgggtggctcgctctctttagtttacttatttttattttactccagttttcagtttttagacagtgtcttgctgtgtagctcaggctagcctcaaacttaaagtcctcctgcctcagcctcctgagtgcggggtgggatttgggccgctggttggatctgacaaccccctcaccttgagtctcttccaggcgccagagtagccatcctagaggctgtgtcctgacccggctgagtttctcaattgattcggtgagatgtgttatgaggagctcctggcttgtccccgcaccctgtgttgccctgtcacaggcccaggtgcttcctaaccaggacacaggcctgtgagttcttcaggacattgaatcaagggtcacatgtgggtcctcctgcaccaagagggtcctctgtgtgctgcgccctgcagtcggctctgggcagcagatgagcaggctggcgctgtctgcttctcatcccggcagacgccggagccaggctggggacatcctagcacgggcctccgaagctgaaccccggctgcagggagcctggctgtggggagacgggctgtgggcagccaagctcgcattgatcgcagttcttggaaggcccgtcacgaggacaacaggcagagagtaaacagtgcgttggtggccagcagctgccagagtcgggccagctcacttctagggactggccggtactgtccattgccatcgaggacttgctgccactgccctcctccaagtctgagacctcctgagaccctctggccaggtaaggttggaactggctccaagtctggtccctgggctctcagcattgcctctttcacccgccccttccctcctagagccttgggggcttctggctcctttgttcattcattccgtcgtgactagaccctctcccaggcctgacagcactgtgctctgtagagagggaacatcttcttgcctcagcccctaaccctggagctgtctcctgcttggctctgggggtcaggctggtatctgtgttgccgtgggctgccacccaaatggctggcatagggacaggcagaaagggcccatgatgcgggtcctggagcctcccacgcagactctgctttgagaagggcatgggtggctacagatcggcatggctgttaagagcagattctcaggtcctgaagggtctgcggcaggagcagccagtcagtggcttgctggaaactcaggcatctcagtggccaggggcatggaagccctcgggtgctctcaatgctggttctcttgcgtgttttgtgtgtttgtgttgcagaaacgcctgtgatgctttgggttttgtgtgtttgagtgcttgcggacggtcagtgctgagctggattgtgggaagagggccatgaccttgtaggtctcagtactgacgagcccaggttcagaaaggcctgacgtctgatctggggtccagggtttgcttgtgtgccaagcagtatgcgaagtgagcctcaggagactggagtttgtagcatcctgatttaagggagagtactgaaacacagagctgtcagtttgtttttctgcagtcacacagccggtatgtggtagagctgggttttgaaccctatacttggctttcaaacacaatcacatgcggttccgctagactctcatgccctggagcacaagtggaagtcattatcacagaggaggtggggcgagttcagctgggtgtgcaggtaggtgactctagagggctgtgctgggccagtgagctcagtacctgtcctttccttgttctcccatcctggactgtgacctggagaactggccattggaggctcagagaggtggtgccactgcccaagctcacacagctaagatgtggtggagctaagattcagactgctcagctgtgtgcttaccctgacgttgcttctcccagcggccccgggtcagggagcatctgactctcccggtctgttctcccggtctccgggccaacccattcccaagccccgtggaagccgcttccattttctcctcccatatttatccttccccttgggtcagctgttaaatgcaggccgtgaagctactatattaaattcagatggccttgttgccctgagagtccctacttgctcagcagaatgtaaactgacagggtatgtgtatactgggggagggggaggagggtggggacaactctcccttcctccccaaatgcctcctgccatcactgctgtggtctttactgtcagcatctactgggaacactgtgtgaggcaagaccttgacattttcttggggtgtcaggannnnnnnnnnnnnnnnnnnnttgctttggtaagatttggctctcaggaaggctctgattcaaggtcagagagcttagaaagcagcaagaaggccaggaccgccccagggggtccccactaaacataccagcagccatctctgggcacctttggccagcaccccacacagcctcagagccttcctttgtatgaggaggcaaacatctgaaggatatagtttggctgggcctcctttgccaaatgtcactccgaggctttgtttattcatcctgtttctatagttcaagggaaaccatctcttaacttgggactcaggaatggccttcctcaagccttgtgtccccaaaggccctggccaagctgcccatcctcctcagagaggccttttagtcaaaggcacagcccgggccaggtcccagcggatgccagtaatgtattcacaggcgtgacacgcagcccccgcgtgtcctgaaccccggcctcccgggattggtgaggccacaccatcgatccaaagccctggaccgatgccccggtctaaatccatcaggcccagcaagcccccctggtcgtgggccactgaataatttacggtccctgggagcagtggggagcgggtcactggagttcatgggttaataacaggtttggttttcgatgtcagcagctctcccgataacgtatgaaagaatcctattctgttgattagattttgaaatggatcaatttttaatcagccaaacacctgactcactcaataagccctgtattgtgcagacaggatggaggctggctttatttacaggagtgtttgtttttttgggggggagacctgtacgcaaatgcccgcccccctccctcctcctggcagaaattgaccgggttatctctgacctcaaatggcagcgtttgattctctttctgattagttgggaaatctatgggtctgtttaagagataagaatgacagctaacagtttgattcagtcctcgtgcttattgatgaagagagcatttatttgccaatgaagaaattttgcttaatgtaacattgaaaaaggaagaggagacagcgctggctctgggctctggctgtgccagggggtggagggttgctgggttcctcggggctaccctgcgaggttcttaaaacagtaaacaaatacaccaaactgtaaagatgatggaaacggagcagggtgtggcactcgggggatcactttatttattcactcagcaaacaccagaactggtaagttcagactccaatggaggacagcatgggggtggggtgaggggatggttctggcagttctgggccctggtcaagtggccaaggaggaagtggtgttgggccagccctgcctagagtgtccttggtccatgggggccagagggccattagtgaaacttaagcacttcactgtagatgagccctcacctcaggtcttcctgcaaactcaagagctgggagcaggggccagagaggatgtgttagggctgggcctccagcgtgcctttacaagccagggccttgagtagacaaacaagcaaattagagcagccttcactctagaaccttctagaagaactcatcagaaactgctggtggtgggagtccctgagatgcgttcttgggtaggctagtttgctctttctactgaggcatgtgctgtcatttggaggtataccttggcatgcacctggggaccagcagtggcgttcaatgtccccacgagggctccaagggtatggtcacttgcctgccgctgtgatcattcagctgtgtgcagggagtggggctcagggcagctgccatccccctccttaatgtgactggtggaagtcatgaacttggtggcccctggagcaacctcgataggattccactctcccaaggcctcttggtccaagcttggtaggtgtggcaactcatcgcagggagacctctgcaaaaagagccagctgaactggtgttagagaaagctcggggctctagctctggcctgtcactcgagttccgtgtgacctgaacgggatctggttttctgggcctttgtttctcgaggatagaatgggagttaagaggaacgtcacgattatctcagggcctgtgggcctcctgtcccgtcttctcatgcagccccttcatttggctggtaaccacccccaaaagaatgttctttgcacgcccatgcacaggacactgctgggccatcctcacccccctcagctctcagcacgaatgatcgcagactctgcacacttcttttgctgatcgattcttctcattaaaatgccagctccgagaaggcaggggctttcgtctcttttgcgtgccttcctgggtcaagcacctgcagtggcatctgggacacagttaagttcctggggggggagggtgctgggggggaaacgagacgagttgacgtcatctcagcagcaaactctcttgtgcattcttgctcacgtgactgcctggagctctttgagccatgcggtttcctcctccgtcggatgctgagatctctcctaagacgttggcaacagtcagccgatgcggatactgagtcttagtccaccaccggaggagcatatgattcttcagtacacaggggctggaggagctgtcagtacgtatttctgtaggctgaaaagccaggctgcgctggtggggaccgagaatcacttctctgtcaagaggacctgacctgggcctccatggtaaccagaagtcaagtctattcccccaaaactcccaatatgagggactgactccccaggcacaggtaggggtggagttggcctctcaaagagcagcagtaggaggggctggacagggtgacatcaggacctcatggtgatcagggtgattgcagatacctggaagagccctggtgtggagactgcatcatgtgtagctataacagagctcccaggccttcacctgctagtgaccatgcgtctggcttttttccaaagccacaaggccaccctttctctgagttgagcgtaccagagcatggagccccaccgtccgttcctgggagtgtttccctagaggaagagccggggtctggtctctcggagggaagtaatgattcttgagttcaactgagtgacagatccaaggtctagaagaaagggatttttcctgtgacattcgtcggacacctactctgtgcacaccacaggggccagcctggtgctcacagggattggactctggtggtagggcccattgtgtgattgctgatgtaccctccacaataaggatgggggggcagtatgttggggctgccagggtagctgggaagagaggctccagggtgacctgcttgggacccagagaatttagtaggtggctttggtggggtccttgccacagaacctaaggcaagcccacagtggcttctgcttgagccctgggggaagagaggttggtggttgggagagggaaccttgggtcaccgggggacaggagggtctatacgccccttccttctagagttcacaacctgtggatgtgttgagagattacctgagagagcaaactttttcccttctccctccccgcccccccaatcttttttaaggccagtttaaaaaggctttctttccccccttctccctgcgaacaggccaggggctgttacggaaatagtaaacaagggtgctcgcagaagctgctctgttttaattagggcattaaagtagcttagcgcttacactttatattttttgtgaacttgattgtatagcattttaaatacctgtgaacgttttaaggactcagggcgatggattatttgcagtttcacaggaagcttctattttaaaagcaggccagggtgaggggcagtgcaggcttcgctgcggtgcctcctgggggggtggaataagtcagactgatgttgactgatgaccaacggtgcctggctctttcttactcagccactttagggtcccctctgcagagggtgcaccctcctgggtgccgagccaggacccctacgagccctggttgctcccaagccctggtcttttcccaatgtggcatatatatatatattcctctccctccccaaggccttgggcaagcatcctgatgccctcctatcctcacccttccattctgactccccacgctctgcattccgccataatccaggcttgcctgtggttccctattctctgagcatatagtcatcttatgaatttatatatatatatacatatatatgcatatgtatgtgtatgtgtgcacacgtgtacagatttgtgtggaggtcagaagtcaaaatcaggtgtcttcctcaattattctctgccttaaaaaaaaagtaatttagttaatttgattcttatgtgcatcagtgtgatggtgtcctctggaactggagacacagttgtgagctgtcaggggggtcctggggactgaacctgggccctctggagtagcagctggcattcttaactactgagccatctctctagccccgcccccttctttttcttcttcttcttttttttttttttttttttttttttttgagagcagcatctttcgctgaacctggcacatgccaactaagctggcattccaggggatccacttgtatccacgtcccctgtgatgtgtgatgaaagagaaacattgccatatctgtcctttacacaggtgctgggtgggagtggagctcaggtccctgggcttggatggcaggcactgctgtattggctcctgagcaccccccaccttgtgcccccgcccctgttggtattagaccagtggttctcacccttcctaacacttcggccctttaatacagttcctcatgttgtggtaactccccctaccccagccaaaaagctactttgttgcaacctcataactagaactttgttaatgttaaacccccccaaaggggtcgctacccacaggttgagaaccacctgcaccaagcacacagctaacttccctgcccaccagagctggaggggagtaaagtaattgtaaactgtgtggtgagtgggtctgagcaccctagagactccctccacttaaaggctccatccttagcctgaggttgggagggggtggagcctctaagaggccgcctagtgggaggaagtgagaccactgggcatacccttgaaaatgctgcccagggctttctctgcagagggaagctgtttgccaggttcggaaaacaccgggaagccagtgggccaaaagggtaaagtgggtaaagccaaaaaaccactctgcttgcttttggtttggacatatcctgggtttgtttgtgccacaggacctttgcacatgccatggccttgcatgattccttcagttctcactttcagagagtccatccctaacccttttaggggaaacactccctatccgtccgtattctgtctacactcttgcttccttctccaccatgtggctcaatcttccatcaggtggtaggttgtttatctgacatcatcctgtgttgcaaaatgctgttctctgctagctcctcatctggcagttggggctgagtggatttcttgtcggtgatggccgctggagaacactcctgagcccgttgttgcctggaaggtgcactcagtgtgacgatggggatccgggatgtagtggcaggctgcctgaggcgtccagctcagacctcacctagcctgcagcccgataccaggcccttgaagcagcagactgacgacagacatacagcaatggccttggtggtggcccctgccaccagctgctgaatcctgttataaaggaaggacgtgccttccgttcctgccagaaacacggtgataggcaagctgggtagaaatttttaatnnnnnnnnnnnnnnnnnnnnnnnnnnnnnnnnnnnnnnnnnnnnnnnnnnnnnnnnnnnnnnnnnnatctaccctctatgctgttagaatctgctttcctatccataaccctaggttatcacttactgtttcatctgggctgcttttaactccagttggccagccctcagggtcatgttttttttactcctaacccatggcttctccttcctcctcctgcaccttctgcttcttccccacgtggttctcctctgaccccaagcccaggaaacctaacccccccccccccacctatgtctcttctgcgccgccattggctgttggcatctttattttccaatcagggtcacaggtctatttgcagccaccaggagtgccccgccccctcactcagcatcacagtagacagcaagacccaaacctcaactgtaagctacttattccctcggtgccacagctggtgcccatctggcctgagagtaggggagagccctagggtaggcctgagattcctgttggttcgtggatggatgaagcacaggggcctctgatgccagggactttgtggcccagggcgcatccagtggggggaaccgttcggatcaaagggagcaagtccggctgacctgatgatttctttcttctactgatgagagctcggaacacatcgattgaggtgatcaacatttagatctttcatagttaatgaggagctgtctgattgatattggaaacagtcactgcccggggcttttaatgaagcccacagaacggagagagagacacttgacattacaggtagagggatgtgggcacgtggagagcagggttcttttgcagcctctacccctcctggcagtgagtgtatcctctgacccatcccttggcctctgggactctttgtatcatcttctgtgacgtgggaagggggggaaggggtggtcttattctctccggggagacttcatggcttgtgagggtcagaagtgacattccatgcgaagctcttggcatgatgggaacacagcgaagtttcctcttggtacctggccatgaggtgagtgcctcaaaaccctgcaatgctgtagaaatggtgtactgtcgaatttttcccactgctgtgggtgacagtggtgacctagacgaaggtagacactgccttctctggtcagcatatcttcacgctcctgggcttggccatgtgcgatccaaccagtcactggattctgtgtcagcaaaggcagtagggtatgtgtaggggtgactcatggctctgacatccttttgcctagagcaacacttgaccatagtaggaactccggtttttgtttttgtttttggattgagtgtcagaacctgcctggaaggggagtctaagaaccaagggcaagatcccaaagaaatggaaacttgaagttgatacaaacctgcacaaggatgtccctggcagctttatgctcaaaagcctgagattgaaaacaagccagctgctcttcagtgagcccatggttagacctgtggcatttccatgagtccatggttgtattatggtatgctcagatgacggttagactgtggtaaatctacgttagcccatggcctgattgtggtatgtccatgtgaacctttggctacactgtggtacgccaatgtgggcttctgtctagactgtggtacgcccatgtgagcccatgcttatagtatggtatgcccatatgagctggtggttaggctgtggtgcacccacatgagctgttggctagactatggtatgcccaagcaagcttttgcctagactgtggtatgcccatgtgagccttggctagacagtggtgtatctacatgagcctgtgattagaccagtacgcctgtgaaagcccttggtatgtccacactggagtactctgatcattgctaaataaaagagtaaagaaatgttagtgaacaacatggaagagagagtaaagaattgtgttgagttggggctggtgagatggctcagtgggtaagagctctgactgctcctccaaagattctgagttcaattcccagcaaccacatggtggctcacaaccacccataatgagatctgacaccctcttctggtgcatctgaagacagctacagtgttcttatgtataataataaataaatctttaaaaaagaaaaagaattgtgtggtgtgaattaagccccgtaaccaaatgactcctttttctgggggaggaggaagagggacagggtctcaggtagcccaggatggccttgggcttactagatagcataggatgaccttgaactcctgactgtcctgcctctacctcccaagtgccagaatcacaggctttggaccacctggcccctcaaggattccatgtggtgataggaggattccctgtggtaatgtcaccatgttacagagatggaaacagaggacttaaggggcttgcccaaagacacacagcctgtgtataatgagaaggcaactcaaacccccccaggcccgtgacttggaattcctgcacaaagggttccctgggcttgcagggctgcctggtcctgagggaaccaccgtccttgtgtctcagccctgccctctgccctcctcccctcaccgaggacgttgctgtgatttgttagatgttgttatacttgcttagaggtggggaaactgaggcagggggagggactggggctattcaaactgagacaaggtctcctagccccagttcccggggatcggacacagcagctgtttagcttatcatgctctgatgcgttcttggagttccccctgtcccgggacagtggccccaggatccaggctctgtaggccacttctagctgagctgagatctagtctgtaggcaccaggctggggccttgggcatctgcctgctcttctctaccccagcgcagcctcctttctgagagggatgaattggttaaggaaggaaatgtttatagggctggtgaggtggctcagttcgagtgcttacatgagacttgagttcggatccccagcacccagggacgaagtgggacatgttaaagcacagacctgtaaaacgccagtgctgggaagctggggtattgagaatcccaggggctctttggccagccagtatagctgaagcagagaactctaggccagtgagaggctctgtctcaaaggaggtgggtgtcgttcctgaagatgacacctgaggtcatattcgcacgcacacacacacaccacatacaaacatacatgtgcacatgcacgagcactcacacaccagcactgtcacagagagaatgaccctggtggggcagctggccccgtttggcctttctgctcaggtgtatgtgggggaatagtcacacctcagggttagtcacacctcagagtgacagaaaaggctctgcctcagacgcgcctttccaggaaggcctgaagccaacagctagcaccagactagccaaggtcaaggtcccagtattgaacacacagcccccatgttgacttttcccagccctaagaaccttctagagatccccatcattgctgctagcttctgtgtggtctgtgtagaagaagagctgctggcacattctgcaggcgggagctagacatggccgtcatgtgtacccacatgatccatccggaggtgggagtctgtactgcaggcgttgggccacatgccttctacggctgtcctccctggtatccctccgtcagtttcaggcagctgtctctttctacatgggcggagacagtcatggggggtggggccaccctagccctgtgtgccaccatcacttgatttgttgacccttccaaggtcctagatctggccacgactcgggttctgagacgatgtcagtttttgggggtcaggcttcaatgcaactcagcattattagtagatatttgtggtgagggtatcttctatgcttggaatttggggtggcagataaaaggatgctggggactcctcccctaagggtgacagggacagggggctttgcgggtctgtctggatgatgtttgcctctctgtaactgcgggaacagctacagatgagccgtttgccataatggggcactggccagaggttgctagatggaccttgctgagccccaccacctcccacccttgaatggtgacagctcatgagaccctccctagtcttaaccagttagagatgccagtgggtcctcccatgaagttcctaacaacttactgttgtggagttcatgccaggggtaggagatggggggggggggtagatgctcccaaggtcgtcactgttgggacaaggaatatgggacttagagaaggttggcccaagggacagacactagtttcaggaactcagcttcactccctctcccccatgggccagcaggactgatctgagccttttactgaaaaagccacagtggaatcttcgaggcttctctttggaggggtcctgcaagggcggggggccatggccacccctttttacagacaaggtaacaggctcaggcagggtgaaatccaccatccacgaccacccagtcagctggtgacagagacatcagtcaaatgcaggcacattgaggtctgtgtctcccttccttaggtgcctccgtgcctcagtttccctatcaataaagtgacctttcctccagtggagtcactaggtccctctacctgcagtggaaccactggagcctcaggaaagtgacaagatccctggcttgccacagcaggtctcagcttctctgtccctccctcacaccgcgacttgagatctttacacggatgggtactgtgtgcggggtggtgagccttggggtgggggtgtgtgtgagcgcgtgcgcgtgtgtttgcaacaaatattttataatagacaggcctcgtctgccacttctaaaagtagtggggaaaaaaaaatccacctcgagaaaataaaaataacaccaatgcctaagatgctgaagtcattagctcggtaggggcagcaagcaggtctggggctagaaacttccgtgacagatgcctacactcatagggaacaaatctccatgattaggttgtggacaaagtgaccacctgtccacatctctcctaaccctcagagggacgcctccagagagatgaccgtcttccgtacttttgtgacctgtgaccgaaggattgatcactgccctggtggcagccatagagcttttatttcgtggaagccgaacgctgcctcgtgaagtgggaacttggccgggcctttgcatccatttcgggctgcttgaaaactttatttcctgtgactgccaccatcaggagtgagccggtgtgtacctgcaggccccagctgggaggggactttacggagaagggcttccttggcggccttgggttaaataagtattggctgctgatggatcgagtggcctgggacatcaccacggcggccttgatcctctctctccacatcaccgaggaagcttggtgagcagggtcactggccagccgtgtcaggaccatcagggcccagagctgtgcgaagagggagaaagagatgctgtggtctccagccactttgctgtcacccacagccgtgggagtctgagggaggagagagccatcctttgagccaggagggctgatgggaatgtggatctgagatgcatgccttaactccatgttctggtagcagtagagactggctcctattgttaccaccttttaaagcattgacaaatggtggggtcctgtggcgtgtgtctgtttcatctgtaggatgagaagtttggttggtttcctgggctgtggggttccccccccccaagtagtttctttgatctaaatggactcatgagcaatggagccccatctccccaggactagtcaccccctggcaatcctcacaggtggcttttgttgaatgcctgactcactggggagaagaagaccatgtggcagttgggatcacgtctggttcatgaccagctgtgtgtcctcgggcaagtggctggccctctcagggggtctggtctttgaaatggaggcaaggataaacgagttggctgttgtacatgtgtttcgtcgtttgtgagtgagtggcctggaactttccaccccggttgtcctgaggggcacattcgaggctcccaaggatgaggattcagggctatgtcctgaatgttctggctatgctcactgacagacttgccatcagcagtgctgtctgatggttcacactgagaggcacctcatgcccgttctctgtggccccaggaagcttgtggcctctgtctgctttgtttggcatggtcactgtccacccaatatcttttggcttttaacccccctctatatagggtttctctgtgtagccctggctgtcccgaaactcactctgtagaccaggctggcctcaaactcgaagggatctgcctgcctctgcctcccaagtgctgggtttaaaggggtacgccatcacacctgcctccctcccaacatgttgaagccacagttggggatacttcgggaccagtggactcagggcgtgcttggtcagagtgctggccccaatctgtcctggggagagccagagaggagcttaagaaatgagggtggctcaagccactacctcccctattgccccccaccccaccccacccctggtcaggctgaattcctttcgtggcatctaagatatatctgggaccaggtcggagtgcctggggcgtggctgaccctgaatgcagcagtttctgagtgagctctccattggtggggagagcaagaattgcctagtgtgccaagcattgctgtccccgggacctggctcacacccttgtgacttctcacagggcccaagatagagcctttcagcattggcaaggatgaaccaaagcctcgttctatagcttctggccttggctctccatctcccaccactgtagtcctgggaaactgtcccagtggcttccgtgcttggaatgatggagaccaggccccaggctggtgctctcgatggcgtagctggagaatcggaaaagcaggttcttgcccacacacactcccttgtgccttctcccacagaacctgtcgacttccatgccagtcagaggaaggtgctgtggggtcctccactattcatgccacccgagccccaggggtggcccatgttattctgggatgggcccaagggtcttagatacgccatattacctacctctctccttcctcctttcctgtcccccacttcccacactgctcccagccctcctccctcacctcagcctgggcgccacggagtgacgcttggatctctctctttttggctttatttattaaaaacaaactagtccaagagccaagcactgggtgccagcagaaacggagcttagaaatcatattagacatggcagaaaaaaaaaaagttaggaatacatgagtctaggctgcatgggggctgccagataagtaagtctggcggctgtgactgggatcgtggggaaggccacctgtctcagctcaaggagggggacacctcactcaatggcagtcagggccaggactggatgcagccacaggagccacacgctgctgttgcaagcgcagggttggtgctgtttcacacacaggagctgcacccggcacagggaacagtgcaagattttcatcatcttgttgggtccaggtgagcgtgtatcggggttcaggtgaatgtaccttggggctgacggggctcccttcctgtgtagtttggacttggggctgggcgtttggtcaatcaactttagggagctgtgcagtggcttaagccgcagctgtggtgacctgtgtacttgacctttttatcagagcatggtcatgccaccacagagggcaggaagagctgggaggagctttgtccagggtcctgaacctggagactgagtgcacactggggagtgcactgctggagcctcagagagataacctctgacccccacttgtttccttctaggcctgtaggggtctgacctgttagcccttagcagagcaggtaaaagccaagatgctgtgtcacgttcctccctagaggaaggtctcaagggtcttgcatctgtattttctggttctctctggcatctgtgggagggtggccctaagctctaggctgtgggggcacaaatcattgatttatcaatccatcctctaactacctggtctagtggttcacttcaggctgctcagtaccctcagggcatcccaggatcagacagaccaaggactaggtaggtagagcaagctggcttaagctgggagcctggcggcggaggagctatgggtaagtgcctggcctgcctggaagccaaggccagctgtctgcgtggggacagcagcctgcgttatgcatcctagagcaggtgggagccagggtgcctgatggacacaagatcctgggtcccccacctggggcacaaagtaacacagaggctcagaggtcgccaagtttgtttcagtgggaagaggcagatgaagcaaatggcagagtcacagcccagaaggcctggggtcccccagacttggagctaagctagcattttgggatcttggccttgggtcccatccacataggctactctgctatctgtgtgatcttccttctcatccaagcctttacgaggtccagattaggccctctagggaggcgtgggataagatggtatgcaggcaaggggctgtgtggggtgggtgatggaaccccactttgtatcctgcccccactgtcaggagatgtagctacttgtgtgtgatgcttatttcaaaagcagagctggggtcaccgggatccacctcactgagatacgactttgaggagaagttggggtgtctttgtagatctgggactcctgatcacctcgaccaccttagtggggcctgcagggacagtgtagtttagactcaagtgaccagtaggtctcagggctggagcctgggacatagcacttcgtgccccttcagtgcctggccctgccggtggtcagctcagggggtgagatgacatctagctgtcttgagagtcggggaggtaatgccacacagcctttaaaattagaaggaagatgtttgttgcggagcagaacctgcgtcagcccgagtcctgtgggaagggccgctagcagcctttcgcgtttatttttgcacattctttgcatgtgccgaggctgctggcggccctcgctcagctcactctcgcaggggctcgcgctgcccacccctgctgtcactggacatagctgcactgtctgccctggagaagacagagctgcccagggtaagtgcaggaagatgtggggtggacaggattccagacagcgttctggagtctgcctgtgtcctgccgaccgtgtggtccgtgtgggggaatgtgtggctttaaagctttctccactcttgtcatgtctttaagaaccgccggcatatgagatcaggtgtgaaaatatctctctctctctctctctctctctctctctctctctctctctgtgtgtgtgtgtgtgtgtgtgtgtgtgtggtgtgtgtgtgttttctggggttgtggcttcctgggtctcttatctatcttcaggagatggccatgggtgtggctgattgcgggtctgcgctctgcaccccgtatgatcttggggagacaggagtccatggttgtggatccctgtggttgcgggtatgtgtggcagacagtggacatgtgtgagcctacaccgctctacatgtacaggggtgcgtataagtgcatttgaacatgggtgcacgcacagggtatgtggacagtgtgccgtgtgggtgcgcggtgtgtgagcgttctgcatgagtgatggtacgggcacacgtgagcgtatgtgacacatgcaagctgcatgtgtgtgtacatagggcactcctttggctcctgccagagcggggctgccacagacctgcctggccctggaaggctggggcaggctgagggaacaggcaggctgcaccccagctggccccagatcccgttccaaggctgtggctgggtctactctacccggccctgctgccaggggttagatatgcttgctgtctgtagtactgtaggctttgtggccccatggatgacaaatactgccctttcccccctggctcccctagctccttcaaggaaggtgtctccaccatcaggatggctctgtgttctttgggatacagcctgccccctttactcttcagggagcctagtggctagccagttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcctatccgtgcctcagtctccctacccgtcgggtgacgtgattaaccgtgcctgcctctcgctgatgctgtgagggtgtcttctcgtttttacataaaaggttacagagcatgcactattgttgttatttctggaacagcggaacgcagattaaaacagcccccagcctgcaagcttgcacgcttccattgttaaagcccgtgtgggggctgcttctctgaagctctgcccgtgttgggtaacatggcttggggttgcagggtggtgccccgtgggtgggccgctctgtcctcgtctcttcagtaaattggcacagtaggtcccaacttggctgaagccaccctgggcagaagcatctggcagggtgctggcagcactcactcagcgctggtccgcccggccagcatcgggcttgtggtggctgtggcagctcaaactggcacatgctctcgctagagccgactgacatgtgaatgttggtggcaggcctcggaagcaagggtgtgtggtggtgccccagagcctggcaccgtactgtgcccagagtcaacatgcccttcagccgctgtgaagagctcagggctgcagcaccgtgcatggcctgggtgggtgctcaaaggtattcagggatactccccaaagcacttaaccaaaccccgttttccaggttcctgtagaagtctggtttctctagtagccagctgcctaatctctctggccccctctagctacttatatttttttcctgtttaaaaattgggtgtataatctgtgtggggttgcctacacatttaatctcagcacttgggaggcagaggccagcggatctctgagttcgaggccagcctggtctacaaaaaccaaaataataataataataataataataataaatgtgtgtatgtacaggcatgtgcacatcacagcatgtgtgtggaagtcagaagacagcttgagggagtcggttctccccttttatcatgtgggtcccagggatcaaactcaggttaccagcctcagtggtaggcaccttagcccgctgagccgtcttactggctccaccttacccatttaaactggtggctggcataggaagtgaattctaaaatcacttcctgtatcgtttcctctttcttgaggaagttgtccttgctggtttaatgaagatattgagacaatatgaagactgaggcagagggttagagttttactcagtggctaccggtacctacctgagtcctgcagagtcctgcctccagggggcgctctctcatctaagaggtttgtgggcagagcctcttcccttcaccctataacagacccatgcatttccctaacagaaggccaggttaggtagctggccctaccatgctagggacattatgaaactccaggcccttccagggggatcccacggacacagataaaggttgtcactggctgaggtggcctgaaagttccaggcttggcttcagacatggctgaatgtacttagcttctgggaagcggttgtctcagcaggcaactcccacccccgctttcagcagcccctcactggcagctgcagtaaatgaacaacgtgggtgtcacactggagggtccctctgcccaggtggtaagtggctctcaccacctttgctcaccaccctgtccccgtcaagccccgccctggctctgtggctgctggtgccgtgcttgtggctgtatctttagccttttgggggcacatgaggtcctgttccatacctgacctggttggtaccctggcatcttgtgacctttctccccagccagcatctgtccttggctgatctgcccagtggctttgtgctgtccctaaatagcctcagggccacactgagggttcaggtgccaagattcatggcccaactttgccccctgctcccccccttctttctgtgcagcatgtctggaatattaggggcaatttagagggaatgttgtcttaactacactaaggtgggagtctggggccactgaaggaaggccatggccttgggggcccctcgccagatcatttgaattgataggtgacgggtattgatttctctctcccctgcaagggctgaggggtagtgactcagcaaaggaagatggtttgaaattcaggactggcctgggaggaggaccagggagctccccctgcccctgctggccagagctgtgcgggagggcagtgactttctcaatgcctcccctcacagggagggagggctctggaactaacagaagcctgcccttgtcttcctcctccacacacttgaggaatgacattcctggccttcccaagtatgtgggacttaaagacacatacatacatggtggggaggggacggggacagaaaggggaagtttgggggcagggaggaggggaaatagaatgacatcagaagcctcaagtttgtgaaacatgaataaataactgtgaagataaaccaccagagggggagagaacgcacattgactcatcaatgtaaaaaggatgttggagtcagaaaatgacccggggttgcaccccacggcagtcagcattcaagggaaggggcatcctggatgctaaaattagtggggccaaaagaacgagcagcagggcaactggccaaacgtttcccccactggaaacttattgnnnnnnnnnnnnnnnnnnnngctttctctccctgtgactcagtttcctagtagtagtggctggaagagtgagtactctcgcctcgccgggggactgtgctgtggacagagagtcccatctcctggtagatgacaggcattctgactgaagctgtgactcatcccaagagctttgactgtggcgctgggatggggtggaggcctctcgcaggttgggcaaaaggtctgccaccaagctgtaccccacaaccccagggaggaggtttagttgctagcagataggcaatacagtttatgagacaccaaaagagaggccgtgagccctggggaatcctagagggcttcctggaggagatctttgaatgacatcacctctgacaacgcgtgaccgaaaggggtggtacggaagacacagaattgtgttaggactttatggacagataggaatgcatacaagtctcaggagatacaggaggacaatggctgtccactggggacaggagagaggacagggatggggagaggtaaggacattatgcagctatgttgggtcagccacccatgtgagatggtcagtgagtggacaagctgtggtgacatcgggcagtagccacatgctccacacagtgctgagtgacagcctaccatgccgtggaaaccacaaccctgtccctgtttctcgaaccctctgaatctgcccagaccccagccatcccactgctctatcctggcttgcagacccctcctcgggcccaggctacagctttccagtctcttctgtgacactggggcacaccgatgctcaccagggttcccagctaatccatagggcacggttgtcattctgaagttacattttgttgtcccctgagctgggcctcaacctgggcaaaaccagaagtctccagggccgccacagctacccatttgtgtgtgggcccatgtacgcgaaggtcggggccccaaaactgggcattgctgacaagtccctagtccagagcctgtttctgctccatttagtcaccatcatgattttttttttaaagataggttctgatgtagcccaggctagtgctgagcttgctaggatggccttgggcttgtgctcttcctgcattcccccactccccgcagtgcatcaccatcgcacctgacttacatggtgctaggtgggtacctcctcaacagggccacctccagcagagccacctcccagcctcagtcccctttaaagcagcacaagttcttcagtcttggtccttccaaacccggcacttcggatgtggtctgacctttctgctctgcaggccgcctgtcctcttaacgcctgcctgcaggttgtgtggcttgagcagccgtgtcggaagagggagagcgtgtcctcgtcctcagggcaccccgtcaggaggtgccacagtggtccctgccgtggctgctactgacctgatgtcaactggcttctccccgaaagggttactcctcccctgtgagggatcaataagtttccagtgggggaaacgtttggccagttgccctgctgctcgttcttttggccccactaattttagcatccaggatgccccttcccttgaatgctgactgccgtggggtgcaaccccgggtcattttctgactccaacatcctttttacattgatgagtcaatgtgcgttctctccccctctggtggtttatcttcacagttatttattcatgtttcacaaacttgaggcttctgatgtcattctatttcccctcctccctgcccccaaacttcccctttctgtccccgtcccctccccaccatgtatgtatgtgtctttaagtcccacatacttgggaaggccaggaatgtcattcctcaagtggtgtccgccttggtttttagagacagggtctcttatcagcttggagtttgccaggtagccaaggctggcccataagactcagcgatctgcccacctctgcttcaccagtactggagctacaagtgtggcttttgatcatggatgctggagactagaaccagggtccccatgcttgtatggctaagccatcgcccccttttctgccctccactctctttgtctcctaccttctcctttaaaccttgagaccaggatctcatgtagccctggctagattcagactctctgcatcctaggtgactgagtccagaccctgagatgacacgtatgagattctatacccagctttctgtccccttttttttcccttgggatctcctgtaagcccttgtccagaggcctggccaggtgcctgtttgacttgatgcttctggcaagaaccctggatgtagctgtatggtgtggcaccaataggtgcaccagatctgggtgtccccctcctggcgctgagagtgcgatcagtggctttagctgtcaccttgagcttctcgttgttgaggtccctacaatggcttttgttcctggatcttgttcctgcgtgggacatttctctacggagaaagccgtcctccttgcccatcagtgccctcagaaacaagatggaagggacaggtgcgtctctcttccccttcacctgccagtcttccgcagagtgacatcctccaaagacttccaaagaaatgtttgaaaattaccataaactctcacatcagcgtgtgtgggagggggagttgggagggaggggcggggggggggcaannnnnnnnnnnnnnnnnnnntgcacccatattctggttgtcctgtctctggtatcttggcttgggatctttgtttcttggctcctggagcctctgggctcgcaggtagctgtgggaccttccctcactttctggaaggtcacactgcccccaggctccgtgggttcaaatcttcatcaggtctacaatcagagtggaccttgggacagggctggggtggggcagacggagggagctcagcccttgggtcttgtctttcttccccctggtccaggttggtgttccagcaggtccagctgtgccccctcctcccctcctctgtcacctcccctcaggacatgctgggacatctcccccacctcctgcttctgacctgggtctggtcttttccccaagggaagatgggaactccaggtgccctgagagccaggcccttacctgtggtcccttagtcatgtgggactctgactacggatccctttctgatacaattcagcccaaggggctgctcaccatttctgcctttccacatccaaggggcctcttctcccctggccaaacccagaccagaaaaaaatgacatgtaatatcccttcaccggagtgacttaaaaattaatacgggcctccccgtgctaccccacctccacgcgagccgcctgtgctccctgtgtgagattaaaactcacatttcatttttatatgctgtgcttaatccaataatgattttgcgttgcaaacggcaataatatctctcagcatagttaatcagactagacttaatgctgtcactatttattaacctttgttgaaaagcaagaagtttctctctaatctgcgattgttggtcctgtcagagtctatcaactgagaaaacagttttggcattcattaaaacggtgcaaagcccgaaatgacaatcggggctgggtgggatctagtgtgtgaaatcctcgccctgtttctcgggatggcggaggagcttggcagggggaggcctgcggcttggcggggacccacgtggtcagagaccccagattcctcttgactgaaaatcccttttccagggtttggggggacgaggagggagtatggaaactgacttgaccaatgccatgtctttgagctcccctggacctggaccaggttcctgagctttgtcctgacgttcattaggatgctgagctgggcacctcttctctccaaagcctggtcgagctggagtccatcaaacatgactgcggagatggctcagtggataaagcagctgccttcaaggcatggagaccagagcgtgaatcctcgaacctctgtaaaaggcaggggaggtagagacaatagatagacctctggggactcctggccatcccatcccacttggtgagttccaggtgagtgagaggctatctctcaaaagccaaggttgatggcactggaggcttcgatgcaggggcatcccagtgtgctcatctggaacgttgtgggaactccacagcacccgggagtcaggtggcccgaatgtcttaagaatgcctctctagaaagttcccaggtaatgcaggtgctggggtctggaagcccccaggacctggtggtttgagattttatgaaccttgctggtatatcattgctgggccatccgctgacctcggttgacggctggattagaatgcattgtccgggtttcctgctggctctgtgctagagccgccccgcccactgcacatcttggctttacgtcactcccctgctgcccagccctgggatagctttagaacaccggttctgatcagctgggcacagtgaggtggagaggtgtgccctcacaggttcccaggccgtgcagaagctaacggatgccacgtcaggcaggatacattttgtgtcctaagactctgccgggtcacaaaggacctcagccggatcacctggctggggcttgcagaggcaaccctgagctatacccatttccccgaagggaaaccagctttgaggaaaagggaaccttccacctgctaaagcctctgacacaaggcaggctccagggttcccctttctccttttctgagagttccagccatgcctcactgtcaagtcttcactttccaaagatggcttaagaagaaccagatacggggggccggagatacggctcgcttggtggagggcttgtctagcaagtgtaagatcgtgggttcgagcctctgcttcccacacaaccagtcatggtagtagtacacgcctaaaatctcagccctctgccacttaactacatagagcatttgaggccagcctgggctacataagaccatgtatcaaaacaaaccaaaaagcccaggatagaccatccatccacaaggtagttgctatggacttggttggagtgactgatgtgaggttctcccccccacccccacccccacccccgtgatgaagccgcagccctttcaggagcagtcagtgagcaggtgtggtcaattactcaggaaggctgagggtgcctgggacagtgctgtctctgctctgttctgctctggtgataaaggcggaagagaatgtgacaatccagatctctcccttgcctcggattgcaaaggagctcaggctggcacggacgatgggaagctcttactgtgcagagatcaatgctggctgcagcagccagagcccagaacccactttttatttctgcctttgataaccagagcctgagagagcttcggaaggcggcatgcccagatgcctctggagtctgtctatgtgccgggagaggaacgaatagattcttgcacatgggggtgggatctaaggccccccagtatggtcaggagcatatgtggtctgtcccttctcttctgggtccccaagaagcatcttaccaccttcgtaggttaaaagaaaccatgtgagggaagtgtgtggatttcggctgcgcaatatccctctgcctctctgttccatgcagtgatctttgtgggttgaggacacccagttcccttcaataggtactttcaggactttttttattttttaaatttagatgtgtttgcacaaatgcaagttccagtgggacccagaagagtgtcaggtcgcctgggtttagagtcccaagtggttgtgagctccccagtagggatgctagaaaccaaactcaggaactctacaagagcagtaggtgtctgaaccactgagctgaccctcctggccctactttaatttttattatattttattttgtgtgtatgcatgtatatgtgtgagcatgtgtgtgtgtgtgcgcgcgcgcgcactcatgtgtgcatgcacacatgcacgcatgcacacacaacatatagaggggcagttctctgtctccgtcaagtgggacttgggaatcagcctgaggtcagcgtgcttggctgtccagtgtctttactccatctgtctggccagccctaaagccacttggttctaagatatagcttggcgctgtgcttttaggccctgaggcacggggccgcatcagttgctcacccagctgggctcagcaaatctgtgctcctggccgcagtgcttggtcacctctcaaggaagtgatgtgtgaggcatcgttagagggatggagtttgccaggggtggaggggaatagaaacccttgtggtgtaaaggagctggattagaacttggtgaccatggtgggtgggctggcagaggggactgtcagcgaagcagtgtggagagctctagctggggatggctggggagaagcttcgagttctggacgtctgactaaggctttggctctccctagcacactgtgggaatgcctgatcaggactcagacctgggggccggctggaccttcacacactgtaacctactggtttgttttcataaactgtgaccttcgacactccccccagttctattatgttaaccctttgtattcaaacccttctcctcttttctgtctaagcctatggtacacctcgagttagtagagtctatggtgtggggactcttgtcatttcttaggtagacttccaacttaaggatctttttagattttaaaaatgtgttttgccttgcatgtatgtctgtgcctggagcctgcagaggctggaaagggtgttggatcccctggaagcagagttacacatggttgtgaactgccctgtgggtgctggggattgagtccgaatcctctgcaggagcagccagtgctcttagccacggaaccagcccctggacacccagcttcaaccccgtgtgcctccctctgtttctccattccaagcaaaagtgagtgtccatgtgtggtttgttgcttccgacagagcagcctgtccacctttctgggagtgccctttagcgtcacagaggatagcgcgtgactttctatcctccagttctgctcttgtggttcaagacttctccccgtagttcatgtcctctgtgttttcatgtgaattcagaaattgacttttccgcttctcctactgaacaaccaaagcgggcccttgggggttgatcatgatctcatggatgtagatgacttaggagaaagctgaagttgtgaaggagatgcacgcagtcttccatccatggacagcactgctccacaccccgcccccaccacccctgcccctgccccctgccccctacccagctcttctcttattctgtctgtgccagcatagaggcctcctctgccccacgactgcacatggtgtctcctgctctgtcccctgagccttctgtccctggtactaatcaccatgacagaagttctttgtgctttgatgcttctcagttgccatttcctgtgaaccgtgagctcttgaagggtggagagactggctctgtctggttcatgtactggaacccagggagttccccatgaagattgatgaatgaatgaatgagtgaaggaaggaaggaaggacggaaggacggacggacgacggacggacaagtccatcctttcacacacacctgcagcttgctggctgctctcattcccagctccgttgtgtctgtctgtgaatggggaaactgagtcctccttcaggcctctgcttggccttgtgcttcagactccgctctggccgtcaggagttgcactttgagaaaccctgttcatacgacaggcagatgcgtgtgatcgtagtttttacactcttggctgtattgtgtgcctgtgcatatttgtacatgtgtgcacataatccgtgtgtacatgagttcacgcacgtgtgtgtgtgtgtgtgtgtgtgtgtgtgtgtgtgtgtgtgtgtgttgcacgcacacacgctcgtgcgagattcagggtaggcgtggaagtcagataccagctgcaggagtggcttctcttcttccaccaatgggagtcttgggtttgaacttgggctgtgaggtttggcagtgggcacctttatccatggatccatctctcaggcctgattgcaggcagtgatgataatggagttttaatttctttgatgaggtgcagagataccaccttccagcattgctcagagccttaggaaaaccagcagtggggttttgatcaaagcaggttctacttatgagtaggaaaatctgagtctgtaagatgctgccaacaggtagtgaaggccagtgacagcaaggcgagtctcggccccgcccctgcccctactccaatgcccctccccccttctccccaggaaccacggcatagggcatctgactaattggtttgcggacatgactgggctagatagatttcattgtgcttttgatctcaagtcgatacagaggccgagtgttaatggagtcccctgggtgagggctgtaaggaagacttaaggaagaacttcctgaggagacctcaggtggccaggtggcctgactgccagcattggaatatgggaattcagagagacaaggagattgagaagctggctgctgtgcaggagtgcagagggaaatgaaggagggggtggccctctgagctgattctctaagttaacctagactaagcagaaacttgagagcggggctccctggggagccatgggaagaagacctcaccagtctcttcccattacagttggtgtttcctactcctctcagtcccattttagttacagaatagcctggaaaagcagaggcaacaataactattgttctccccaaatcacagatcagcaaactgaggctggtggccttggcctggagcttcgggactagccagaaggattccatggtgcaagccccacttctctgccttgcccagtatgtcattgtccttggtgatggagcttgattggcttttgtttgtgactctagaatcaaatgacaccttacaccatagggactggagaggtgactcggaggggacagttccgttcctggcacccacacagcagctcccaactgtccgtagttccagcttcagggcatctgacaccctcagacagataatacacgcaggccaaacacaccagtacacgtaaataaaaataaatacatcacattaaaacatttcttaacagaagaaaaaaatgacacgttagttcacaaaacagagcagtgtcgtcttggggtgcaggccacagggcatgagagcatagctggttattctgctgatagctggttgtcatcgtgaggcagtgacagggaacagagagatgggaacgcagtgggttggcccatgtcaggtcacaccgactgactcttcacaccgactgactcttctgtgagagtcacagcagacaagctttcctctcaagcctgactggactcgttcactgtggttacaggaagctcctgttgtgggggtggtcagtggtccaggtgggatgtgacagtgtgtctgcttgattctgtggcacctggcacaagggactgcatctctctgtggtccagcctgcttcgtcctagaaagctagtcccaattcatgctctcccaaccattttgtttgagagagcagaaatatctctattgtgtttgttacttagcccccgggactctgcaaagtgcctgataaatatgtattcagatatttgcagaggagctgaggtcaaaggttaaagatgacttcagctggctacccacgagggagagggccagattagaaggcacactcatgtgaccttgacactgtgtaggcagaggcaggggcatcgcagattccaggctagcctgggattaggacggctgaaacatgcttgtgtgattttggtgtgatttaatgcttgactggttttttatgacccttccagaagccctcatttcctggtgctctcagatggctctcaggagagaaggaggacatagctgtaagggctgtgagtcaagccatctgtccgtccatacagactgtatcatgccatggagagggtagggcctgtatgtgctttggtggtctcatgtcatctccctcatgtatggaagcaatcatcatagtcacgtagggacacacagtgatggagcagctgctgctagctctgtcacagcagtcaccacaccaggagtctggaaactcctacagagtctcatgctaagcataaaactcttcatcctagaagggacacgccacttctgtgttcagcgtgtagttcagacttagtcgtgtggcctctctcaaccctaaggagacaggggagcagagataggaagcttcggtagaaataaccatgcctgccgcatgcgctggtaaaagtcacttcgtttgactccacggcaaacccggtaagaagaccaggaaatgtaactgacagtgtgtcgtgggctctgtgttgtttgcccagaacagctcgtttaatcacagagtcaccccatcatccagtaggcactggaataattcccattttacagatcagaaaatggaggctcagagaggtaaggctacttacccaaagtcacacagctaggaagtggtaaacacagtatttgaacctaagctactttggctacaggacccgtattatattaacccagtcaccaatggaaaaaattgaggctcagccccatctaacgcctgtcctcctgcccacagatctccaataggagacctccctattcagtttggccattgggattatcaggttatcacccttcctgggtctctcttgggtgggcaccttgcagtccttaacctcttgagtcctgaagcgagcctatgctgtgctggtctggacgactcagctccgcaggagccaagactcctcaagacccgtcacaaaacccagacattattaagcattaaatgccagggctggagacgtggctcagcagtcaagagcctgtgttatcattgcagagtgtgggagttcagttcccagcacctacatcgggcagctcacatccgcccggaagtccagctccaaggaatcgatcccctggcttctgcaggtacctgcactcatatacacaaaacctcacacataggagtgcacttatgcacttatgcacacaggtagaatcttaaagattacaggattaaaacatgcaatcagcgattttagtaacttatcttccagagggacacagttcaagacacaagcagaattctgaaaccccaggtagtagttattaaccctgtatgagctgtgcttttccctaggtatataaaccagggatgaagtttaatttttataattcaggcatgacaagagatgagccaacaataaagccaggtgactgtaacaacgtaccataaagccgcaacagcaggctgcggagatggcccagtcagtaaaccagttgcaagcatgagggaccggtgagagcccagtgcattaaaagccaggtgcagggttgagggcctgtgcccccagtgctgaggggcggacagaggcagaagggtctgtggggcttgctggccaggaggtctagccgagttggcaagctacaggttctatgagagactctgtctcaaaagtaatgtggacagcagtgtcacttttgatgatgctgtattctgaagtcagtgcgcatgtatacacacacacacacgcacacgcacacatgcacatgcgcacagtcagagttttctgactgtgctcccagtctctcaggaatacctcattgctgtcttctcgctcattgctgtcttctcgctccaacttggatactggtgagacggtgtactggctagttttgtgtcaacttgacacaagctggagttatcacagagaaaggagcttcagttgaggaaatgcctccatgagatccagctggaaggcattttctcaattagtgatcaagggggaaaggccccttgtggttgggaccatctctgggctggttgtcttgggttctataagagagcaagctgagcaagccaggggaagcaagcctgtaagtaacatccctccatggcctctgtatcagctcctgcttcctgacctgcttgagttccagtcctgacttcctttggtgatgaacagcagtatggaagtgtaagctgaataaactctttcctccccaacttgcttcttggtggagatgtttttgaccaggaatagaaaccgtgactaagacagacagctaggtgtcagcgcaccatgggtagtaaataggagtggttcatggctgggttagggtttaaggcacagttctgccattctgtggcagtcagtttgaaaaccaagatggctaccaggcagatagcagggtgggtaacacatagtgtagatacgccaaaagacattccgagtccacttcatggcggagacagagtctgagcgtggtgacatttcatgcaatactagaataataaatacatcacttcagactcatgaattgtttatttctggaattttcgctgtatgtttggacagcagttggtcgcagtcagatgagaccagaggaagctaaatcgcagataccgtagtattattttttccacagagggccatatggtctctgtcacggctactcaactctgtcacagcagaggcagtgtgcgcactaaaaggtgtggctgattgccagtaaaactttatttacaataccggaggatggtgtgggcttggctcacaagccacagattcccaacttttgtctagagtgtgtgtccctcacctgcccagagattattcttcaaatctgttcatgcagcgggctaggaggtacgcaagtaggcaaagtgcaccacacaagtgcctgggcctaagttctggcacattcctgagctgcggagctgaggcagggggattcctggagccctctggctagccagcctcactgaagtggccaacaccatcagtgagaaactcagccttaaaaagagacggagagcaactgaggacgcctgatgtcaaccttgggcattctgcacatgccacatagacatggaaaacccatgtacacgtgatcaccttaagtgtccctccatggctgacagacatgggggcccccttcacccctgaggttctgtgagtggttttagccattcccactgactgaaagacagactggcagacctgaatcttgttcatctggttgttatttaagtggggtgtcaccccactgtgttcttgcctcccagtacctgacctagggcctcatcatagagattaaggaggtaaacagcctctttgtggggtattgggaaggtgtataaaggagaggtgtgtacactccatcatccccagccccaggcagtggtgctccgtgagacttgctcaacaatctaaggacagtgactcctaaggacaccctctgtgtccctgtatgctctggtggtccaggcccgaagcaggacaggtacccagttgtcggatacaagaagggtaaatgacccacccgtgtgtttggttagcactacccttagcaggctcatcagctactacacggatttggaagtgagggtaaaatgaggtcttcccctgcactcaaacaccccaaagagccgagaactaaggggtctgagtcagcagacgtcgggatcccgagatcgagaccagctcttatgcaacgcaggttggtcttgagctcatgtgtgttcaaggatgactctgaactcctaatcctcctgcctcaacctcccaagaattagcactactgggcactccccactgtggattatgtggtgttggggatggaacccagggatgtgtgtactgctggcaagggctcctcaggctgagctacacccccagctcccaggaaccttttgaaccatggtggtccccagcttctacttccggagttgggccactgaaaccacggagtaggtgagctttctctccagagtcctgaataccgaggaagtgacagcactctctggggcctgatttaaaccctttaaagccttctggctgctggcgatgagctcagaagaggcctgccctacccggctgccgtggtgagatggccgaggtgtatgctcttgctgccgggagaggattgagtctgcctttgttatttttgatcatagaactctagtgacggacagaacccagaacacccacagaatggcccgagaggctctgcctctcagtgctcccagggcttttgcttccatcaagttccaaaatctacattttcatcgagtgccagccaggccaaggtccccctgtcacgtgcccgccaggccagggcccccttctggcctcacacgctcaggtgattgactttaggcaccctgttaaaaatcaccaccctagacaacctaaatgctgcatcttgtattttagaatgaatgggggttttccctcaagttgacccaacgtgcgatgttagatcttatcaataataaatcctcccatccatccccaggcagagtggggtgacgggggtggcagatggggaggggaaggagatccttggacaggatcacagagtttgaccagaaggaatgcagaagctgcgccctgagagagcttcctagagcattccccaacttggcttgttggctgatcgggtgggagatgggactgaggatatttttcactgagctggctcagcgagcaaaggtgtttgccgccaagcccgtcagacctgagttcaatccccagggctcatgtgatggcaggagggatctgatgcctacaagctgttttctgtcctccacatgtgaactgggacatacgtgtacccctccatggattaacggaataacatttaaattaaaaaaaaattattaaaatgactgttcaagggtctggggaagtggctcagttaccgcttgctctacatgcatgaggttgtgagtttgagtccccaggacccgaataaaagccaggtatggtagtgcatgcatgcagccctagtgcgggggggggggggaggggggttggggagaatggaggcaggtggagcccgtgagcttaggatcagtgagggactggatcaaaaaaagtaaggcagacaggggcctggaagatggcacagtggataaggtccttaccgtgcaacctggcaacctgcatttgatccccaaagcccacacggggatggaaggagaaagctgtcccctggcctccacacatgcactgtggcgtgtgctctcccctccccttcatgtgcacaatactaaaaatcaggtgagactgatagaaaacatgggactggcatgaatctctggcctccacacacatgtgcacatatgttcacataagaacatgcacacacacatatacatctgtattgtgaaggtacacgcctgcagtcccagcactcaggaggctagcctgggctaatatctaaacaataaactgagcaatactgaaatgaaaagactatatagtagtataaggtacaagccacaacaaagaaggggtcgaggacagaggtgttccctgcagggtggactctgacacttagggattgtcctgctattggggtaaggtctggcctttgtttttcgagacagggtttctctgtatagccctggctgtcctggaactcactctgtagagcaggctggcctcgaactcagagatccgcctgcctctgcctcccaagtgctgaggttaaaggtgtgcgccatgcctgattgggcactgccctttgaaatgcttgatttctccaggttccaacactggtcagatcctggtccacagatccactggaccgacttctctgtctgttctctcttaggagtccatccagtcccgcacgcactaacagcccatagcaacatgggcccgtgtcacctctgccatctgaatataactgtaggaaaagaagatttcaggcctgtttgcttggggttgccgagaagtctttgcaaggaacccagaagcctggcgcttctcacccttatcgttaatttaaaattggaggccgggggagagggctcagttggcgaagagctcaccatgcaagcctgaggacctgagttcgaatccttagggcccatataaaagtctgtgcatagtggtgcattggtcccggcactggaggattgtggggacagagatgggaagatccctgcgggtgttgctagactgttcaggggtaacctgcggctttcatgagataatctgactcagaaataaaatagcaattgagaaagacacctggtgtctgtcaacttctggcttacacacacatgcgtgcgcgcatgcacgcacatacacacagcaggcttatacatacacctgtacacatatacacctcacaaagcaacgatcggaggtcagctaccactctccacttctcttccctcttccccttccaggtccagcagggcacaaggcccttcacagaggaggaatagtttttacaagtagcttctggagcagggatgggctaagcggttgtaatttctcacaaggctgttttttatagaagaaaatcgagtcaacactccggagtatactcggctctttccagagatgggagaattaatcaagctgccgacttcgctgtctaaggcgcgcagggcgggagggccgagtttcatcagcagattggctcggggaggcgcagatgaaaggaaggccggccctctcctggtgccttaaatattggcaggcggtggggtcgagatgtttccttttcttttgttgttaaggaaagccatacagataattaatgccgctggaaggagcccgctcctctggcgtctgccaggctgggctccccccaccccgcagtctgggatcttctagggagagagaaaaaaaagtgaagcccccagggggactctggcaatttacacaagcaataaatatcatccagagagcagacaggaccagccagggcctcatagctacagacatctgagagggggactcaagtcccagtgaacgccaatgaacttgacacagggaatgcttcacaccatccagtcccgcagtgtcttgcagccctggggtgcagctgtcacacggtgattgtttgaaaaggtaggtggtcaccaaagcccagggagcgcacacaatgggtttgatgcttgaaggtttttatcacgctgtatgtctgggtaccagggaaatctgttaccatccctagatgccagaggcagccatggggtcgtgcagttctggacaggtctactgtccctggaagtcctgtatgtgcctcagtgtgcccagaccccccatgcagtactttgtgagccctggtctgtacatgcatgttagcacgtgctcacgtgatataaaatgaaccattctcagggcaatggtggcgcacaactttaatcccagcacttaggaggcagaggcaggcagatttctaagttcgaggccagcctggtctacagagtgagttccaggatagccagggctacacagagaaaccctgccctcaaaaaataaaacaaaacaaacaaacagcaaaataataataataataataataataataaataaagataaaataaaatgaaccatttaaagcaagcacccgaggctgttagtacactcatagtgtcacgtggcggtcacttctggctcattctaaagcacgctcctcccctgactgttgaccgtccccacggggaggctcacatccacacccagcagcttgttctgttgtcgtggaggtttgcctcctacagacatctggcagtggagcttggtggtggctgacctctctgcgccagcctctctctccttcagggttgtgcatttgttcagggttcccaggtgctgtaacatgcatcggtacctcgtgccttttcatttttcttggctagttaatattccaccactcgatcgcctttactctctgggccgtggctggcatttggaccatttccttttgaatcgctgttgtggctagttgatgccagggattcgtagagacaggcattcgcttgatcaacaagagatcgattctgtgggatgtggggttgtcaactggtctggccacatggcacttcccttctgtggggggaagccctccagactgttggggcgataatcttttcctatggctagacctgccggccccccatggtgagctggtttatcttgcaatgcaactgtttagctgtgtcttgggggcacagccggctttttaattgagtaccagaaaaatccacttttttggcagatttggggtgttaccatccagggtgatgttgtaccaggtacatggggagggggaccaccttggtggtccatgcatctcctcactgcaactcctaaagcaggaagtgcaagagacaggagtgtaaatgagggagggtgagctgccgtgggactatagagagtggtggagactgtagcagtgtccaggaggaggccaggctagtgactgacagttgccaaactagtgtggccagacttgcctggtttgtagaagaaactagaaatcccaaattttgtgtgtctctagccagatgttttagcgcacacctgctctcgggagacaggggaatcaatttagagtcatctccagttacatagtttaaggagtttaaggccagcctggactacatgggcgattcccaaccccacttccacttctgcctacaagaccagggacttctcgccctctgcccgctgaccataaggacctcgacaggaagcctaggagtcagagaggggggcctcagacatctaagccatgtcttcatggaattggtctgtgatctcaaggtctactctgtcccaatccctttaggccagtcccttccagtctccacacccagctcacaatggcaaagatcgcgaggtgtgggcagactccggtgaggctccgcactgggccatgtgctgtcctcagcggacaccagacatcagcccagtgtctgaaggggtgcctcctgcaccactgtcctgcgggatgtgtggcctaggggttaggcagctgaacctgtgtagctgctccttgggacactctgccagttgtagggagcattacctgaatgggtgacatcagagagggacatcacggcaccccactcgcacactgtgaacccttagacatttcaccaaggtagaagggccctgaatggtggtcctcaagtgcccacagccggcccctgtacccagttttggagtaccccctctaattagacctccccagctgagcactgtggttcactgtagagccagcccatagggaaaagcagccccaccctcctggaagcctgactcccctcacaagcgcgttcccacagacacagggtcagtgtctgctagatcctcccacagtggggctgtcagaacttgcttgctgctggacgagcctccctgccccttccttggatgagcccaagggagcttcagggtttctggctcactcacaggggtcaccttctatccaagaaaccagccaactctggagagtcctttcacaaccctgagtggcagcagtgagttcgaaactctccctaggagaacctgggtcagtacatccagccccacccagccatggctgtcctggaactcactctgtagatcaggctggcctcgaactcatggagatccgcctgccttccaggtgctgggattaaaggcgtgcacccccaccgcctatactttaatttctgatctctcacactggctctggatcacccaggcagctgctgtgggaaccaggctgatcccaattacaggagcctcaccggttctgccccccaccccaggaatgcacccaaaagagcgcatggacccaagaggtcctggaaacaatgatcacacagtcagaaagtagaagtgaccagattctgtgtcaccccctgaacagataagcagaaggaaatgtattcaaacagtggaatagtattcagccataaaaaagtatacagtaatgctttgttctgccatacgaacacacacacactcagtgctattgacagaaggtgggccagttgtcacgtgactgcttacatcacatattcaggaagggggaatccaggaaacggacacagcttagagtctgcagggctgaagagagggtgatgggaaatgaatacttgctggattggggttttccttttaattctatcattatagtataacatttgtttcaccatgacatgttaaatctgccttctgcctgtgacagaagccatgagctatctgttctatccccgtctgtctttctgatgccctggattgtgggggggttccttttggggtgtgatgagaatgttctggaactccaggggggtagctgtcctgttgtgtttattgtctccagttggactctgaagctttagtgttggtgagtgtgtgtcccccattggccaggctagtggagcctggcgctttatacgtccctggtggggacttgcccatccttaagcagaaggttgagggtaaaggatggagataaccagcccttggctttggtacaaatccatcttcatagggagaggagaccctgaggatgaaggtgaagaacatggagggatgagaagggtggggtccgagccatgggttcaaggccaagctccgctgagacagcatccacaagaagagtgtagcagagccacagagttgccacgtcggcctcaagtgaggttgctgatgatgggcacagcctcctgggggtgggggatggggtggctggaggtcaaggctggggactctgaatgtgcccaggttatcaagcctggcctcttcctgtgtccgcttagtgattctgaataatagctcatccattttgctaataggtgtgtgcaaggctcagagaggctgggagactcacccaagatccctcagcaagagcagccagcttcagtctgtcaggagtctcttcttgggactaaaaaggtgaatgctgagccaggcgtgaccatatacagctgtcatgccagcacttcggaggttgaggcaggaggatcaggagttcaaggccagcctggactacacagtaaaactctatctcaaacaacaaacaaacaaaaactctatagcttttttttttttaatggaaaaagccatctacaaagaataataaaatagtccttattgtccccatcatgcaggtggagcctagccactgccagcttctgttgtccctgtgcctttaaacaagcctgaaacgttagagacagagcttacgggtgtctgtaggctgtggtggggtcctacctgacaattatctttatttcctaccttgctcattgatttttctttctttttcctgtactgtcatggctcccacgctcggagggtctgcatttcctcatctgtgaaatgggcctcctgcctctctctcccctgctggagctcagtcctgtaaaccagtggggaagggacctgctccaatggtttttattggtttcagtgtgtgtggcaggggtggggtggtgatgcacgtgtgtgcacatgtgtgtggaggctggaggttgatcttgggtatcacccccaggagaacccccccctttttaaatttggagacaggatctctcactgggctgtagctccttggcaccagtctggctggccagcaagcccccggggtcagcctgtctctgcctgccctaggcctgcagacccacattgaggcgcttggatttttacatggggtccttgaggattgcaaggaggcgcttctcccagatgtggccttctagagatgtccctggtttggggctccagttggcgccgggctgcgctggcagctccaactccagtatctgcccagatgtgggcagatgccagcctccgagcctcagtttacccttttatgagtcagatttggagttggtttgcatggatgtaggtaaagatgcatagtgttaaatgttgagttaagcacacaatgccgttcgtctctctgtgcctacctggcgattgctgctgtgggacttcccgaacaggaccgtatgagcgagctgtctaaaaggataaatagcctggacctctgtggtggtgggggctccagctgccaagacccctgcttcactagttccctcccctctccccccatgtgtggccactctgggggctgccactaccaggaggggcttggcatgagaaccagcagatgccagcctcggcccgcgcgcagatgtatctgccagtttctgacgggaagacgtgatctgggaatcgctcacttcattgataattaaattcaaattaagagagatttgcatttatgaaatgcctgtttgacaaggtgtcactgtaccatccaccaccagggtgcttgggagctgacgggggggtgggggggaacagccacgggaggggcagggcggcagagagtcacagctccatagggaacacaccactgggtctctgccaggccacgtaatgtcacccagtcccacaccccacccctttggctgccccctgggtccccctcagggtttcacaggtgtaaggagaccatgaatcctgggaggaatcccccatcccccattcctgtcacccttcccactgaacattagcagggagacccagcttctcttctggggactttggtggtgaccctgatttgccatgcaggcagagttgcaaatccccgtcttcaccttgcttattaaaatgctgggtctctgtatcccaggtgtagctcacggccctacaggggaccccagttggaccacatgccttcaacaggtctctttgtccttcctcccttcccaccttctccagaggtgtagctgtctcctcaaaagaccaccggcacaaaactcaaaaacaacaaaatcccctaccccatcccacccaggttccccccaacagacctcaaactcccaagatggctgcttgtgctccgccatcctccgcgtccctgagcccatcctcttctagagctggctacatcatctttcctttgaagatgttcttcctcacctggtagtgctgagggttgaaccagggccacatgtgtggaagagttctttttggcttagaaagagactcaggtggctttatttcccggcccgctaaggcgagaagtgctcggctctcagcctcacggccagctttcttcctcttgccatttcttccagcccattgtggttggtacccaagcaggtcaaggcagcctgtgcctgcaggctaggatgtccgaagaagcttggtgagctggggctctcctttgtgatcagaataaggggactcctggagcctgtgttataccctgagccccatcagagtccttgcgtgacctccaaggctgtgtggcctttggcaggctctgccacctggaggatccccctgcgaagagccagcatcacatctcgttatgatgtgtctgatgtgacatttctgtggctttgtttttctccatgggagcggtaagtgggggattggtggaacccccacatggctcagaactcaactcttatttttcagtatccccttaaaagtttaggtgatgccccaaaccttttttttttttaagatttacttatttattatatgtaagtacannnnnnnnnnnnnnnnnnnnacacaccagaagagggcatcagatctcattacagatggttgtgaaacaccatgtggttgctgggatttgaactcaggacctccggaagagcagtcagtgctcttaactgctgagccatctcttcagccctgatcccccccaaaccttagagttaacattatttattcaattgtatcccgtatgtgtggggttgtgtgtgcagatgcatgtgcacatatgtgggggggggagggtgcgtgcatacatacatgtggacccacgcctgcctcacacggctttttgattactctccaccttacacacagaggtaggatctcacacatggacccagagctcatttgtctaggcaaccagctttctctgagggttctctacctcctgtgctgagactgcacgctggctgccacgctcacccagcgttctcgcgggtgctgggaatctgaactctggtcctcttgcttgcttggtgctttcatcctctcagttgcttgcccagcctcgagagattatacgtaaatcctatttctctttacgttgattaggaacttaggttttggctccaccacttcacacacacacacggacattcacatacatgcactcacggacacacatacttcagcgcttgacaggacaccatggtgtctgcgggacagaacactcctcctgacctcagtttccccatctgtgaggtgtgtgcagtgtctccttgggcagactggaatgatagcaaggactggcctttcctaactgtccccgtgctaccctgggtcatcttaacctttaagaagccagtgtcaatcccatattagaggtggggaaactgaggcccagaaaggagacatgaagatcttgtagccacacattcggtaagtaacagatctgggctacctcaaagcctggagcccccaagtcctgacaccccaagaaaatgtcaaggtcttgcctcacacagtgttcccagtagatgctgacagtaaagaccacagcagtgatggcaggaggcatttggggaggaagggagacttccagatgagaaggctcacaccaggccaagccccagaccaagtccagccaggcttccagtacagcgcctttaccagcaccccccaacctgctatctctgaagccaggtggaatattctagcgcaaggtgcggtagtagcatgaagtatcacccgcctgaaaatccccctgtatctgctgtgctatctaattactgcattagagaagtcttcagaccatgtattgaacattataaatgggaataagatggttctggtaatggcttaataaagcaggtaaggcagccccgaccgtctgccgggtccttggatggcagccagattgatctgtcagggaggcagaaagcagggccagcgtgggcccctggagcactgtctccatgaggggtcttggactccattcttccttttcctttgaagtaccgctcaggatttctggctaatagcagccagaggatggatggagaatggccagtagccagtcctgccttctgcagccgtaggcttcagactggccggctgggagctgaaagtccccgtggctgaggatgcgtggacccaccgtggcggcagtggtcaggggggatgatgggctgtgcatggagtgaccacactaaaagtaatgtagtgggaccagagacaggctctgtgccactggtctgttgtgtgcccaggaagagaaatgtaacctcgcatctcccgggctttctgtgtatgtggcgacttgagctgtggactgtctgcctctactccccctccaggaatactgagtgtccttgtcctttctcacctctgtgcctggttccttcacacccatcattgctattgcctgtggacatcttcccacagcttggaactggtattccccagagaggccgtgaggcacagtgagcccatgaggagccacaactcaagggaggaggaaggaagtccctaggtgctctgcatagtcccaacccgactctaacttcttgacctacccagactcctgtgcgggtgttggaggtcacgttccagcacagccagagccctccccaggcctggcattctcatcaggcgtcatcgtagtcgtcatggcgacggggcccaggaccccagagacgggacgcagaattaatggcagcgccgggtaaaggattcctgtctgggcgaacttgatggattacgttgacgaaccatttgtcatactgtaattgttctggcaaatgtaatacccactagtataaacatcgcagtgctttgctaataaaacccaaaataggaagagaaaggatgatacagtgccgtgctcacttaaagagacagcgcctccactccgagtggggccactgttcttccccgaggcctgaacgccaaacagcggcctgccctctgggcatgcgcagtgtggttactgggttggccttttctcacatctgttatcattcttggtggccatgtggtgtccccagtagagtcttaatttgtgcaaggcataaggccgctgcctctgaggagccctcctggaccagccttctctgaccagccagccagcccctctctgagcttttttgccttaggctccccattactagatgggaggtttccggggctagaacgaagttctgaagtgccgagtgtctccgtttctctacctgcccagcgaccacacaatagtgtctgggacttaatagatgctcagtaagaggtcagttgagcatactcatgagcccatgccaacatttcaggaccccatacatcgtcaggacccatctgtagctctgtttgagccccagccaccctgggcccacactcagccattgttgctgccctttcccaaatctctggctgcttaactcccagatgccacctgtctcaggtagctgcactatgaaggggcctccatcagccccgagagacttggtgcttatatatgattctttcccaagagcagctgaggagcctgtccacctgctctgacctagcctagtcccaatacccttggagtctctgctgttgtaggtaccacatttggcttgctgggacaggaatcccaggacactgtgtctgacctcatctggcacattcacttatcttgtagggtagttttaggttcacagcacaattgagtgcctgcccattccctctgcacaggcatctaagcaaatccttatccacatacaatggctgttttttccttctggggcctacctctgcagcaccagaaggaggccaaagatgcagagggagaatttctcaaggaagggaagaattcctctcatcttccataactggctactcatagctgcaagagaaccgggaagagatcacccaccccaagttcaggtgtccacatcctgactctcagtagcaagatccacatgaatggggtacccctaatccaaattgactgctgtccttggacgatgaggcggctatgacccagacacacagacaaatggcgtatgaggacaccacagatcatcagtgctgtgggccaggtagtggtgagtggctacacagtgtaaggcagtgcgccagcaccatagacccacggacttgggacggccacatcatggacattgtatcatgtgtgacttaccatcttggcggctactgcttggaatcgctccccttgtggtaccgagccatgctgtgtctgtctgtctgtctgtcctcattctttctgtagcgctgggtatggagcaagggcccttgtgcatgttagggagacactctgctactaagccaagccacaccacagccctctactgcagtcaaaggatctgaagcagatcttttggatggacctaagaagtagatactgtcaatgcataggcaagggcacctgtgtctaacagtgtcaaggttcacggagggtaaagcatttgtccgaagtcacacagcttgctggctgctgcactggtttttgggtctgagatctgttctcactgctccttgccttgacctaccccagcctgtgatttgtaaaacagggttgtgttgttgttgttatttctttggctggaaacgttcaggcaaatagacctttgtcactgagacagtccctgctgtgcagggtcagcagaagcaacccacggctacttggtcctcacgagatgtcagtagcgtttgttggcttgcgatgagttgatctgtaggtaccatccagtgtccccagggaagacaccactgggttaggctgggcttggttccctggagcctcttggccacacccaggatgctctgcgactgctcaggttctaagctcacacctatgaggtctgtggagatgcaccagcatggtagagaggttatttgaagaaagggctcacagtgttttcctttgcctgttggaagggccccagggaggcccagttcccattaccctctccctgggagtgacagaatgcatcgttttgttttgttttgttttgttttgttttgttttgttttgtttttcgagacaggatttctctgtatagctctggctgtcctggaactcactttgtagatcaggctggcctcgaactcagaaatccagacaggatgcacctaacgccaatttctggcatgtggctatgtgtatgtgcctggagcctaaacagtgctcatttgcaaggtggtttctggaaacaaaaagaatccttgtttagtgtatgccaatgtttgacaccccccacccccagtggtgtttctataaacaaagcccaggcctctctctgttgagtccacaatgcaggaaatgcatgggctgtttctgatgagaaatgctacttgtgggcacacatggcactgatgtccacagtaggtgcctaattatttcactacggccaaaggcaaagcattgagataaagcatcatctttctcttccgtgtatgtctccattatttgaatatgttttatgataagaacatgtaataacttagttcctttatttaaagaaaaaaggcttcctctataacaggaagtttcaaaacaaaaatgtaccattaactcgacacacaggagcttgtgctatggaagtcacccagagggtgaggccgtgcgtgtgtgtgtgtgtgtgtgtgtgtgtgtgtgtgtgtgtgtgttcctgttgagtcgctccctggtaacgccatgctgccggcaaaagcagccatcttcccggactaccgtttgccctgccatttgttggggcggcaggaatgtggaaggcaagaaggtacctaaggagaaggaccacaaagtgtctagcttgcttcttctgtcctggctaggtggcagaaggctagaccacacgaatcttgggaactcccagatccttccagacccgttgagcagcaagacaaaccttacgggctgagaggtggtgggggccaaggagggggttagaattttagcagctttcaagggaagcgagtatctgggtctgggatgatggctgctttttagatttatgtgggtgtttgtttgtttgtttgtttcattcattcattcattcattcattcgatagttagttggttagtcagctaccagtcatgtgggggacctccacactcagccttgcacatttttccacagtccgaagctctctgaactcatgccatcccgtcccggaatttgtttttgtttttgttttttaatttttgtttttgtatttgtttttgttttttgagtttttttgttttgttttgttttgttttttacatttacaactgactggggtcggtgggaagaaagacaaacgcctctcccctgtttggagtcgtgcgtaatttctatctcttgacctttgaatgtatttgaatgtaagcagcagtaaaaatgaagagctatgaccgtcatttcacaccccggctgtactaaccggttcctgcccgagcgccgggggttttaaattggctaatgcggaatgctcgctgagctaataataattcagattacttctgtcagctattccggtttcatgggtaatttagtagttgaataaatttttttttaaaaaaaaattcattcgttaccatgggctgcgatgaatcagtagatggtttaacattggcagcggtaactgtaagaagatttaaatcgctactgaaaaggatttgagtgaaggtaatgttttataatgttctaagccatatgcactactttcaggcctcatcagttttacattgattcttagtgaagtgtttaattgcatcgtgaatgctatataattcagttctttctgctaatatggtatatatctcaaagtgatatacagccctgacaggggggaatttgccgttttgtgtctgggttttagggagacatcgggtactgggtatcttgggggctcgtggaagggcggtgcaccctgccccaaaccctgcacgcaccctcccagggtggagggccaccggtggcttggctccatctcactgcgacttgacaacgtggttggcacatgctgggtcggtggtgtctgtcaccaaggggcccaccaaggggccatgccagccggatgggtcagggggtggggaagtcctcccagctgtcggacgacgtgatgcagagagctttgtacagagctggcaaggcgcgtgcatggtgatgggcccacttgcaagtggctgctgggccttctgttgcctgttgtcgtctgtttaagcatgtgttgaatattcacggagnnnnnnnnnnnnnnnnnnnnnnnnnnnnnnnnnnnnnnnnnnnnnnnnnnnnnnnnnnnnnnnnnnnnnnnnnnnnnnnnnnnnnnnncacagttggcaaagtggttgccttacaagtatgggggcttgagttctcatcccaagaatccacatttattaaaaaaaaagctatgcactggtggtggtacccacttgtgatcacagcgctggggaggcgggaccagcagcccatggagcttattggtcagtgagaggccacgcctcaaaaaaaaaagatgaagcatgatagacacctgatgctgaccgctggcctccacacacatgtgcacatgtgtatgctcatgcgcacatgtacaggtacaacacacacacagagaagaaggtggcagatcgagagacccacaggagccgccggcagtatctggtcataaggagctgagctcaggggacctgggggcacataagaatgtgtgttctcagaaggggacaggtggcccccatctccagcctcctgtccctaggctgccagaacttttcattttcctcaccaagttcaatctccagatttctacaaagcccctcttttttttttttttttttaagaaaaattcaaacatatacaccatccaggccaaactaaatacagtatgtctgtgggcatgggctgcgtcagccacctgtttgccgtgtctgttccccgggcagggctctgctgttaaagcgagaatttttttctttttttctttctttctctcagctgacaaagtatgtgcagttccagacaggagaggcaatgtgaggaggcctgccgggctgggatggctcaccagagttgggcatggctgtgctgtgctcagggaggaaggaggctggtgatgatgatgatgatggtgatgatgatggtgatggtgatgatgatgatgatgatgatagaggaggaggaatacttatcagacagacccaccccagtgaccctatttgagtttggctggtctacccaaaaccttgcctccaaagcaggtcacatcctgaggtctgggagtatgtggacatgaaggatcaccattcagcccttcacacaatagttagaggaacagcggagatgtggttgtgaccaagcaaaagaggcaggaaaactgccatactggctggctggggacagaggcatctgtcagctctcagtgatgccggtcatatctgtcccagagcggccggaccttcaaacgcagttggtgcctgtttagccatctgatctcagccatcagaaagtggcctgactccgccctccgcatggcgccagcacgatgtaatcagagctgtgtccttttatcttggctctccaggaaggccagccagctagcgctctttttgatcactagaaccttgacacagaagaataatttacccatgcggaagaggggcccgcgccatgttatttatgaaggcgtccgctgggcgcatttctggttcccaagtttgtgggtgtctccaagcagacagaacacagacacatctgacagtgtgaggtcaggggagaccgtggacgtgagcttgacttggaagagttgggagggctctacagtattaaggggccccagagctttaaagtctcaagttcgggtcccagctctgtctttgtgtgtgtgtgtaggccagctggcttgtcattggtttatatttttttgcagaaaagagaacaaaccttccccaagcttgcctcaaggttaacgtgagaggctgaagggcggaagtctggtccctgccctgagtcttagctacccactcagtctggccccacagcccacccttgctccttgcctgccgtggggtgaagggaaaggcatgatctgcccctaagcaagtgttcagtactagcaacgtctcctgggctcctccgggtcatgattcgagtggcctttctcctcagaagtcatttttcagccctgcctcaagtatagacgcagcctgtccctcacctgccgcttgatgctatcgctgctcgactgagaatttaaaagggggagggatcagtgaggtggccgggaaggtaaggggaactgccctttaagccggatggcatcagtttgctacccagcatcaggtggtggacagaatcagctctcaaaggttatcctcagacctctccaaatggattgtagcgtgtgcatacatgtgctacacacgcagatgcagatatgtaaatcgtgaaacggtgttttcttatactctgcatggcctagggtcccttgtcatcagattgccaccccaagccatcagaagtttcctccctaaggtgacagggctgtgtgtgcccaagggagccatgtctgtctgtctgctgcaggtggactggcttacctcaacgccgtggccacctcacttgctaaactaggcacaccagccaccttgtgaagacatgtggtcccaaaagctcccccccgcccccggccagggttttgcagcctctcagcgttttgagggtctctcagattagcacgtgggattgaattagtggtcgttttctctaatgcgctatagagggataatcacattagcgactttcctagcacatcagattagacgtttggagcatgtccctgcctagaagagtgataacggggtaagaaagatcagccaacaaccacggcaggcaagcccggtctccatttccactgtccagaacaccgccctccctctgctccagcctcctggtccctgcagaggagggatttcattctgtccccaacatacatggaaaggaatgtaagaccttaataggggcaccaaatgagtgtttgtctaatcaaggggcagaaacataggtagagccgaggctgtaattaatagcactaattaccctcctacccttgccctgaccctccgatcccaagacgccgtagcaggagcagcgggaatggttgtcttttgctggccgccgtcgctggccaaggaagctggtttgtgagcttgaagcactcctgaccggtccctcccacttcaaagctcgactgccgattgtccagtgctttctccagtcggccttccagaactgcccaggctagctttaattaatcaatcaattaattattaattaatttaaagaacttgtttctagaatggcatccccagggcagatctcctaagccatgttctctgtgggctagccttgccacgggcactgtcccaaacacagaagaagatgacgtttcttatagacagacagacagacagactccctgaggtctctcactgcagactccaaatcggcagtacctccaggcccggaactcaaccctccgcctcaggccactggctgaaggactctgtgtacagtagaagagagagggccggtcgggcatggaaagtctttacacttggggccttccttcatttaaaaaagagataggaggcaccctaagatcaggctccatagatggcctgtggtttccatgggagctgggggctgggaacagcttcctaaaggactgctctggggagtctgcttatgtatagcctgacgctgatgtttccgtgtgtgtgtgtgtgtgtgtgtgtgcgtgtgtgtgtgtaggacagaggtcaccctcagggaccattccttagtcagtctttactttggtttttgagatagaatctctcactgggacttggtgcctgctgtctcagtgaggtcggctgggccagcaagcctcacggatgtgtgtgtctccaactccccagcgctgtgattataaacacgaagagacaaagagtcacgtgtgtctcttgatgtgtgtgctggggctctcacggctgcacggcaggcacagtcctcactgagccatctccccagcctggctggagagtagtcttccactgtggtctgggtcagcgaagaccttcatctgatccgtgaacaggcttcagtgggctctggggatgcggccttcatgcagtgctggactccatgagagcagagttcgggaggtggtgggagctaacaaggctgactctcgtggcacagggtagagctagcaccctctgctaaaagtaaggggaagccattgggcagttccccaggggagaagaactatgtttaaagaattaaaacatctagctcagtgtcatatgcctttaatcccagcacttgggaggcagaggcagaggccagaggccagaaggcagagggcagaggcagaggcacagagagcagaggcagaggcacagaggcaacactgagttcaaggccagcctggtctacctagatagttccaggatagccagggctgcctagagagactgcctcaaaatgaatgaatgaatgatagggacactctgggatatataaagacagttaatgtaaatgaaggaagacaagttcaaaggatggataaaggataggtaggactgattcactaataggtttgatatgtgtggcaatctgttagcaatgcctgccatgggcacaggaaaggcagcggcgatatgtgtgctatttatttgctttctctgccttgtgaggcatttattggttggtgggagagaaaggggaagataaagggtcacccaagaatagtatttggtgcctttagtagcaactatgggtgctttgatagggctagtcatccactgatcccaggagcgtcaagcaaaggattgaactgggacagggtgagaagagcctatgtcgtctccacctaagattgccaggagtcagttcaagcaaacagatcccacagaagatgcagcaggacagccaggcttcctgagacctgcatgactctgcaggatgccatcaggacagttctcggaggacaggcaaggcaggagtcatcggtggagcagggaacaaaaagaggttttcaaagctgtccagtgagaacagaggtttgagcctgggcccaatctgcttcccctttgcttacagctaggaaagacccaactggtgcaaacatggtaacaaaccagaagcaccttcaagcaggtaggcggatctctgtgagttcaaggtcagcctggtcactcacatagtgcgtttcaaggacagctaggctatgtagaaagaccctgtcaaaaacccttaaaaaaaaaaaagaatctaaagaatctagaaacatttcccaaagacctgatgctaagccagattggagaacatctgtcaggccatttttgaacgtgagcttcacggagatgtgttattctataagcaacatacgtgtagctttaaatggagcggttcagatgagcgctgttgtacaagggaggagcttccagcatcctcccagcactggtgcgcacggctgcttgccttgctcccacttacactatgtaggatggactgatacatgttgggtggaagccagactccaggggaagtctggggacgtgacttagcagataaaatgcttgctacccaaccttggggacctgggtttggattccccgatccccgggaaagccaggaagtggcactgtgtttctggggagtctcacagtgctgaagaggctgagacaggagggtccttggggctttgccatccagcggggccaagcaatgacctcctggcttcgtgaaagaccctgtctcagaaagtgacaaaggatgatagaagaaaacactgtataatctgtatctttcacatacacatatatgcaaacgtatacatcatacaggtgcacacaggcaggtaagaaaccagacttccgattttaaattagggaaatgtttctccggatgctgggcagtagtgatgagggcggctccgtggcagtatcacagccacaaagggcacagccaccatacagccagcatgctgtcactccactgggatggctggaaggcgaagcatattaaatgccctttctatttataacatctccaactcaccttggacttgttaggggcacaccccatgatcagtcaggagcaagcacctcgagcccacaccggcttcatgggacattgtgcacagtgggtgagcatgggaggtgtgcccccctccagcccccatcctgtcagacaccaaagggcttggagtgatgcctccttggctctagtgtgttttaagaagagagtctctgtggtggggcctgtgtgtcctgcctgcacacgagtgtatctgtaggcgcagcacatgtcagagaagggctcaaggcaccatgagacttagctttggtcactagtcccatgattatacatggctgtcatctttgtgcccaggaaggtggtgtagtgatggaatcgaattgtatttcaggggtccctctggagcagtgttgagtgggttcatggtatctggagagtggatgagggccacttgggcttagccttagcaatggctgatgggtaccctggtgggccacatatggagaatggaatgaacagaagtgaaaacctctcccaggctgggaccgggtagtgatgaactcaccagggattttctagaagagagagggaaacggggtaacagggaagcagaaatgaggtgctcctgacctcccactgggacgtcagggccgctgtaggcatggaggtaagacacagcggacaatggagcaccagccctggagactgtgctggctggcctacagtcatcacgcggagtatacatggccaccctttccccagcacacagacatccaggagatagagtccttcaaggacacagccccttagtcccccccccccaagtctccagcagagctgcagtgggacagctccctcagcatgcagacaccagaaggctgggtgacctctgtggcgatggctgggaacagcttccttgctagctcactcccctctctccgacagtaaagaatctgtatctgaaggcatccccctgcgctcagcacaggccacctcacaagccaccctcagcccaacccccagccaactcagcaaacgcttccagcgtccaacgccctcaggcctgagccaccagtgaggatactgagactcagagaagtgacaggcccactgcagcaaatggcgggcctgtgacagcggggccccgtcccaactgtgctatatgccaagtgccagctgaatatcactccttagccacagctgtcctgccccaggctgttactgtgacacccattttaccaaaaggaaaactgaggcccaaaagaggattagctttgctctgagtcacccagctggaatggatcagcgccaggctggaattgagcccccagctctacccctcccgtctgcagtcccggcccaaagcactcagcagttgctgaggcaggagacagaactgggcttagatggaggatgcatcagaggctcatgggctgatcagagcagtatggtccgggccttggaaaccccagttctggagaggtgggcccaggggtacgggaagcagagctcacagggcagtgggcacccaagctctcacggctgggatgacagtctgagcaagctcatgggagctggggtcctgtccctcacagcacccggcacagcaggggggggggatgaggagcagctcacaggcggagcggggggacttcctgcttgctttagcaagtgtggatgggtgtgtgtgtgtgtgtgtgtgtgtgtgtgtgtgtgtgtgtgtgtgtgtgtgtgagcgtgcgctgtgggcatgtatacatgtgtgtcttgaatgagtggctggaacagctacacccagacttagcctcccacttgccaaacttcccaggagatgcttattggtcaagtagagcatcaaaggtttctgacctgtggttggactgcattagatcccagctctgctgcccgctagctgcttagccttagctcggccagttttcacctctgtgcctcagttttcccatccaagacatctgactggtacttagagctgcttccagtgcatgatacagttcaccatgtgctagctagtgcttggttttttttttggggggggggggtattgttgttttctagattttactagaaatggcaagccttgtggcccctattgcagccgtccacctttgctactgtaacaggagagtgaccatggaccgtaagtgggttattagacgtcagccagagtggcctgtctggcatagcgacacgcagtatatcaaacagttgtgcctggtgctcaggtgggtcacctgtcaccacatttctgttccaatggtgtcctttaaagtggcttccctgcagccacctgtgacatttttctccctgctcaagaatacttctgcccgccactctaaggacagaccaaggcctgagaatggctcggtaacctgccttgggtcacatcactgctgagagagaaggcaggctcagagccctcaggttttggcccttgaacctctaccctctaggtagttacatggaggctaaatatggaaggattgggggccgggggggggactccatcctggggtgcaaattttcctctgcactggagatctggggagcttagagggcggtgggaagggctggcaagtcccagtgactgtttgctctacagaaagcatcgttgtggttttctgggatgtatgctgtctgcattctgacagggagggaggggtgttgggatcttggccatgtgcctgttggcagtgggctcctggatgacatgtggagcgctgtgggagttatccagcggcctctcaggatggctggagacgaagcgaagtgggaatgggtgggactcttcccgtgtctcagacaggctggcagatagcaggacagcacatgcgggtaccatttgtgccctgtctcttctacggggataggctgagccagagaacacacaggtatcttggcattaggaaagcaagacccctgtccccacaggtctctgcctcatccgagctattaaaacctcgggctctttgtttctgctccccacacacacccccatctcccccaagataaattctatcctccctgctttggcttgggaggctcttgtgacatgacccctgcctcctggtcctagctcccgtcttccatcttgggtgtccctgtgccacagagagtgctttctttctgtcagttcccggcccaaaactgactgtgaggtgaacttgaacggccgggagaggtctgatcatctgtgcatcttaaggtagcttcaccacgccgagtccggcactgtgtctgagacttttttcctactcccttgtcatctaagtttgccacacggggtagaatccactccaccctcactttctagtgggaaatggatgcactagttttttttttttaattaagtgcccaagatgccccaatgaggacatgttgccaagactggtactcaagccagctcaggtcccatttggggttgtcttatgtgtgttgcttgtatgatccagctcagatttgggccctgtcacacacacacacacaccatgctccaaatgtaaccccacactatcccgcactcgctgtcaccatgttcacaggctcctgattgccctgtgacgcccctaagagtttgatggatcagcaatggcagcaccagcccagctgtcacaccaataaaggcagaatctcagaggattctggaaggtacccagtcaccctctctgcttatcacccgtctgtgcagaagccagggcctcaaggggcagtgttcttcaggcatgagggtgttggaaacagagagcccctaagtctactccctctgccaaacctcactccgtgggcacgtggcccatgttggcccccgtggctctgctcacagtggacacattgcttctgctggccccggcatccatcaacccagacctccaatgccatgccgggtgaggagtgtcacattgcattatcgagtccccatcagtccatgtcatgttggggtgcagcgtgaaggccggtgcttcctctaatgtgattcgaaagtgactaatctgagaaggcttcccacactgtatcctgggaaataaacatcacaagcccgcggaggctgctgctcaggaagtccctgctgctgctgggccttgatgggccggtgggggaagttgggattggtgcataaacttttttgaaactgaggaagtctagagctctctcacaccaagaatgatgatcaacatctgggtctgggaggtgccactggaggtaaagcaccgccactcaagcatgaggacccgggttcgagccccagcacccctgtaaaaaagcagggaacacctataaccacaacaccaaggaggaagagacaggcagatcctgggagcactggccagccagcctgtcctaattcatgagtttcaggctcagtgagagatactggctcaaaaaagaagattgagagtcacctaggaacacactagcatccacctatgtcctacacacagtcggtgtctggactcccctccccacttactccctggtttggagttggatcctgtctcctccagattcatgttcaaataggccctctgagaatagggtctttgcagaggtcattaagtcacacaggattcaggctggctctaactggtgagaaagccacgtgaaaaaacagacatgttaacatgacaggcaataagatgcagagatgacacaactctgagcctagggacacccaggccagcagagccagtaggcactgggggtgggggggggagcacaaggaagaacctgctttgaacttgtgacctgcagggccgtgggagaactgcatcatctttcccatcgtcccaggaaatcaaaggacagcttctatcatcccaaagatggcaggcagcctaggtattctcaggtggcattaggctcactgactgtcccctggctgcaagtattccttgagggccgaggagagtcaggcagtagagggcagctggcatccgggtgtgcagcctgcctcatatcgcgttaacgtgtgattaagggggtctttaaggcgcccattagtccccctctgctatctaatagggctttcggatttagaacagaatattatttactcattagctgatagcagagccggagcatgctgtgtggaaggggagccacgattagagacaattacacaagggctgccgagcttctggtagggctggtcgtgtgggtccgggtgacccatcatgcatgggggtgacagaatgtgacctccaggaaagataggaaaactgggcctgctactggtcattagaggctcagaaaacatagaagcaagtcccagggcagacccagcacttccgtaccaggccggggattcaccaccttaaagcgggcagtcatggcagtgctctgtggtggcaaaccatcagtcacacctcctaggccagtatggtagatcactggatgccccgcggcttcctggggcagatgacatgcctgtgacctacagctaggaagtggctagatgccagctctccttgagtggcaaatcctgaaaccttcccagcatgcttctgtgcccaaggcagaggcacctgggctggacctcatcttctcttaatcaagatgagggaggggaggaagccaaggactaatccagtgagcaggagcctgtccctcagtggcagaaaccttgactagggtaagatggggagggtcaggttgctgtctgggatcagtggctccggcccagatgtttggaattggagtcagggaggagacaggtgggcagcgtctaggagtgtctgtagccgtgcctcttgggagccatgcagggggcagccctcttataacagacaggatacagcatgaggaaaaacctcttggagtttgaccttcatagatgccttgatcctggccagcctgagcctcaggtcatgcattcctggtgactttgtaagtagacactcaattgatgatggggcttcgtcccagtgaccgttcaatacttgcagctctcttaagagacacactccacgtgcctcctgatacctatcccgattggtggtgcctcctgtcttgtcaggagggaggtgtggaccaactccaaagaagatgcacagcgaagccagcagtcgagcctgtcctgagcatgtagaaccttcttcacactatcactacattgggagtcagggactgtccacacaggcagaagtaccaggccaggcaagcttggagcataccaagtatcagatgctacacgggtcctaaacctcacctcagatgcctaagagttgaagggaggctgatgtagataaggagatctctctctgtctctctctctctctctgtctctggcccatcagaccgtggcccgcttactgtggattccaggatgtgcaggggacctgagctggctcagagctttgtgggttcccagagtggccaccagtttcttccaatggcactggcccagtaagaccagacacctggcttcagggatagatattccaggcacaagtggtctctgtcacttcctagagttgcaaataggtcactgatataaggatggtcccttccggctcctctgggacagagccaaggaacaggaactttggcagcaggaaccttcaatattttctgcttcatacttggaaccccgcctctgttggccaggcaaggggcatacaccagagtatgagagtgagcatgtgagcgtgagcccacttgcctccgttctaataaacctccccaggaatccgatatcagttcctgtcagaacaatgcagcctatctgaaccagaacaaaataaaaataaacattaagcaattattggaatttaagtttatttacaagatcagcaggctgtggggacattacacccattagtgaggcccaagtgtcaggcctttgaacaaccccacagttcttggcatgtgggccatggactttcaggctaggttgactcaaaagcaagccagtactgtggcaggcttcctgcatatcctatgttaatggctttgttgggatcttgggagggactcagtgtccctgtcttgagcagagtattccatccagtgtggtccctgtagtggaggggaatctgaacccccaagctgctccagacccttgcatccccaacatccctcgttccaaaggagcccacatattgccacatagatagaccagcagctgtcacactaagtgctacatctcagtcactgttcaccaccccagaactaataccctctgggaaactgtgagttgggaatcggggaaccagccatcagcatcaagagagcacaagcaccccaaagttgcaggaaaaggggctagtgttcctccaaccttggctccaaggagagcccagtaacctgcccaagtcactggttagcacagcctgctgctctcagcaggatgcttcaggccaggcagcccaggcagcccaggtttagagtagtccagtccaggttaatggcagctttcgtagggggagagtcctccccttctttcccctctcactcctcccctacttgtctggaccttgctggggagtgggcagagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcaagtggggcaacgctgactggagctggaggtgactctggagtggctgttggtcacccaacaccttataggtgtttgggcaaaaactcagactctgccttcatttgtctttttcaagtacctgagggaaaaggtgggtttgtacctatttttcagatgaggaagactgaggctcagaaaaggcaagggtttgtcttaagctctcttggcctggttaaggaaaaggcaaaggcccaggagcaaccaagaggccactaggagccccttaagtgagattagcaacagtccccaggtccatggcctgcctgccaaaaacattccaaagctgtggaagaaattgctgtttgaaagggcccaagagcaacagtctctcatggttcaactaaaatctgagcatggggcagaggtatatctccagagaattctgccttggtacggagtgtcatacaacctaaaacctaagctatccgtacacacacacacacacacacacacacacacacacacacacacacacacccatgcacgtacattcacacatactctcacatatgtacacacacacacagacgcgcacacaggcacgtgcacagaagccaatggggccgtccggggacgtgcatcctggaatcagtctataatgcaatcaattttgtatatccccggtgaaactgcagcatttatttaacgtcttttataagagcagctgagttttatcacaaatcacattccatttccagtcatctgggactccttgaaggctgaaatgcattcacttcttccaaagaaatttaccaattcctcaataaaggcccatttgcctctgtatgtaaaattgacacatttattgactattaaacctcgaagacttgggttgggtttttttgtgccccagccccccaacgctccccacacattttcttaagctttcaactcgatgccttcaaagcctccccagtcacagaaatccctccggggagcaagaacacaacgggtgcagggtgacacttgagtcaagggcttgcttctcacgtagccaccggatgacactgaggtaggcagcagggcccagtgctctgagtagccctggaagctgtgtgcctgcccctgcccttcatggtggttgtggtggagggtatggcgggcgtggtgcggtgctgtccttttgggcttgtgccaaaggtttttaggacacactgatgacatttgcagaaaggcagggcccacctctctcacaacaatgaattatcctgaggcctttgagttaaaacaagaacaccttttacgggtgttcctgttggaggtggatgtcaattccagtcaggataggactggtgggacaaaataggcagggtctgatggggagtggggagcaggagagaaggggctgagctgttgaatgtggggcccagtgctaggtcccatctccgaatgtgattagcaatatatgctggtgggtaccagtggccaggacaccctcctttggggtttgtttaatttcaaatgtaaaatgacggatgtgggggtctagagagagagcttggtgcttgccacacaagcatgaagttccaagttggagccccagaacctgtgtaagaagccgggcattctgacgcactattgttatcccagtgtcggagactgaaccagcctgaccagggggtatcaggccactgagagagagagagagagagagagagagagagagagagagagaccctgactctgaaaaactcaaaggaaccatactcaagcctggcctccagcctccacacgctcacacaaacgtggctgagggagaacagagggatctgtaggtgagggactgaacagacccaggttcaaatcccgactctccttgccagccccgtggcctccagtgtgtttttatcttagaaccttggggtcccgctatatacagttaagacaaccagcgttcatcttagaactctaggcaaggttagatgagatggtccacttaaggaaggttccggaagcagcctcagttggtcattgctcctatcgtgggcataagattcagtgtcggcctaggatggggaacgaaaagtcactgggatccagccacctgcctcaggctccattttcctgcccatagaaactggtcatctactgtatgttaggatggttgtgggaacaggcagccttccctggccccctcactgtcttccttgggttgacctaaaccctgtttggggagctttctcagaccacacagctccaagctctgagccctagggcagctgcctgcaagatttagtagactcggctcgcaaaattgctgagatttagacgagccattattcagtgacacctctgggctgtacctctaatgctggcagtaccccattgggattttcaaagtggttttaggggactaaaggcagaggtcatcacagtactcagccagggtgctttagggcctgggatctggctctagacatcaccagctggggtggggtgtgtggggtcccagcagggcagaatcacttgaccagggtctcccctggccagataccttcatggctccctgttccctctgacataccagtgtcctcatagcttatacttccaggatgtctgtcgcctttctgggagctgagccccatgtacccagcttcagcaaagccttctgggacctgaggaccgaaatccaacctcttggcatttcctatagctgactctcggaacagagggctgggggtctcctcttcagaggatctcccagggtgccatgtggctaggcagcactgtggtaccccagagatgaagtaggggggattggtttctcgaatgaggggcagccagctccgggttagtgaattttgcttctgtctgtcaaagtgatcctctacctctcagagcctctgtttcctcatccatataatgggataaaaatacgcctatctcacaggaatatagcttacataattcacagaattactccacgggattccacaaatgtgtatcattttattctttgtataggcactaaaatatataaagatacattaaaaaaaaacaacagagacccactccatgcaaagtgtctgggctgtaggggccagggataaggtatagccagcttgtggtcggcagaggcagacagactgacagatatccagagtgaaaagccttcccttaaggtcgcccctaggcttgtatcggacttgtgggtcctggtggactgaggactcgcaggctgccattctcgcccgttaaccgaactcgctttagtcggaagattctctttcattttaaaagccagccagcataataaatcttgtcccaaaatctcggcagcgcatctcggcttgagtgtgtgataaatctaatattctgtagtctctgtgaaagggaccctgggcggatctgtatcagaacgacgggccaaccagtgacttgctcttggctcgacaaggccagccctctcatcagctctgtgtgggtggactccctccatccctcccatcctccatccctcacccccccactctggcagctgggtgaggaccaggtgatccccgacatacataaaaggacatcacagcctccaggcaggagctgagaggtctgggaaaggagggaagcagggccctggggcccatcagaccctcacagcaaccccccctgcccctttggcataaacaacattcctgaatcaaatggtggggccatgcagactggagccagtgttccttttgcctctccacactgatattaatcaaagtaaactgtcacatggtctcttgtgaaggccggaattcttctctggggacagtctagatgagatataaaggcttcttggtagaggcctataagttgcagggcacagggagggagctcttgggtccagggtactggcttaagaagaggctactcacattgtgaacannnnnnnnnnnnnnnnnnnnggacaccaggagggtcaggctcagctctcttttgtttgttctacaactagcgtccaggcccctgtgatgccagtgtggttttgagggttaggagactataaagaagacagagatgcacccgtggggtgtgggcattcacgctcgccagagtggatactggtgacagggcctgtcataggatatataggagtcaggaccagtggcatttgggaatttgtggcatccgagtcatggcagggtgtggccagtgcttaccatgatgggggggggatccacctgctatgctgtggtgggaccccaaaggacagaatgagcagagggcaaggtgcagctgagggaagctgataggtactgccagcctttctgtttactactgagtgggtggctcaaggtcagaacagatttgtgtgaagggccctggccaagggtcacagtgggtgccctaggaggggtgtgtgtgtatgtatgtgtgaatccctctttattcagagctatgcagaagcccagtaggggctccaaaaatggagagacactgccctttaacaaccaactctgcccctcacaacttaaaaactactccctctgagcttcagtgtctctgggcctggagaagggacatcataccaatacccagtgtggtgcagaggctggaagattaaatacggacagacatacagacatacagaatacagacatacagaatacggacagacagatgtgcaaggtacccggagtggagacttagccagccctgagctttggtgttccctgatcacgtgaccgtgggaccatgcaaccgtgggcccaggaaacttctcactgtttccccatctgcatggtggcaatcccagggcttcatggtgtcactgggtcctagctccactgggctgagtcacctgttagttgccagcttgcctgaagactctggtattctactgtgtcccaagtggaacctgtcccctgccatttgtgtgggaacaggggcctctgacccagaagtctttgtcacccacctggttgtcaaaggcaaagaagtttcctccactgttcacaatgtgagtagcctcttcttaagccagtaccctggacccaagagctccctccctgtgccctgcaacctataggcctctaccaagaagcctttatatctcatctagactgtccccagagaagaattccggccttcacaagagaccatgtgacagtttactttgattaatatcagtgtggagaggcaaaaggaacactggctccagtctgcatggccccaccatttgattcaggaatgttgtttatgccaaaggggcagggggggttgctgtgagggtctgatgggccccagggccctgcttccctcctttcccagacctctcagctcctgcctggaggctgtgatgtccttttatgtatgtcggggatcacctggtcctcacccagctgccagagtgtgtgtggaaaggaacagagaccaggccatccccctgcctcagagacgagaggcaggtgggtgaggctcttcaacattgttgagagaagatagatggcctggaaccctctctgtagagatcacctctgggccccaccttgatgggcacgcaagaggccctccccgtgcttagaaaggaataaacagcgtttaatgaagttacattgtaacataatggggatcataaaaccaccgtcatcctgcagggtccccggacggtctttattatcgactgtgctggaatcggctttgcagcgctcaggctgcagctgtgagaagaatgcaaaagtctccttaaattacctgctggacgtaaccagtggaacattccatgggccccccctccccacgtgccccggggatgctgccgtcgggcggcggtctgtcagagtcactcactgcagcacaacagatgttcgccctgctcctccatccgctgtttgatgagaaatttactgctctcccgctgggcaggcagcccctctcggcggcctgggctatgagacaggccagccgctggctgccggccagggccaggctgttttgatggaagccatgaaaagctctggcttggaaggcgccggcgataatgcaccggctagactctcctgattggccgatcgatcggcctgatttgatttattgatcaatcccctcaaatttggcgtctgagaagctgcagtgatctttaactgcggtgaacgtctccgcctgccggagaatgagcccccactaaggaatgtatgaaaggaaccggggcttatcttaatcacacaccggcctggtgctggccgagccccgccgtgcgccgccccatcgcccgggcagccctgcgctgatctataaattgatggaattcaaagcctccagcatcgattaccgttataacaaacagcggtgcgcagaatgtctgattatttttagacaaagattctgttctctcagcagcaattttgctgagcctgtcactggctcagaagtctgttgattgcaattagatgcaaatacaaaaaaaaaaaattaaactctgcagcctctctcctgtttccagttattaaatctctctctttgtttgccgtttcctcatgatatctacagctgggtgagatacttggttggcagaacaagatccttgggatccgatgaagaagtggggcgggggtggggatgccctgacctgcatactggataatttccatgggggtggggcgtgacttatcttgggggaggggaacccacagaaggtgtgtaaggatttccactaaaagagtgcaaaggttccaggcagagtgatgcttgctttttgtcccagcactctggaggtagaagctggagtttaagatcaggagtttaaggtcatcattagccacatggtagagtcagggctagcctgggaaacatgagtcttgggggatcagagaaggggggaagatgaaagataaaggtatttaaggtagtgctttggaggcagactgctcacaaattcaagaccagcctggactgagtagttaaatcctgtgtcaaaaaaaaaaaaaaaaaaaaatgaaaaccaacacaagaggctgcaggtgtctcagtggccccatgagtaaagaggctcttagtgtgtgctcctaggtaaaaccccaaacacagcagcatgtttctggaatcccagtgctttgaggtcagatgtgtgcaaagacaggaagaggcacatctgataaagatggaaagcaaacgaagaaaataactaatgccgactcctgtgtgcatgcacaggcccgcacacacgggggtgggggtggctgggctggatgcagaggtgttaaaacccagctcaggacatcaagcgcagactcagagccagttgagcatctctgatgagtgggtgtggtctaccggttcttcatggcatctgagaccttaccaggtgtgcaggccccatcctgggaacccctcagcctcggaggtgggtgccacttggaataatgagtttccacacagggaccacaggtggcaccctttctgcactggcagaacaagcttcaggcaattgtgggtacaagcaaagtaggtaccccctgttgcccagcctggcggccagcatcctggctcttgaagagcccatccgtcatcctggcatcctctggttgatctgtgttcttggaaccattagccccagagtccttgacaggggaatagctgtgaagctgagcccatcagtggggcagcagagactgacaattcattatgcggttggatggagagaggactcaggtgacagtgccaaggcctcttggttcccaaaagccagctccactcggaattggcagccttgggctaattttagaacactcgacattgataatacaggaggaggggctgcggcttggactctgggatcagatggactgggctcaggaagacatcaaggccaaggacatctcttccactgccctggaaggatcccacaggagagcaggtggggagcctgaagggtcaccatgggacaggtcagaggtcaaatacctgctccttgcataccaccagctgctgcagatcccaagccagcagcctccatgtaccttcctgttcctagctgcccgggttcaggagactgttatacagacaccaaggggcctgcccaaggttgcacagtaaagaagtccaagagtaagctggggtttggagctgagggtctcatttcacggaggagaaaatgtcatcagtgttgaatggatggatggacagacagaaggatggatggatggatggatggatggatggatggatggatggatggatgaataatgcaggagcctcctgtgaggatctgtctgggctcctgaatagccaaggataaccaggctgtctttctgcacaggcctggagtggggaacctggttcctatttatgggcattgagagaaaccagtttggtctcactcagaagtttctgtgcaaggacgctctgggtacaaggacgcttcggggtgctcttccaggaggccccttgcactaggatatccggaagcagatgctctcatggaccacctgtctgggaactacgccgctttgggctgatgatcagggacaccaactgcaaggtcacattgaccttggctgggataggttcactctgttctccatgacctcgggtgcataagcaaacatctgcagtcccctccttgtcctggtgactaaggtcacaggcagcagacatatctatacatccctatggtcaagccacgaactctgtttggtctgctgccccctggaggacagttgtggctaacacaggcatatggccttgggaactctccagaccaggcccaacaggagccaagtgactctccaaagtcactgagctcacggccacccaacccgttctctttcttgacaaccaaggaagattgccttctgggcagtggtttgtctgtgtctctcctccagcccctcttcatttctctgtcctgacccatttgtaagacaggcctctgcgtgactgtaaagagagagaacccctcacaggtgggggcagcaacagcaaaaacagggtctttcggggaggagccaggagcagctgccacactgacaagcaaccctgtctgtcccccacaagcccacgttggtgtcttttaaatacacccatttgcaaacacctacaatggatatctaggggttaccagaggcatatcaacagagcggacgttgacagtgatgtgcgtgtccctgcatcgaggatcagaaacaacctgtgttcacgaagaggaaatcataaataacttaagtgtccaggagtgggaggtttaaaatgacctacgagaggactggataaatggctcggtagttgaagtgctttggcgtgaaggcctgtattcccataccgtgtggaaggccaggcatggctacacacttatatatcccagcatgagggaggcaatggattccttgtgctctttggtcagacgtcttagacaaatcaatgttctaggttcctgtgggcgactctttctctctccatgggtatgacgcttgagattgacctctggtctccatacacacaaacgtgtatgtacatacatgctcacatctgtacatacatgcacattcacacacacaaacatacacactctggcagaaacacaaaactacagcaagaataacctcttgtttccatgcgtgaaggattcagactaatcatgtgtccgtgaagattgtccgtgtgtgttggggactaacagtgatctactgtcggttgggagagctgagctcatgggtgaagtcacatccccatagaatgccctgtagctgtgaaaatgagagagatgccttgcgtgtgaacgtgaaggcttaggcgtggtgaacctgtgcagacggctcaccgagcaagcagacatgggtgacacccattgcaggagcaaagagagttttgcggagtgactggggtggcgtaggcgtctctaagtggacattgatggtgaccacatccagggaacgataccctgtgctgagtcccttcactgtgtcagtgactgtcttcaccgatgacttcagacagacaaacaaaacaccaggttttactcttagaaacccatgcagggacatgaacgcagattcttggcatcagatatgggcacagatacaggctactacttgttggctgggtgcccttggctcggcggtggcatcgcggtgcctcccttggctggcctggtcagtggcagccgtgagctgtggtggctaatgtctgcatagctgctagccaagtcctgtcatggctgagacctcatcttgggagaacggctgtcttttggcagctctaagtccagagctcttcctgaagaggcacaggtgggtccccaagtccctgggaatcccatacttccttctaagctcccagccacgggctatccgcagagtccagcttctgtctcctaagagaggcctggggcacgcaacagggccctgctgtgcccgctgatgtggttggagctagacgggccctgtcttcctgcagcctcttgtcttctgtgttccctgatttcctggcttcctcccagagatgctgtcacaagccatcactgccctttactcccttccgttgcttttctcccttagacctggtgtagcccgaacagtgacagggcttcctggaagctgtgacatttgagcagagctcccaagtacagctgcaccgtgggatggtagccagagcgtactgtggagagaggagcatgtgaaaaggtcctgtggttgagaggaacaagggtgagctgagcctactgcagccataggtggaggaggaggagaatggcaccaccgtttgccagctgcacatggtgtgaccttgtcactccgtgcctctctgtagggccagagttaggaaccaggagggctgccttgaggtacagatcacacgcagtatctgtgactgggcctgatgtagagccaggctgtctaggtctcccgtgacctctgacctccctcgcccttccttgctacttcctattccaggcacttcctcaaccaagtaggcatgctctgctgcctcgggggacctttgcgttcccaggacctctcaaagacttccctcatagcagtacagcaaaagccccttttccgtgagtgccccctagtggctctatgaagaattgcatcccatcccatccccgccaccctccaccccacgcccctacacacaccaccactcctgttcctttccactgcttggtcttcctctgctggtctgcagttaaaaagcacttcagtggctcccattgctcttggagattgggaaggcactaggacatccttagggaccccagccctaagaggttgcttcaggagtgctacgacgacctttacactagtcatatatcctccgttccttcattccctcctgaatgcctgactgagatctagactgagtcattcctcgaacatggctcacagaggtgacggtttcctcacgacacagtaaccagctggatttgactcatgactgctctcctgctctccctgtgtgatggtcactgtcctcaatccactcacattggctcctgatagccttagcagtctctccaactgaaggacagacccagcccatttcaaagtcccactaagatgtggtggacgaggccagtgtcctgagcccgtcgatgaggcttcagggtctgccccctgggtcacctgtgacacctatgtcacctgtcacatccaagtctctgtgtagaaaagaaagccaagcatgctgagccaggtacagcctccgagtctgcctgagtctggcggtgcctgcagcctctggtacctgtctatacgtcattaaaatgggctgagacagagatagagtgggactggcagcagacagggacagtggccatcaaccttgagcactgggccttgcatacaggacctggtcagcaagaagtgagtcacctccccctactgtcattgggatcccactggtacagagcctgggtcagagagggccacttccatctccctttctcagaggaggcttgtaggatccccagattgccatccttaatgtgagagcttagaggggtttggtttggtttggtttggtttggtttggtttggtttggtttttttaagacagtttctctgtgtagccctggctgtcctggaactcactctgtagaccaggctggccttgaactcagaaatctgcctgcctctacctcccgagtgctgggattaaaggcgtgcgccaccaccgcccagcaggagctgagctcttgaaggctactgtaatcagagagcccatccatgttacatgtgtgaagcttttcaaacaggaaactaagagctttagttttgtctcatggctgtgtgtgtgtgtgtgtgtgtgtgtgtgtgtgtgttgcatgtggtgctgtacatgtctaatgtgtagaggggccagagaagatagccatctccaaccttaattcttgggatggggctccccactgagcctgaggctggtgaccagcaagcccagccaccctccagcctccactcccacgatgctggggtaacaggctcacgaacacccagtgcagccctttcacgttggggttgggatttgaacttgtgtcttcatgcttatgtagcagtcacttttacccacatagtaatccctccagcccaggattttcttctcttagaataggttttgctatgtagctcatgctggtctagaacttggaatccttctgagtgccggactggtggacctgtatcacctcccctggctggaacatgaagtcttcaacttgtctgggaatcctctggtccagtctgctgtttccagccctgacctgggttcccaagatttctctggccattccaggccccacctgggcctccctgacctctgtctgtgaggggcagggctgacagctgatacaggcactcctctgtatcacccccacctcctccagccagagccatcgattggatgcttttactaagtcactttgattttgaacttgacccctctgtccatctcactttctgatgtccctcaagggcatatttttaaaactgcaagttcgccagccagctgcccagccatggaaagaaatcaaagacaactgagcatccaggggcgctcaggggcacatggcaaacacacatctcttggatcttgagccctcctcccaacttgatctggcaagcatttattatgcacccactgcatgcactgtaccaaatgagtagtctacttcagctgctaggctactgctcacagtgtattcccagcatcgggaacggaggaggaatgaacgtgggggaggacgggaaagtacaaaggggagggaaggggaggctcattttttgcacccaaggggtagacactgtgtgccaagtgttggtgtagacaagaggcacaagcagagggacaaacaaccctgcctcagcctagcttgtagaggctgcaatggagaccaagtgaatgtgagggaggccccgccccccaggccgggactgggttggggagggtggagagaacaggggccctactagggaagggcaggggaggccttgctgatccagtgagcagagtacagcaggtgcaaaggccctggggtaatcaaaaaataaggatgggatgaggggagacagacctgagctggcccagggatttcaccctctagagctgtgggaagccactcccttctcgtgacagagtttctggccaagtgaccggacttaattcactcttctgaaagtatctctgggtgctgtgtcagggatgagctggaggtgggagactgctgcgtctgtccatgtgctttgtgtgacactggagcactggcttggcgatctttctattaagtcaccttcttgcgagggcctcatagggggcacgtaggaggaggtgggtggattccagggctccaagacttgatcagcaaacggccacgttccccatggccttgtgtctggtgctactgacatccaaagacgtccgcatctctgtctcctcacagccatgcccacggtgtgattccagccctgcctgggatcttcagcgtgtgccctctggactctggcgcctctgcaagatcgatccacgttactgcttgtcgctcgcacacaccagaggctatgcgggctattctgtgggggctaaacacatcataaggctctcagccatccatgttaatgggcgtctgggtcatttccagtcgggagctgttatgaatggtgccttggtgatacattcctctccgtcttgaacacattcatgaattatcgggagagctgggtgaaccacagagccggctctgggggcctggcagggccagagtcgttattccttgagaagtcttggtggtttcccagagcatgtgcaaggaggccttgtgttggtggacagatttctctgaattgtgtgtgccaccggggactgcggcagcacaaggtgtatgtgtaaggatctgacatgccctgcgatttcccaggtgccaactggaaccctgctggcagtgcccccgatatttaggtttgccctgtgtccttgccaacacttgctactgtccttttttgccttgcctctcgccttgtaactctagactagcctggctacttgaaatgtcacccaggctggcctcaaattcacagcaatccttctgcatcgcctcctggctgtgagatttcaggtgcgcatgcaccaccacccgtagtgtaacggtggcatggttggttggtggttgtgccatcttgcatcttgatgtgggtgtcttgcctgctgtttcctctcatttgtccttctattcatttgcctttctttaaatctttaagagtttttttgacgttggacatagctctttatcaaatcaggtgtgtgtcccttctatctggcatggtctttgtgctctgatgtcacctcataggtttggttttattattatcattattcattcatttatttaatgtcttctgtgtatgtgacagtcagagggcaacttttgggagtcagctatctctttccccatgtgggcgcaggggatcaaacttagatcatcaggtttggcagcaagcccctttacccgttgagccatcttgatggccctgtttttaacttgactgttatttcccagggtgtgggtgagtgctcttggattttattatttggttgattttgggggtttttttgtttgtttgtttgtctttatttttttgaggcatgatcttactctgtagctcaggctgacagctagtaagacagctcctgatcctcctgcctccagctctctggagcagtctgattatgggcattcgccgccatatctgggcatactcaacagtgtgagcacacaacagcttccaagctgttgctgcaagtgtggatgtgatgatgtcactccagtaggcacgatgatgtcactctggcaggcgtgatgacgtcactctgacagctatgatatcactctggcattgacagtgatagaacaaatgctttgctgtttttaattttgagcgtggttagccatcaagccatatctttgtccctctgtgtgatcaaaggtccttggagtcctctgtcacttttaagggagcaaaaggtcctgagacaagaaagctttgggggaagtatgttctgtggctagcagggaatggctgtggtactcagagactaggaagtgagacctgagtctttaagggctggcattttgggaacaacaccctggtggccatgagggaaatatgttcttgaaggacagcagtgatgttttcctggggtcaattgaaccaggccaccctctcacatctcagggcctcacggtgcctccacacctcccaaggctggcacgggcacccccaggctcagccaccgtggactgagaaaccccaaggtattttgtgtagtggaacaatttaaaataattagaaactttgcagaatgtctttaaacacactggcgtgggtctccggagcagctcttattagcagggacggctgctgactggcgaggagcggcagccatagaaggcccttgattaagtaatttgaatatcttttggagaacaaatcctgaatctctttctattttctcccattgtcccggctgcacatctgctggctggggtgggggatggtcatgagccccatcccaaccacttcccagcctgggatggggcagggctccctatgggtggctgacaagcctcactgggacctcacgctgtcctgagagtggagttggtggctacgctcggccctgctgctattctgctccgttatctgcctgtcattgaagtgtcagggtctgggcaaagcatgtgggaggcaatagcaatgtagtttccctgcaggcccctgggagcagttggggacagtcccagggagcaggagaagacagcctgggtccctttcaacagcaccacgttgtctgagtaaacctctctgtgccatataaatatatatatagataataacaggggccccttcctgggttcctatagagctgggctgtgcacacagcaggcacaccactctgcacttaattaacagacggtaacatgcaagcggcgggggccgtagcaaatccccagcgagtctgtttgcaagctggcgggctgggtgcagaagcagccgtgtttacaaactgcattagtgttaggtttgtcctgagctagttcgaaagattaagattgggagatgttgacataagaaataagggtttgggtctttggatcagaaagtagctgcctgctctgggcctgtgtgatatcactggatgtcgctgtgtgacaggggctggagcagaactccgacagcggaaggacatgtccctgctggcccctagcttcatgcatggcatcacctgctgggatgttgctctctctgagcccaggaggtctagcagggtcaggcgagccctttccagatgtcttcaatgactgtccgctataggtgctgcttaaagcgcatttgcgttggcagagcgcttagccggcatgctttggctctgtcctagctctttgaggtgggagaggggtctggggagctcaagggcatccttggctacttacttagcaagttcaaggcctgcctgggggctgtgtgagtccctgcctcaaaaatgtacgtcaggacgcatgtggcatctgagtgtccccaagtgagaagtattctctggcgagaacatttagttttatatgatcctggctaactgatggtggaagctgctgtcttggctttatctacttgcaatcactcacccagcggccactagaagccaactctatcccctttcctgcctccaaagacccacacagtgttgttcgcatgtaccccctggacccccaagacccgtgcagccactggtcccaaccatcttcccttcacacgagtcctttcttatttagtttggagctgttacaaacagggctggagggatggctcagtggttaagagcactggctgctcttccagaggtcctgagttcaattcctgacacctgcctggtggctcacaaccatctgtaatgggatctgatgccctcttctggcatgcgggcgtacatgcagatagatcactcatacataaaagatacatagtaaaacaccttttataaaaggaagaagaggaaggaagggagaggggggcaggggaaaggctgggctggagagatggcttgttctgtacaatcctatctgcataagcccagagaaccaagtaaaaagaggcatagcactgcgccaagtgctgggagacaggaggtggggacgggctggtgctctgtgacagcctagccagccgctgagctctgggttcagggggagactctgcctcaaaagcaaaagacaaagcaaaacaaaaaatcccaaggcgtcctgattcctgagaaagaacctccaagggtgacctctgtcctgtgcatgcttgtgcatgtacacacacaccccgccgccaccgccgctgccacccctaccgccgccacccctaccgccgccaccaccaccccacagctaagcctgcctttaaaatctctgcctcccctgcctgtttccttgctcaaaactggcttaaccgatttgggttatttttagaaagatgcctggcatgtcggctgacagaacttacatccgaagtttccacctggtaggaaaagacagtttctatacctggggctgactctgtgtgtgtgtgtgtgtgtgtgtgtgtgtgtgtgtgtgtgtgtgtgtgtgtgtgtgtgtgctcgagcgcactcgcatgtgcaaaacactgttgaagactaggagctacctagacatgatcaggctggtccccgaacacctccagaagacccaaaagttgaagggcaggggcggaattctttcttagaactgcctccaacgccacagggtgctctcagcacccagagcccgggcaggagagaagggccacccaaatcccattctgactgacaccctgtgaccctgagcctggaagcacctcctctgagttcccactgtcaccctcggtaatacaggaatgtgacagacagagacctaggagtgctgctgtaatgttaattactgtcatggtggcccagcgtgggacgagacgaggcaggttctagaaagaaatcttatacacacttcataaacctgagctgatctctgagcagtgctgacccccaccttctgacttcctgcgagctgttttgaggtgtaacttaggctaaactgaccttactatgtgcaggcagcctgacatatgcgtctgggtgtgtatggagttacaaggcctctgtgctatatgctttagaaatacccatcacacaaaaggtcctttgtattgatttatgatccctcctgatctagcccagcccagccccgctgcaggctccttccggcctcaagggatttgccatctgtagaaatggggacggggctccagccctgagcaccatgatcccaagatgtatcttgtcacatacatggctgccttgtcctctgtgtttcagagtagcatgtcagcatgtggagtgaccacgctatccatcatttatgtgtctgtctgtctctctgtgagtttggtgcacacaggctagaagagtgtgttggatccgttggagctggagttacaggctgctgtgagtggccgtgtaggtgctacggaaggaattctggtcctttgcaagagaatccagcgatcttaaccaccaagctgtctctccaacctgggctcaggtttccgagacccccaccttggcagaggggcattctgctccctgaagctcactgaaggaaagctgcgggatgagagtcaggagcgaagagacagtcagggcagagaggagctgtgcttctgagccccatgcgtggggtccctgttggtttttaagccctagcaattatggagagtgcttgaaacgcggcagctttcctcctgttgtctggtcagatcctcaggtcaggataaaaggtgcctggcttcacagatgagcaaaactcacaggcccaaagcatctggacgggccaccacacctgctcaggcctgtttacagtcccaccggctccatccacttcatcaggaagtcccctgcctctttccatccctctcctgtttcaacgccagagtaagaaagtgtcaagattactctttggctttctatatctgtgtgagggctttgtagtgctcagatcttttcttccatattcttcatgcgtacacccgtgtgtgaccatgtgtggaggcagaggaatggcttcctgtgtcttcactctcatgctctccagacactagagttcacacttcagccccacaccacgacctctgcctgacctcacctcccctgggggcatgccactgtgcctgactttcctgggggcaatcacacctatgctttccaagtaggggctgctgtttgctttatgaggatggaataggaagttctgctttacagatgaggggcgggtcagacctaggagatgccagaactggtggggatcaatagaggcttcaggcagcaagggttgcgaatgcaaacgtcctggtgtgggaaagggggctggcatcatgggagaaggtgtgcctggagagtcagggagaggtgtctcctccaaaagatcagggccatgagcagtgactggaccccagtgagccccagagagcaacctgactcagtctgagacagcggccagtaggtgaactttaagccaaggagaggtgagagcgctcatggaggtctgcgcatcgagttccattgaccacaccagggtgggtgccaagagaggaggcagcagcccggaaatagccttcgctgggggttagcagcttggacaaaggcgggcaagtggtggtgctttctggatggttaggagtagttaagagggagtctagggtcctctcctgttcctagcaccctcacacagagctgaggagcagagattcagagcagtgacttgcctgagtcaattgaaagtgaagtatgtaggattcgaacccaggtctgccattctgtggtcccgccctgttctccagaacaacctctgggaccgaacctgacacccagcctctatctctccagtaacagtaagatctactcagcattctccccattccacagaccaggacactggggctcaggcagctagaaggggagctggagacaggagtcaactccatccacactcccaagtactctgtgtgagacgctggatagtgagcctgccctctaaccctggactagccaggctgggctagcctctgacccagctctcaaagatgttcttagtccagacagttctgttcagactctgcctctgggtctgagtctcccatgattatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacccacagcctcgggcagagggaactgcctgtgtaaatgtcctggggtagaaaaggtcagctcactaccactaaactttagtgctggccttcgtcttgctgtgtgggttgggggtatccttgtgaatatatttccttttctgtgtgtatgtatgtatctatctatcatgttttgtcagagtctccatgtacgtgtgtgtctctgcatgtgtcccttgcttctgtcttcctctttatcttcaaaatggttggggctgggaaaccagttaagattcaacggaaacgcttgtatctctcctttcaccagcgaggcttgcgaggtgtttgttaggggtgcctctgctggcttaggaagttacatctgtggcagtcctgccccctcaccccccatcctcaccaagcctctgggaacactgtggaccaagcacttggcaaagccaccattgaattagggagactaggctgtatgggtcccagctacaaccactgctgcgtttagctgtgtgacattggccaaaggtctgtatgtcccctgtctggtccctacccagccacaaggcaggtgcacagggggtacctctgttctcccagcccccctggctgtctcttacccgaagcccatagaacaagtgccccttcccagccagtgtctctgcagccagctacctttgtttttacactgactctctgacccagtcccctgagttgctcccagacgttcccagcagcctgggcttccagccatcacctcaggcccccgctccagagccacctaactgtcaggaagccaccatcctctgtgcagtgctcttaagatatcctgagtgaccatcttagtcctttaccccatggaagctcttgggtcccacctgacttaggaaaatgcctgatcaactttcttctcagctggcatctggttgcttctgtggctctgtaatcttgagaccttccctggagccccccattgctcccccaagctttcttcctgccctgggcctcagagcagaagctgatccaagtgtggccagaaggaaacaagtcacaagtgcattagcgtcccagatggtgtagtgacaagtagaggggcagacgggtccagagccctgtttggcctgctcctcactgtgaatttggggcagttgcatgatcttgggggattgcaagaacacatattagaaacgcagacctctaggtagccgaggtggtattcagttcccatgaggatgcagggccaccacctggagccctagcgagtgccccagggcatagtaggtgcttggtgaataatgagtaaatgaaaggatgaatggataggcgggtaactgaatgagtgtgcgaacaaaggaagtggtgaatgagaagttggggagtgggcggggcagtgaaggaatgcatgagtgaaggaatgcatgagtgaaggaatgaataagtgaaggaatgaatgattgtctgctgctgtgtcccttcccatctcttcctttgacaaaggaaaggaaaaggttgcccagcctgcctcaccctcatgccagccctgagccaagtgagaggcatccccagctccttcattgataccctcagggttccccgtggggggcggggcacttccgccaggctgcttgggaacagctagtagtaatcaaggcaggggaacgccatcggatgtggcttgtgccaggtgattatgggtttgattggcgccctccctccaggacagccacctccgggtcctgcagtggcaggagctggctgctttcctgcgagatatctggggagtgacggggagccggagggggagcaatggctgcgcgtgggggtgcagccaagtctggcgggtccctcttccatttgtcccttaattcagacattcgttcacactgcaagtagtgagtgcccgctgtgtactggggactcacggtagtgatctgagccagatactcctgtccctggtagatgctggaggattccgggtgtgtagacacaatttataagtagctatccgaatgggtgaggggtgtttggagaaatggcagaggctcaggtgagggagggtagatgaacagacatctgctgttctaaggaggaggtgtggtgggtttttgtaaggactgagactcctgggaaggtgacaggaaaacccatgggccttcgggagaacagcattgctgacagataacccagccactacagagggcctaaggcagagttgcgtttgatgtcctcaggagccaggtaggaccccatgtgtccagagcagtgacccatgggagggtttagattagagcaaggaagataccaactagtgtcatgtgacttcctgtccaccagccaactagcagcaggtgacttcctgtctaccaaccaaccaaccaaccaaccaaccaaccatcagcctggggcctcccgagactgcaagctagtgcctccttggacctccggaagccagaattttgggaactgatgcaggacttaggaggctcctgctgtcttcacttcctgtatgaccaggtgtgccccatgggcagggcttgggccagtccttgacattgtggtaggaactgaaaaaaaataattgttgagtgaatgagtgagtggaggatgggtgagtaggcaattgtgtggacagctagatgggtggaaagacagatggataaacgatgggctggatggacagatggatggtggaaagatggtggttgggtggacagatgaatatatgaatgatggaggatggataggtggacaggtgtctggatggatggatggatggatggataggtggatggactgatggatagatgggcagatgagagatagatgatggatagataatggagagatgttggcgaggtaagtagataggcaggtgacggatggaggagaggcagatggacagaaggataatgggtaagatgatagacgtattatggatgggtgggtagatgattgatggataatgaatagatattggataggtgggtagatggatggctaggtgggtggaggatagatggtgaccagattatagatggcggaagcagggacagatgggttgatggatagatgaacagacagttaagagaagggctccccttgtcagtgcccgatgcttatcccccaaagcagcctaggaaaaagaaccaatgggcacatagccgtatctccttgcaggtcccatgtgtcagtgtgccctacagcagttacactaggccagtcgctgtgagggcagtgggaggccctcagtttatacccagactctggggtttggcctcattctgaactgtcccggagcactgctggaatgtagtaagttcagcctggctgagaccccttctctcaggctccaccccttgccccagcccagataattggcccaatacatcttggtgctggaaatttacatagagcacaggaagtgatggatgactctagtaaacccgtctgtctccgcctggcgcagctatccatctcagtgggctgcgaggcccatctgtctttctgtctccttgatggtggcaggccagcgggtgccctccatcctgggtcatccgaggccccctctgcaaggcaacatgcagctggctggctggggcagcctgcagaacttgttccttctctggtgtgcctgggcctaccttcccctggatccatgggcctgtcacactcgctgctgttgtgaggcgcagctcatggctgctccactacaagcctgcagcagatgtctgaagacctcttctgcaccaggcatttactggggtgcaggcccagtcagttagctgacgcacactgccgagctccccagcctttcgtcagaacagtgatgctagctgcttttatcttccagctccattggttttgtgtcagatggtataagacagggttgctttgattgactagacaagctggccatgaactcccaggcatcacctgtctgccccatgttggcggagaggtgttaaagaagtgcatacctttaatatctcactctctacaggtcactggagatttgaactcagttcttccctcatttgtggtgtgtgtgtgtgtgtgtgtgtgtgtgtgtgtgtgtgtgatatgtatatgtaaatatgagtacatgtgtgtatgatatatggcatgtatacatatgtgtatatggtatgtgtatgtgtgtgatgtgtatgtgtgtgatatgtatgtgtgatgtgtgtgtgtggtatatgtatatgatatgtgtatatgtgtgtgatgtgtgtgtgttgtatgagtgtgagtgcgcgcctgtgtatagttatgtgcatgtatgtgaaaggtatgtgtgtcagtgtgtttgtgcacgcataggtgcatacatgtgtgtggtatgtgtgtatgtggtattatgagagtgtgagtatatgtgtgtctatgtgtgagtgtgtttgtgcatgcacatgtgtgtatgtgtatttgtgtatgtatgtgtgtgtatgttaccaagcactctacccaccaagccatcttcccagtatcaggtagtggagagggatgtcactatccaaagaccagggacagacaagctgtgacacatgaggccagacacggcggcaaactcctattataatctcactacttgggagagagactgaggcagaagaatccaaagtttgagaccagcctagaatacataatggtttcctgtctcaataaaatgtcaaatcagaggcaaccccgggtgttcatctgtggggtcacacacctgtaatcccagctgtgagcaagatggcagcaaggaggttaagagttctaagccggcctgggctacaaagtcagtgtagtgggaggccagtttggtgtgtgtgtgtgtgtgtgtgtgtgtgtgtgtgtgtgtgtgtgtgtgtgtgtgtgtgtgtgtgtacatatgataatttaagtggagtagcattgtggttgaacatgggacatgtttctaacctccagcccatgaagttggtgggggctcctatgttctgaggcccaggaagtcccagggctgaagagccggactaccccagagctgaggcacaaaccaatcccagagagcagggaccagtggcagagcccctgccggtccaacgcccccccccccccagcttctcctctccctgctcgctggctccaacctcagctgcatctatcatctgctcgcagcagctcattaaaattatctctttttagttgcaaatgggtcgtttatgaggaatcattacttgaatggtctgcacagggctccgggctgtctgtctgctgttgatggctagttaggttaattgcatgtgtctcctccctgcctgggtctggcccaaagtctgggactgtttagatcatggctggagtcggacatgacgtcttgcaggagtgtggccggcgaggcccgctagctggatgcagggtgtctctgaagccggacttgagaaaacgtggctggcttatgtttcggagacgtcttctgttctcttgaaataaatatagttctgtgggcttttctgagtgtgtttagtttaaaagagcccagttgtccattccatctcagagtttgttgattttcaaatgccctttctttgagagtacaaggggatcagtttaatgtctctgcttggcaccctgtccctctgtgtgtgtgtgtgtgtgtgtgtgtgtgtgtgtgtgtgtgtgtatgatatttttactgacctgtgaaaacctagagcatttggatataacagggtgtcctctacacccggtgtgtctaaggaagagatgaatatcagccagtgtttattgaactcctggcagggtacattatgatcttgaattatttaaaacagtctcccctaaacatcctcagcggaaggagaatgggagcggaggagaatgggagcctgaaaagccaggcatagaaaatttgcctccagagcccaccaaggagctgcccccgcctcagtgattagggctgcctgtaattcacctcctagcccctggctgagtcctctcacagacacacaagccctccataaatggtagttaccataattgtatttattattgtcacggccgttgtcgcctgcatatttaccgtagaaacgcagcaagcatcccgcatgcaccgaggcagagttgaggagggcatggtcctcttgtctgcgacagagatagcgtctgctccatcaggactgtgggcaggagagctgggcttgcagtggtccagaactgagagctagtcatgtcccctgcctcaccaccttggcccttggacttggtgcggtcagcaggccccgtcagtcagatctgtacccatcagcaatcagcgatgtacagatagagggacagccctggggttataccacactgacagctagatatgctctgcatggctatttcctgtatgggtgggagggggcgggcattcttctatgtatacaggttcatatgtatgtgaccttacatatgttttcagttactctccacttcatttactgatacatagtctcccgttgatccccccaggcttacacacttgaatagtctgcctagccagcttgctctagggaatcccccatctctcctccaatgtagtggggttatcagtaggccaccacacccacctagctttcaggtgagtgctaagggtctgaactctagtcatctggcttgtgctgcaatccctttgctcccgcctccgcctccggtggaagaaataagtaaaatccagactgcagacactggttccgagcaagtatggctgtgtgaagaggtacagggtccccgagaggggagcttacacctgcaggtgtctccatgctccgtgatcccaggaggctagggcaggaaccttgggagtttcaggcgagcctaggctccaacatttaaaaataagtgctcataaaactcacagtgtcagatacacagttaatcccgtggtgcatcccatgtcccattttttttttgtcctgggatgagaaaaacacacctttaaaaactaagtaaaacttcagtggacctcagtgttccagttctttctcccctacgatgtgagagccttattgtcctggccttacaagttcttgggaggtgtgtgtgtgtgtgtgtgtgtgtgtgtgtgtgtatacccatgaatgcataaattgtggcaaatgtcttttctcttcctttccctctctatcccatccctcacccatctcaaaatccctcctagtcctcaggctgacagcgcggaggtgaccctgcccaatgctgatgcttcagcaccttggagagagccacccaggttttaagcagtgtcttttggtgcctctgtcccctctgctcacctcccccacccccatcccactcaccttcagtcttgggactttcaccaaaagttagctgtttttctagaaacagacattccttcttagattgcccccccaaaagggttccaggggccagagccatcctcacaggtttggggggatcaggcctatgacactggtaaatagccttggagcaggaagttcagatactagccgtcttttacagggagaaggctttgcagtgggttaacggtcctttcatttcattatctaatggtgaaagggtttcattgtgtgtgcaagacgaatgtgtatcagcggtgacaaatggggtctttcattacgcgccgcacttcgtcatacatatgttggattaaagagctcaccctggaaatgcgctccccgcatctgcgcgcgcgggtgtttttttttttttttttaataaatctgattgcaggaatttattgcaccaccggatttaggaaattatgggtcttgattgctgcaaatataatcgggtgatagatgcaggagggttcgtggagttattgtccttgggggtggggagccctgttcaagtccgtgccagcagtgcaggccacacaaacagagcgttccttggattatgcaaatgagtcacgacaactcctgctgaattgtactcctgcgaaagcctccatgacagcggaggaagcttcaagaggggcgatcaagcacataggtcccagcagcaggccccactatgatgcactcgcacacgcgcgcgcacacacacacccctctccctctccatcattggtcttgtgtggccaaaccctggtctgattcctgagtgcgcacacagtcaggccagctcccctacaccccactcccccccagtctgttccttttcagtcggtgagggttctgggaaccctcggtgatttaccgtggggtacacccgagatcaccgtacttctcttcggcaccttcatttttccaaaatttgctggaattaaaaagccatctatatcttaagaggcgaatttatgagcctttaagggagaaagcggcagttggagctgcgcccgccgctgatgtatggaagctgtcggcagcacccgcgagcggggaaagtgcccatacaatatgccacgcgctgctattttgacacgctttggagatgttttcttcagttactgacaggcttatgccatcgctccttggaaatttaagaggtggggctggggggggggtgcggggcggggagtgatgaagaggcatgtcggtaaaccgtccagttcaactttgtctggcccagtgcctaagggcaaaaatgaaaaaagcccacaggatcctggggaccttttgtgtttcatccttttgttttgttttgttttgggtttttttgtttcttcatttttcatgcatgccaggagtcaatatctcgccatttctcagccttgtaagttacagaaacttgttcagagcactgttgtacaaaaattcaacagcaacaagaagacaaatcaatcaatcgctctctctctctctttgtctctctttgtctctctctgtctctctgtctctttcactctctgtctctgtctgtctctgtctctctctctctgtctctctctggctctggggctctctctctctctctctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgccatcccattcaaactagtattgtgaaaactgtagtacataagtgactaacaagaaaagaagctaattagccaccaagataaatcacagccccagcctgtcggctctggcagtgttgtggggagggaggtggtccccatttctgactggagtcgggcctcccctccaccccacccccgaaagtgcctccacccagattccatgcctgcagtctcaaaagtcctcatctctcaggtgaagtggtttgcagttgttggcgaggcaatttggcttgaagtcaggctcactcatcttccctgcctgccactgggcctgggagacacagcgagggctctggaacctgctccttcctgccaatcaatgcccctgtccctcccattcccccacatcaaggttccagaccccccccccccagtctgggcagcccacttcctccctctcccttgagggagaagatcagcccagacatgtgtctgttctttcttgaaatcggatgtgagaattttatcccctcaacccctctgccatcagggcccctattgcttctcaaattaaatacatatatataatttaaaaatcaatgagagtaaatggaaagtggaggccttggaccttgtgtcactttgacagggctgagacaccctcggtgtgggcaacagatccagtgcccagccttaagctctatctggcagccgtctttctgataatgactatctcagcttacctgttagctgttagcgtgtgctagaccatggaaggaggaatactgagggtgggttcctcctcttggcagtggagggtcgggccctgaggtgtaagaggcagggcaggcaggcacagaggggctgagcctcacacccgagactgtagaatcccatcatggcgctataagcaactgtggttcttcagggcacgttggtgatgagggcccagctaggactctgggggtaagtctagagagagctgcaggagaagatatgcaggaaagaggcagaagcctcagacttgagtgtctcccaccgccgtcactgctccaacgggcacaagtaggtctttctgagatagggagtcacatgtagcccaagctggctttcagttcctcatctctcaagtgctggattatagacatgcactatgtgtttatgtgacaaccagggtgggacccagggcctcgtgcaagctaggccagcactctgcaaactgtgccacatttcccagacctctcttctcttttaaggagaccagagcatgttctataaacagttttctctccacactgcggagaagtctcggggaagcgtaactgagtccactgtagacttttaatggccccacacacttatctctctctggttttctctgaccatctgtcccgtccccttcccccagcatagtgagctgaacctcaaccattggtccgcacgggagctctcaggtgaggaaatccaggccaggttttcagtcctgggagtctgccttacataatttccaatgctacctaaaattatgcaattacataattagaagggataaatttccactcctgttatagtcacggctctggaaactctcatgtttggagcccatccctcctgatggaagagtcgtgacagctttatttaagagcatcgtctagggggctccagtccacctactacacgcatcccacctggttcctctaggacttatgtggtcacagtcgggggtgggacttggcccagctctcacccacttcttcccctcatggctctaagaagtaacctcacttgactatagggatatgggaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatggaagggtagctgggacagagggaccttgtcctgggggtaggatcagtagggagtgtccccgaggttatggggtttctcttttacctccagcccacttcctcccccttgcctcccacctccctgtctcccctcccatccctttccccctcccatagggttttccttgtgactttgattgatcgtggcaggaggacgtgttcccaatggatccctgaggacccacgggcttcagggttggcaccttggaacactcacctctgccaggtgctgggggaacctcagagactacccctgaggtctgaaaatctcgaggtcgcataggaaaattgggatgtgtgggtgtctagagctgagcccacgagggtgctcagagcattggtaaagggcgtggtaaacagtctcatccccagaaatcactccacgccctggtgaggaaagacaggcaaggacagaggtggtgggggttggcaaaatttaagatgcagattcatgggaaatggctacatggaaggatcagacccatgctgtgcctggaagggatgtccccagggaactttgcccacctagcactgagggtagagaatcagggtcagctctccgtccccatccccctgatctaggccacaagacctaccatgccacacccaaggacaacatgagccccatcttcccagaacttgggagcactcaggagttcgtgaattcaaaccagcctgagctacatagcaagaccctgcgtcaaagggcaggggctggagagatagctcagcagttaagagcactgactgctcttccagaggtcctgagttcaaatccgagcaactacatggtggctcacaaccacctggaatgagctcagatgatagtgtacccacatatataagataaataaatctttaaaaaaaaaaacaaaaaaactaaaggcatagcaccttaaaggctcagtggcggagtgtggccggcttggttccatccctaggaaaacaggtgtgcatctaggaaaggccctaggtgtgtgtggtgtgtgtggtgtgtgtggtgtgtgtgtgtgtgtgtgtgtgtgtgtgtgtgtgtgtgaagggtccagggcgggctcgggacacttgctctgtggtcgaccctctgccttctctttcagggaatcagagcgatggtagctccggtgctgaagagcttccaggctgaggtgagagccaatgacattacacttggggcagtggtggttaatgcgccctgggcttccctccctgcaggctgtggctcacctcccaggccccccccacctcagttgaaatctgaggtctacagattctaccctccctgcctaccgacccaccccaacttcccacccccactgtcccaactagagcaacctttcaaataagtcccaggggcgaccaaccaatcctgcatatctgcctcccaccattctccgggtgaagcagacttcgtggcccttgttacaagccctcatgccagcaactgtctccccaccccgccccctgcctgcccatccatcccatgacagcaaaatgtcctaccctcttctctatggtattgataatgtgccttcacctgcctgagatgctgcaaccatgctgggctggggtggggggaacatctctaatgcccccacaggcaagggcgcccagaagcccctccccccacagccctgaggtggaggggagggctcctttgcattccccactctctccctcagaaccaccacctacataggtacataggtgcagctgcatgcatgggaatgttgttgtgggtgtggcttctctaatgcaatctccattttcctctctgtaccctggagatagacttctggtcttctgtgcagttttggagttatggataaagagagagaatacaggctggggtgggtatgcccatctgacactctcaagagtgtcacaggaatgaatagttggggttactggctgtgtgaccttaggtgagttgcttgacctctgtgtgcctcttgattttctctctgttgtaaggttgaggtggagggagaagccatgtaaatatgaaggaagtattcagaacactgccttgggtgttagaagtcttggatagctagatgtggtcccagcacttgggaagggagaagccatcctaggctgcggggagaaacggtatctccccttttccgtagaagaaagacttaaatgttacaagctctcagtgataagaagacctgaggcacagcctcatggatggcaggcttgggatttcagccctgctccttcagctgtgtgactctgaggaggttcttcgacccctctgaacctcaactctcctcctgtttcgtgcaaagccaagcttacagacccctggtgcagttgacgtccctaaggacagggaaggagaggatgcttgactggagtttaccaagcagggagctggcttcccatacacaacgtgggtggacagttttccgaggtgcctctctggccacgacctacgggacttgactgtgtccccctgccttccttatgattgctggactgagctgcctcggctgcaggttccttctcaccctcgtggggagaaaagcagccgtggaaccaaatgaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacccccaggaaaacaaaagccagccaaggaaggtagcttctggaacccagcttgaaatggccgaagttggaacatccttgcacggagcaagggagccagcccgaaggccctgctaattataaaagttgcttttatgaaagataattcaaagcaataatttagcaaacataatcaagccacacagatggggccgctgatggatggatcgcaacatgcaattagcggctctcacagttacatgtcattaaccctccacgcgcaaaaattattttctcattattagttgaaaaggtaaaattaagctgactagacactaaaggaacaaaccacaattaattaccttcatttattacagtcattatcttagagttatttttgcttggagacagagagatgcaaacatctaaattaaaagttttgttttggctaaatctgaggtgaggcacctccaagcagtgtgtgcactggcctgcccctcaggaccacactactgggcctcctggcccccagattcctcttcacagagtggcctgtgggatggtggaagcccttctgactggcctggagcagggacagtcccctgagcctaagaggaacacagcagtttggggaccacagtgatggagcctatgtggcattggtgagtgactttgtctctctgagccacaccgttgctttctgtgtatagggacaatgccctgggactccaagagccagtgagttgctgaggtagcaggcatgtcactagttcacagtgtggcaccgtgcaccacagcctacacaccaacaatgtcctccctcccaggaactgagggagctcatgcgacccatgcctcagagtcctggagagaaagccagtggaagatttaggaggctggctaagtccacacagtcatttaacacttagctgggctgggacggtggctaagcatcttgggagtacaaggatctgggtttacccctagagcacacatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttctctgtgtagccctggatgtcctggaactcactctgtagaccaggctggcctccaactcagtaaatccgcctgcctctgcctcccaagtcaccacccggctgtgactcactcttgtaaccccagtggtgaggaggaaggagaggagatagatagagagttctggggtcactggccagccagcctagcctgcttggcaaattctaggccaatgagagaccctgtctctcctcaggagcagctgaggagtgaagttcaaagtttctccctggctctatgtgcacacatacaacagacacacacacagacacacacacacacacacacacacacacacacacacactttcacaaacacatatagtagatactcgtagagtgtcaaaagcggttggctgtcagccttgggacatcacccaccggtaatctctgcccctcttggcatggagacagcaggcagttttacagtatatactcagagacttcccagggaagacagactactctcctgtgtagccctctgcaaacatccttggatgggactctctttgcatcaggcgcctgtaaagctagaccaagctgagaactggtgggatacggtccctagccctggggaagtcctgagcacccagttcttcttccatggagaagttgtctcgagggtgacctggtgtattctccctgaacccgtgttgccagactcaatggtcttgtcccgtgacagtcatggctgcccatactgaccttatctgtccacatgggtccttgagtccccccagggagccatgactctatgtctctctctgtctttcaaacctgggcctgctgtcacaagagcccgaaatggcagtgatctggaggacagtgatctggtggcctttagcttgcctggtagtttcactttctgacctgtcctgctggccagcacactccctgccaggagaaactggtcacagagaaacaaggccagaagcaagcctcctaagagacaccagcatgctgcagaactgtgagcgattgtgctaaggggtggcttaggagtgtggttactccaaagataaaaggagacccccacatttgcagcaagcctcccctcccctctcctcccttctctctgctcaaccccactcagcccctttggcaaagttgattcttgtcactgtagccaagtctgtaggtctttctctgcatgggaccacaggtttctcctcctcctggctccagagaatggtggcaagtggctgtggtaggcacagaggttccactgccctcagagatgcaggcaaggggcataagctgttgggaactcagggactttccctttgagtgtcttctcaagggtttgagggcagctctgagacgtgagtgagctaaggctaagggagtcgggaacaggtctgatagccatcctgggacaaagggcagattgttgaagggagtacctgggtcttgctatggccattgtagcactgagcctcacatatgatgaaacagatatgcccagccctggctgagtcactctcttcacgccatctgaaaaacgggtggtgacagctggccatgtacattttggtcatcccccggttgctgatgtaatgtgtcgtgatgtgttgtcttccgtggcttgctagaacctcctctatagactttgtccaagcagacatatccaacagtctactttggtgcctccacttgcaggtggccagggactgggataccccctcctctgcttgtgtcacacactaccattgtggtggctgctcaggcggccagcgggtcacagaatcagtgtgagcaagccaagaccctcagagtacaccttccagtgggctcagtgttgccactccacacatggccaggcgtggctcagaggtgtgtgggtgctgcccatctcatagatggtacccgtggcaactttgactgttcagtttgttacagttgtcccaattgtggagggtctgtggttagctctaatggggaaattgaggctcagagaagcgaggcggtaattggtgtctatcggggtccaagtctggaactgaggtagggaaagaatagagaatctgagtgttcagggcccggtggctgaccccactcggtattagatggaggatgcctttgagccaaaattcaaggttgcctgacacttgactgtctgaccacgcccccactgccctcagacaggcctgacctggctcctcctaccccagggaaatcctttccttctgttgtctgtgccatcttcttcctccccaggttcccctctgtggttctccctgcccagacttgaccatccccccccaggcccacagacaaggtcaggaaaaatccaacccttgcacatcgggacctcactcccacctaggaggacaggggacggggcaagcctgggctatggagctgattggcatggaatttcatcccaacgtgtctttcctaggctgggtgaccttgcgagtcacttaacttatctgggtctctgtccctccccatcaaaagacttacatttatttgatatgtgtgcatgtgcttgtgtgtgtgtgtgtatgtttatgcacgtgcattacagtacatgtgtgtaaatcaagggacggtttgaaggggtcgtttctctccttctgccttgtgggtcctggagattgaagtcaggcttggtggcaagtgtccgtacccactggcctctgctttaaatgaagctcctagtggttcctgcctggttaggctcatgaggagctcagtgagctgatactgatacaaggagaatcgaggacacgaggctggcacttgtgtctcctacaagtcctacgtgggagatgccactcacccatttctcaggtgagctcactgaggctcagccgtgacctataagacctaactcatcagacttggaccagtaagaccttgtggcttaatactgcaagtgagtcacagcctagactctacccttccgtaggtcttaacattctcagacagggcagagtacttgcccaggcccacacagccctcttcccatgacactgaggctgggaactacagtccctacaaatcctccatttggaaagcatgcctcagcgtacaggggaaccaaggtgctgagaaggccaagctggggagcccgttgcgtgtacagaagtgagactttaacttgaggcctggttatgtgataactaagtagtactcaattgctgtagtggctattcctggttgtcaacttgacaatatctggaatgaactccaatccagaattggaaggctcaccagtgatcctaatctggaggctgggagatagaagtttctgacctggatcttgaggcatggaagctatggattccagaagattaaggcagggagatctctgagttcaaggtcatctgggattaaaggcagggtggcacacacctttaatctgggctacacctttaatctgggccacaccttctgctggagacctgcataaggacattggaagaaggaagatttacactctttcctttgcctgcttgccttgtgggactgagcaactgctagatccttggacttccattcacagctgctgctgaccactgttgggagttggactgcagactgtaagtcatcaacagattcctttactatatagagactctccataagttctgtggctctagagaaccctgactgatacaatcgcgtacttagagtgtctcccgcagtgcaagtcaggtatgagcagcgggcccacgacctccctgctgtcagacccccctcctggtgatgtcactagcctgtccccctagctgtcctgccagctgttggggggggggtgaggctcctgcgagcccacaggtccatctggatctgcaattaacccaccaaagcatcttgggctgcgatgctgaagttacaaccaaattaagaacccacagccttcctctttgatcctgccttatcaagtaaattattaatgctcctgtccccacattaagcagatacttgcagccattccgggtccttctcattagaaataacatcatctaaagaagggtattgattgctttttttttttttttttttttttaatcttggtatcatggacgtgaggcacgtatttacatggcgtttcctttaactcgccttcccgtgctgtatttttatgttattgatcttttttttgacacggaattgctttctggccttgtgtgtatgttgtaagctttccccatccagcaaaggaatgggctgggcccggacacaaagagaagagcgatggctctggccgtgcgcgtggcaggaacagtcccgcgcctttaacagcaattagtctaccctgcagcccggacgctcaagtatgaaaatttacaaggcttttaatagactgagctctggggccaggcaggcctggcgccgggcggacgtggccgccggctgtgtgtctatcgagctgcctccgggtcagagaggggtggggtgtgctgtgggaacgactggaaacacagactgactaccccagcgagggatgtgccgcccagcgcacagtcacacattcggctgctcagtttgatggttactgaaggcctactatgtgccaggcagggggctaagtgctggaaggacgtgcgagagttcaaatttctcaaaagcctggtgccttggacggaggagagcaggcacgaaccctgtgtcataccgatctgagttctttcggtggccttgcttgaggccgtgttcctaaatgagcctcagtttccctggctgtacaatgggataatacatttagcatctgcccctcagggaggtggggaagaatcatcaaaatagtaatggcttgggacctgggttctacctcccttaatgtccctagagaagaatgttctagactcagagccagcctccctgtagattcccaagatggggctccccgacctttccctgttgcccacagtggctctccacaccgttccattttaaggaggtcccttcttgtcccccaaccctatcagacctcattcggccaaacattgatttggcacctgcagtataccagatgagtagccagctatggtgtatatatgtgtaggtgcacgtgtgtgagcctgcaggtgcacacagtgtgaacacgtatgtgggacagccttcccgggatctggggctggccaattaggtgaagccagcctgcaaggaagcgtctgagggctgcctggctccgtccatctccccagtgctgggattctgactgtgtgctgcctgcttttttttttttttatctttttgatgtgggttcctgacattaaactcaggtcctcatgcctacaagggagccacattactgcctgagtcttctcagtccccaaagtcacctctctttcccctgcggcagtgtgaccccatggggcaggggcaggtgccaacaatgtgcactgaggtttctatggcctaggtggggtaggaaaaagactgaacaggtccatgggccctactgtgtgcagaccccactggggaccatggggataccatggggtaccagatgaannnnnnnnnnnnnnnnnnnncagatgaagcctctgcatttctcaaatttcccaatgtctgacaggctaagctccccttgtgacagataacctgagaaaaccagggaaaagattctttgggctcagggcttcattcattcattcatctgcagggcaggtattcccaggcacttgctgtgcaccaggcattattgcaggtgcaggaacaagtaagacttgggattctggttccccccatgacacccaaaaccagcagagacagagacagagacagtcccaactcctggaacagagcagggacccagccctgagactcagacacggagactgccatggtcccgctgtatgtcccagctagacttggttctccgacatctccgacagagaggctgagagttgggggaggagtcaggactcgaacccaggtctgtcgtgttggtcagaacaatggcccctgcaacagcagttttgtgtgcatgtgatctcagtgacatcttattctaggcagttgtgggagggggtgctgtgttcagctgtgtgccgcagagccccctggggaccagcgtcacctgtcaccctggtgtcacctactctcagctgcttcgtggatgagagagactgaagcaactgtatcatgtctgtccctgagggaggaaagccactggggccaggagagccaggggcatccgtcagcccaatctgctgtgtggtccctgggggacagagcgcctccctactgctgctggggggaagcctggtgcccaagaatctgtctcgagtagtcacaagaggaacctgccaggctgggaagtggcaattcagtaggggacacctgggcatggttggttctgctctgtgcagggccatgaggaaagggaggctaagcccccattggcggtcctcagggttcacccagacaaatacaaacaaacactagagtcctgccatccttaccgcaccaagaagaggctggttagtgtttaggcgggcagtcagggaaggcttcatggaggaggtgaggttctaacaaggggtttgtggaggtgggatttgatgggataagcatcgaccaccgtggccttggcctcagcaatctaggttttgagcccaaattcggttactggtcaggtgacctcagctgggtcacttctgaaacagagcctgttctgggcagttaccattactccaccaagagagacggagtgagccatgaggattgggccatgggaggtgtgcctcagtttacccaagtctgcctgtacagatggatccatgtggccccgtatctggtgctgtgagctcagagaggtctcaggactgcaggccacacagcctgtccctggctcagaagagcctgtagcatggtggcacacatactgtctcagtactcaggatgctggggaagggaccatcactagtttggccagcttgggctacacagtaagaccctgggtcattgtgagtcaagggaaggaaagactctcctctccgcccctctccagcgtcccaaggtgttcactctctttgaatttcgtgattcttctctttcatgattacaaaagcctatgttccatccgcaatacccatgctgggtgcaatgacattggcgtcaccgcagtccttgggagacagaggcagaaagtcagttccgggtcatccttggctacataataagttcaatgctagcctggactgtctcaataatatttgttttaaaagccttccccagcgacccaggacagagagggatggtggtacaggcttctgagtctttatcattcagttccttgtcccacaaaatgcttctccttccccctcagctgtataagtaaatgtccatgtgtcctgcaaggatccacctatgtgccttggtgtgagattttctgtctgtctgtcttgaatgacatgtgactcatccttcacctgctgttcctaagaacctcaggatcagcccctctgcctctctccagggctggttagtgtacagtaccacacacacacacacacacacacacacacacacacacacacaccatcacaaccctctgacagctttcagcaactcttagaatggaatccagacacctaaatgtctgtttgagattttgtaccacccacaccacctgccctctttgtgcctgccctcccctaccttttttcaaatacttcttgatcgctcaccccctgcctcaggacctttgcacgctctcttctcgcataacccctgttgcttgggcattttgcccaccacagacaaagctcacaacctgggcactgtaaggatctggatcaggtgactcttggtcacaggctggcctcggcctgagtgttcagcagcctgcctagagtgttcccatagcatcaccagtcacccatagcatctccctcagtgacagccagaagcaggtgaggcaccagcaggcatccctgacatctgtggctcctccagagttctggtcacatgtcactcttacagggaactgctaagattaccgatctctttggtgggccctttcacacagctacacacacacacacacacacacacacacacacacacacacacacacctctctagactcctctgcttcccggtagtccccactcagcaggagctggagaggcactgatgaagcaagtattgattgatgtgtgatacaattgacaggcacggttcttggtgtttctgtcccaggcagcactctggttactctgcggttcccaattcattattccccatgacctgcatatgagctggggactgtctttgtcagcatcttacaatgcaagcaagagatgagcacagggggctagtgacctgcccaaagccacaccgctgcttcgaattggcagccatggccttgaaccatgatttattgagcatttactatgtgccaggtcttgagggatacaatatcgaacaggagagccctaggttttacacacacacacacacacacatacacacacacacacacacacacacacacacacatgtgcacgcacatatggaaaaatatgtgctcctttttcaggcactaagattcccccagacgttaaacagggtcacgcagccagctggtggctcagacccttctccttcttctgggccttgtatgtttcccacttcataccctgtccacagagcagggacagtctagcaatctagccagtcaattataataatatttttctctccagatgtttaaaaggagcgagggggttggcatgctaaggtataatcatggctcagagcccgagctgacgttagttattaattaggccattatgcattccacggtgataattgctttgcggtggagtcaccaagcatgaaacggacccggcaaaggaacgcaatctatcagttcttggatccccagtgcagcacagtcgctcaccttgagctggtgcctcagcgggaaacaaaaagaaattaatggtgccagtgagagacacgtgcgagccagacccttccctcatcccagccctggaagtggtccccgcctggccccagggacagcactgaagccaagtgaaaatgtccatttgtcttggggacatctttccctgtcttctcttcccagccttgtcatgtgtggggaaacactattgctgtctcctccatctctgctcttggcagtaatgggctggatgagtcacggacacagcctctccgcctgggctctgcctccacccaggttccaaccctggcctcagtgattgggagatgcaccaccccgtatctgctcgaaagcctaggggtgggggggaggtatcagtagcagacacagccggagtccagtctcagcacaggaaacagagatcagggtgagcaccgtcacgtttacggagtacccagcatttgctagatgcacccattgctgtttggtttcttggtggttggtccttggtggctgcccattttacagacgaaggtgggctggggtgatcccaacactgggcccacagctgctggtgtagctgggcttccaacccggaaccaaaccaggcatctgcccacctgggacaagacaaggtcatcctctgcccgtttccaggacaacttcctccgcttccaggtgtttctggatgcaccaggtttgcctcaactgagtcgcatcagtcatacaggtctgaggtccccaccccctcccaccccccaggtaacgaatgcctctggctcagcatgaagcctgcccggcccatcagcccccatccaaccagctgcagaacagaagtcaaactcagcacaaacatggcaacttaccacagggagggaggaagcccgcagagccaggcctggcccttagcctcctatcgattgtgtctgcctggcttagaagttcctgagtatccttgatgaactccatccttcccacaccgctccccgctcctccttccagccttgctgtgggtgttaactccctgcaggaaaccaagaggacactgtcggcagagagtgacaggcacagtctgtctccggggccggattgctgtgacagggagtggatgtcatccagcccccacagaaacacttggacacagtgaggtggttggagggccgccttagtgacctgtcaagaatgagggccagcacatgagaggctaaaccagaaggatcaatgggagttcaaggccaggcggaagctggaaggatggctcaactgagctcttgcaaaggaccagggttcagttctcagcttccccatcaggcagctcatggctgcttgtaactccagctccaggggatctgacatgttcttctggcctgtgtaagccggactcacacatatgcacacacatgcacacacaaggcctctttaaaaggcccaaggcgctccataccattgaccccgagttcatttccaaatgagatggcactggagactagacagagcctccccaacatctgccctgtctcccgaattctctaagccaaagtcccatccctgattatccccagacactccctctgttgctctgacatgtccctggcactttggactcggcctggcactgcattgcatagtagttggtctcagtaccgtactcctcgaagcagaaagaagggacttccttgtctaagctgtcccgtcaggcaaccaggtggggacatcctgttcttgggatgttggagaggagactctgtctttcttccatgtgcttccttctctggctggactcagacatcatcacccgtcatttaggcaaatacttatcgggcttctcctacaagccaggtgctgttctgagtgctgagagaaacattcttcccggatgtgcggatcgatggccttgtggcctgctgggttttgaggctcactccctgctggggcaccccaggccggttcctcaccccatcattccaaaccagacatagggctcttcttttgttccttcggtttgatacaaggtttcaggtagcccaggctagcatgagctcctgatcctcctgcctctacttcctatgtcctgaggttgcaggtgtgccccatcacacccaaccaagactgttgacagcccagtgactgtcctaaggcacaacagcatataaacgctatgggactgaagcagctgagaaccttctagatggaggcgggggtggcgggggggggggcagactctgggctgaattccaagctcactgcctgcccttataaataaagctttattaggatccagcctcctgtgcacatggttgccaccactttgcagggtctgggcagagctcagcggtggcaacagagaccgtagtataggccaaagagcttaaagggatttactaaggctagagccaggcacctcctctgtgccccatcccgctaaggttccctcaggacttcctcagcccctcggaagagacttcccaaaggccaccactatatttaaaagcctgggaaggaccggcactttgatgacatttgcgtggccgtcattccttaaagggcacgcatgttcctctagctttgctcttccgggctggcattttggaaaaatgtaccagagtggcctcgagaggaggaagcactacctggagtcccccagtgccagcttcccagggctgggccactgtgcgtgtagccaagagaaggtgaggtcactaagccagcatgggcaggcagacatgatatagagtcctcgaggggacagcccaaggatcagggcaggccgggggtctggcaatcgctcactctgtgctctcaccctcgtctccaggttctggcaacttgcacctctcagatgccggcctctgacttcacccttgtagtcctttggccagaaatttttttttttggtttttttttaattaattttttttattaggtattttcctcatttacatttccaatgctatccaaaaagtccccaatacaccccccccactcccctgcccacccactcccactttttggccctggcgttcccctgtactggggcatataaagtttgcgtgtccaatgggcctctctttccagtgacggccgactaggccatcttttgatacagatgcagctagagtcaagagctctggggtactggttagttcatattgttgttccacctataggggttgcagttccctttagctccttgggtactttctctagctcctccattgggggccctgtgatccatccaatggctgactatgagcatccacttctgtgtttgttaggccccggcattgtctcacaacagacaactatatttgggtcctttcagcaaaatcttgctagtgtatgcaatggtgtcagcgtttggaagctgattatggaatggatccctggatatggcagtctttagatggtccatcctttcgtcacagctccaaactttatctcttttttttgtttgtttgttttgagacagggtttgtttgttttttgtttttcgagacagggtttctctgtgtagccctggctgtcctggaactcactttgtagaccaggctggcctcgaactcagaaatccacctgcctctgcctccccagtgctagggttaaaggcgtgcaccaccaccgcttggcctggccagaaattctcattgctgccgaagtcttggccaatgttacctcacgtttaacagcgacaggcctccggagtggaacgcttgcctaacatgggcagaggaggctctgggttccgttcccagcactgtaagaggagaaacagcaaataaagcatgacttttaactgctagcatcagacacgcccactggggcgtggccctgtgacttgtaacgggaaaactgaggtataggcagatcggagacaagtcgctgattttttcccagccatccaccccctggcaattcacgggggctggccaagctccacagctctacctcgctttgtggagcttcaccaatcgccagccgcacctcacaggggagatggctcagtacggagagactccatggagaccacactgctgtggacaggactttagatcttagtagctcagagccgattctaaagcccacagggcccttcctcaaatccctaggcctttattaggcaccaactgcatgcatgccccgtattttcctgacctttctcctggccccctctcctcagagccagtcacccctccacctcaccaggacttgacttgcatggagttatctgggtgcccagagggatgggtggatagggcctggctctcctgggtcagggatgaggtaggacagagggcttgctgcggctcagggaggcaaccggctagatgtgcaaagtccccagcaaaacaaggctacggttgttcctgggttccagccctttgtcacctagctgcacctttggggtcatggggtatacaggaacagtgacctcaaggagagtgtggggatatggacccgaggtcgtcagggctccagggcaggtgcaccagggtggggtgggagcactttagatcgtggccagtctgagcagatggctccaggtggctgctgtcgatggaaacgtgggtcccgggtggccagatcctccgactccccggagaagctggcagtttggcactcttttggttttaaaatcctggatccctctagatgcacatatttacatattccagtcctttctggggtgtcatttacataccacagtcaaatgtgcaaatccggagtgtctggcttgatgggttctgacagctccaatattttttaaacactggcatatccaagaaaataggctcgcagggtggctccagcccacccttcacggcctttcccggctgtcacgtgccacgtgacccacgactacacacgtgcagcatccacagggcagggcctggccttgggaagatacagacgataactgaaagtcacgatgtgcagcaacagcatgggccccggggccccagttcgagtccccccttctgcaacttgctgtgtatttttttcacggcttactccgcctctctgaatcctgactctcgctgttgttaacatggggaatatgacagtgacctcccaggactttggtctaggttgaggaggttcatgtgacaacgaggccttagcaaaacttcagatgcgtggtaaaaccttgagatgtggtcttccaggctcttttttttttttttctcagagtagtttgaggttgaaagataattggaaccagggcttcaaagtctccacgcatccccacggccccggctgtaagctttgtgtggcctgccgcggccatattgatgagtgtagtgcctgcactacgtagcactgtgtggcactgtggatttggataagtccatgacaccaggaaaacctaccttgatcttctgaaggacagacagtggaagccaactgtcacatctaacacaaaagccaccatcatccacttaggttgctaggaggccacacaaattccagcccctgttccctgccacatagccagttctgcatctgtagtcttgtatgaccttagccctccagtgtggcttgaagccactgtctcagcttctctggatcactcactcaggaaccatctctcacccagggctgctttcgctcctcggtgacagctatcagtgaattcagccttctggggtaatgtcaagtaaggagcactatgggtacagaaacaaagtcacactctgagtggccactttagctgttccagtggcaaggccagcaggccacgtcccagtcagcacagagtcaccttcgccagccaagggcactcagacaggaccacaggtcttctcagcatcctggacaagggctcaccgtccatcctcggccacaccctcacaaaaccagaagccgtcccaccctcctctccagacacagcccagagccagtttctttttttttcttctctttctctctctctttccttccttccttctttcttccttctttccctttttctatcctcaaagcaaaatttatttgtaagatactaaaggaagccctcctgtccctttcatgccagcagccctcagccgagaagcaaaatcgtgtatttcgctgctaaaaaaagccccggcttatacaattttaacaatagaaaaatgatctttgcgctccagtgcgcggaggcttggagggaaagcggcagtgttcaggtggctggtgcattacaaatgagcggttctcctttgttttgagtgacaggcaatttaaatgccgtcttatatggaggccagagttggctgttttgggttttttgttgttgttgttgttgtttttttttcctaccccagaattgggagggggcaaaaatgatggggggggggcaaggagaactgagggactctgatgagaagtttagcttggactgtttaattaggagatcaggagtttctgattggagtaattggtaattacgccatagctaatagcagctgtagcctggcctgctgagcaggggaagggggtggggggcgagggtggaccttgctgagtccccagagcctggtgcaagcaaattaggggccacactgtgtcgcttgaaaaagggttcgtagcaccaacatctgaaaacagggttctctacttttaacctggggctaagaacaaacatggtaataataaaatttccggtggttcctcctgccccagtggacggacgtcccccctcagcctttgcatcaggcctggtgacagtgacacatggcagaaggggcacaggtgcagacaggagtgtgaaccgtcttgcccggggtgattagaatcgatgcactcgagccagggaaggcattgagggcctgggaggacggctcggtggtgagagagtgctaacttctgtacaagcatggagagttgaaactcctagcacgcatgtaaaaatccagacatggaggcaaagactggaggatcccaaatttgcctggctttaaaccccagcaggcaagagccggagagaccgccatgtggcaacaggtctctctttctcctgatttacctgctgcctggctaccaggatcctgtcaggttcctgcacagcaggccatgtagttgccaaactattactgtttctaacgtatggtgaggttctgtgggacatggagctggtcatcgctgactccacgtcacccgtgtggcctccagacggctgctgtcacagctctgtctggtcactttactcctacccttctttgtgaccaggtagagtcatatgggtgttgccatggcagggtctgtccctgctggcctcctcagtcctagaaatctgcaagctagacagatagggcatgaaagaatggccctagctgtgtgctaataaaactttatttacaggagcaaatgaagggccagatttggcctacagcctgtagtctgccaaccctttcttggcactccaagcagggagggagagagagagagaacacgtgccatccatatggagttgtttggatttttctagaagctatattacatttttaaaaataagaagaaactgatagatttaattttaataataactttgattcacattcctcagcaatgtcctgtcaacaagcagtagatataaaatgattattggggactttttcatctcctttctatgctaaaagtcagaaactccctgtttcttaccactcatccaagtgttgaatggccacggtattttttttttgacatgtatgtatttgtatgtaagggagacacacgtgttccacagagtacatggagagatggagagatcaagggacccggcaggagccaattctttccttctactgtgtgggcacaggaaatcagactcgggacagcaggctctatggcaagtgtctctagccactgagctatcccaccagctatggaaaggccaccgttaaggggccaatggcgtgtgaacgtagtgaacgtattggacagctcagctctcaggggcattctacaaaggtggtcatagaaataaaggcaccactacaaaactggtgggcgctttaccaggagagcagggaatgccatgggtgatgctagggaagctgcaaaggactcggccagcccttgtcccctctcccgcttttatgagttataagaacgttctgcaaaccccagtcaagaccgccttcattgaggatgatgacaaccagagggtctggcacttttatatattctccagctcaggaaggagcaacaatgttgcttcttgtgaccattagctacaggatagccaagcaccagcctctagcctcacgaagctgcaggaaagatgcaggaccctggggacacagcggtatccagacaggtcacaatgaccacctccttgcctggggctcttgccttcctagggacaaagggtcccaatttgcccgcccacacagacaatggcagaggtaacttggtgacttgctttggtgacatgtctttgaagacagatgttcacaaacaggaatgcatggtctgcctctgcatgttattggcattgccctcctcttggggacactcccaaattcactgctccccaacacttccaagaaccgctaccctgctggctaccctgctgtggcttccttcctttgcttagaatggtctgtctctgcgggatggcaaatctccctgagttgggtgactccactttcacgggcttcctgcccttttccttccttgccacactttccttctcagcaaaagaagaggattcgccaagttccctcaccaaagtggtcgtcttttgcccatgtctaccctacccctgccagcctcgccccaacaatgctttttgcgttttctttcaaacatttagtgcttgtaacaaaacatgggggggtgtcgccttgagtttcatgttcccactggtttatggctattcttagtcctcaggactgggcatatgactgggactcttgggaaacgtcggttgaatgaataataaaaaaattgtcaccctggaaggtcacagagaccagggtctgttctcagaacactgaagtgaaaccgcccttctcagtggccttttaagtccttgttccacactgacctcgaaattctctccacttctctaaatgactcctgttccgaaaggcctctgcggaccccctctgtcagaaggaaatctaacgatcacagacagaacctgacactttctagtaaccacattgttaaatggtaaaaagcgacgacacgtcttcacttcagagtgtagctccgttgtttgttttttgttttattttttttttaatggcagtgagctatgctgtcttttctttttcttttttttaatgctaagtctttgaaaccctgtgtgtattttacgctcattacatgctttgatttggactccccttggttcaagtggtcaggagccacacatggctttggcagccatattgggtggcatggcagccattttcagagtatgaacctctacgttgaatgtggtttttctgggtgcgtggtatgtttttctctgtgcaaggcaggttttctcttaggttgttttaaaaaacaaaaacaccagagtgacaaataccattgagttgttcactcagagcagacagccaaggaagaaattggtcaccttggtaaacgtatctatgaggccccagaaataccaggagctaaaacactggatactgtaggactcctttgaaggagttgtgtaattaacttcttccctttacgaacaggaaaataaaggcaggaggatttctgtgaattcctggccagcaagccatgctggaagtgcattttaaacccctggtgtctacctttctggacaggtttgcttcaaatggcctctgccattggaaagcaaaagaaccctagatgccatcttagctgggcatagagtttggtgcgatgcactccatttgttgattctgtaaatggccttgaagggctgggagtggggctcagttgctagagtgtccgcttagcgtgcatgaagccctaggttcaatccccagcactgcataaactaaacaaggggacatatgcttgtgacctcagcatttgaggtgcagcagaaaggccaagagttcaaggttttcctcagttacaaagtgagtttgaaggcagtctgaacggtgtaagctcctacactgccccactcagaaaaaaaaaaaattacgttgggcactgactttgtgccagagagagctctgagggctgtgtttaagggagactttggctgtagatccatctccctgtctcttggagctcatcactgagagttagggggaccaccagcacacacagaagactaacagtccacacaggaagttggtgccaggagggatacatatcgcactggcagcatgagacttactgctgcccaccgtggcccagccagagaggatcctgaagataagcagctggcatcggtgcctgccaggggctagcctcagacacggaaggctcaggacactgcatcacaaccagccagcaagagctgagatcaaggcagctggcatttactgcttgaaccagggaataagaaggtcctgagcctagaagtcctcctgcggccaggactctgggagtcactgggccacgtggtgcagggtgacgcccatcttccacaaagactcagtgtcagccaggaagcatttatcgtggactgtcagtataccaggaacgctcgtataaagtcgattactctaatgttggctggagctgtcagtgtcttctaagaactgacaagtttacaatactggccaaacatgcccgcttcctcccaaagcacatccatgtttgaactcgacagcactgcgctccagtaaagatgcacagccaatgttaataacctactgtttgtctctctgtgcttagatctgtgggaagtggatcctattatgatcccacatcaccaccattttacagctaaggaaacaggcagagagagagggggcagtgacttgtttaaggtcacacagccaaggcacagcacagctgggtaaaaagcgacgacacgtcttcacttcagagtgtagctccgttgtttgtttttttgtttttttgttttttttgttttttgttttttttgttttttgagacagggtttctctgtgtagccctggctgtcctggaactcactcagtagaccaggctgacctcgaactcagaaatccacctgcctctgcctcccaagtgctgggattaaaggcgtgcgccaccaacgcctggctccagatttctcaatgtgaggggtggttgctcaacttataactgtcttcagtgctcccgccacgcctcccccaaaccattgcccaaaaagataccggtctccttgcaggtccagggtcacggctccacgtgacacttttctcttctttccaaaggtggtggctctcagtaaaagaagtcgggaggcagaggcggcgttcctgagtgtttataagcaattgattgaagcaccaggtaagaggctctcgggctctgtcattgagtaattaccacagaggaggagcatcccaagtgggtgacatggatgccacagtggcttcgtggtgctggagtctggggacaggactgaacccagggggaggccaggccctctggaagatggggatggggaggggtgcgtacatgtgtgcatgcgtgtgcatgtgcgtgtgcgtgtgtgtgtaagagggagagacttgaccagcctattgtgaagttacctgtcagctctgttatccagctttctgcctgatgggtgggagggcaactctgatatcttgccctccgggggaacccctttcagggccatagcttgcagcagggggcaatagaaggataatgtcattttttctacagccaaacttggaatcttagtattgagggaagcctggcccaaaagaacaaataccgggtagttcccctcagtgtgaacacagcaggcaggagtcagccccttagcctgcttaccatggttagagccgaacaccacacatgcatgcacacacatacatacacacacatacacacacacacacttgcatccatacacagacacacagacacacatgcatgcacacacagacatacatgcacacatgcatgcacagagacacagacacacatgcacacacatacgtgcatacaaagacacaaatgcacacatacatacgcacgccatgcatgcacacatgcatgtacacagacacatgcacaaacatgcatgcatacacaaacacatgcacacatgcatacaccgactcacatgcacatacagacaaacacacacacacacatgcaagtgcatacatgcgcacacatctgttgtcagataaacagatgtccgaagcatgttccatccacactggactatgagtcagccgtgagaaggaacgcagagcccatgtcaccatggcagcacgtgactatgtttgaaggaagcatctagaacaggcatctggatcgactgtgagagactgcaggggccagagtcggagtacagggtttcctgtggagagagaagattctagaactccagggaggcagggcagccgtgctctgtaggtgagctaagtgccaccaggtggtttcctttcagcaagaggcctccagtgaggtgaacatcacctcaggtgaacacagcagcctcccactgttgcgagtcagccatctctgaggtcagggctctgggtgtgagtcacacaacaatgtttgcctgaaaatatctggcccctgccactctcccattcgttggcccgtgcccaccactcacactgcaggtgtccaggccacaaggccaacactcagatgacctgccatgcttagccccaggcagccgttccagcgcttggggtatccagactcaggtcacacatgaggcttcaagttggtgtggtagctcacacctgtgatcccagcactcagaaggcttaggctaacctgggctacacagcgagactctgtctcagctgggaaggtggctctgtgggtaaaatgcttgcctgggttccgtcccaagcaccctgtaaagtgctgggtgtggcagggaatacttgtgatcccgggggaggcagagccaggctgattgccagaggagaggagctcccagacaggagacctgtctcaaaagacaaaagcagtaggcgcctcatgaggactaacgacctcaacagagcacacacatgcatgtacacccaggcatgcacacatgcatgtacacacacacttgcacacatgcacagaagaaacaatacttcatttcttgaagctgccatgggactctcatctttctggaccccaggctggttttttttttttttttttttttttgaggggggagaggggcggtgttcgaaactgggtttctctgtgtatccctggctatcctggaactctgtagaccaggctggcctcgatctcagaaatccacctgcctctgcctcccaagtgctggggttaaaggcgtgagccaccactgcccagctcaaggctatttgaactctgttgtaagcctggcagagagccacgtgaactccagagacaggcatggaagcttccagaaacccctcattgcttcacacactgtctctccccaaagcctgggtactcagaggtcacaagaagcctggagagcccaacgctgacttccacgtctgtgacttcccaggtctcctcctgtgaaggagggagagggggagggagggaagagacacagggatgccacatcccagctgtcatggagctagaaaacaaggagtcttaacggatggaggccagccacacaaacggcccctttaggggctctaattcattttcaagacatttaagaataacacagtgctttaatgatttcttcggggaatcaggaagacgtatttttgtgctcattaaatgttatccgcagacatgagaagcaaatgtcagatggggggaggttttggggggctttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacaccttccccttccccggcatgcctgtgggtcctccctgtgagactccagaccccgcagcctcagtgtggttctttctcttctgtgggtgttcctggtgtcctgagctcctccccacactgcccatgtgctgagggctagtgctgtgacacagggttccttggatgagagagaaaaatgtgggaaagtacatagaaaccttgtcttgatcccagaccctgtggtcagaacaaatgaggttgtttcccctggttgggctgcccagctttttttactctttacccagtgtgctgtttgaccaactctttgcgcagttcctccatttatagcaggacttaattattattgatttgtccatgctctttgtatattagggacaggggcattggtaccggtagacatgtttggcatcttctctgttaaacggacttttgctttttaactttgttcatagcctctcgtatacatcgtacctagtagacattcaagcaatgatttctagaaagtagagaatcttaccaaatctttctttctgtgtcctatttttaaacacattctcacctgaagtttagaattgggttttttgtttttttgttttttgtttttgtttttttagtattcctgcgatcttcttttaaatttttaaatctaagccatgtgaaatgtatttttgatgaaagcaggaggtaaaatcactagtttagagttttgtcccaaatgactaattttagcgccatctagtgatcaagccaccttcacctccatggaaaagacattttagtgtaactgggaacagtgatggcccctactgcccctacttacatcccctcctcttcctcttcctcctcctccttctcctcttccccttcttcgtcttcttctgcatcttcctctccttttctccttcctcttcctcccctcctctttctcctcctttccttccttcttttcttcttcctcttcctcctcctcctccctcctctctccttctctccttccttccctccctcgtgttccttaggtgtcataagaacacagagaacaacttcacatgagctcagacggaaggcccaggtaccatgttgcctggacatttctaggtgttgtctgtgtgacaggcatcatgctagctcctcacaggcacaagctcactgacaaaggcccccaacacaaacacactcacacacacactcatacatccgcacctgtggttctcagtgtccaaccttgctgtagaattcatttgaaaatacaggactttgggaaaatgtccatcagagatttgtgctgtggaaagagggggcacccagtaagcggagtgtcacaaccagccctttaggagcgctggcctgggagatggggagtgccaacatatctctccaggtgtgaacccccagagctgagggaagcaaagagctgcaaatgtgtgtgtgtggggggggggcagaggaagaagggctctgggcaccagggatgggccaggcccctctctgctgtcttgtcttaccgcttcctccatgcctgcccttccccaggcccgtgggacacacagcagagaacacccagcctgccgtctggtacacacctctccccctgcgcctctcattcgacaaatattcagtgcttgctgctgtttgttggcctctctcctaccacaggggcatggtgctgagcaagacagaccttttccttccaccccaggaggttccacgtgcttcacacacatacacaccacacacacacacagagccgtgtttgcattatgacacacatgttgtgccctggaaactgactctccctctctgggctgctgtctcttctccacagatgagctcctccccctcccaccttgaatgagacagagcctcaagcgcctagtagctgctcagctaacagcggctgccgctgaccccatcagtgccagggagggagaccctcatgctaggcacctctgcggcctcagagccagccagcacaagccgttgtggggagaaaggagccagcaggctcctagctgtcctgaaggaagggacgtgtgcccatctgctaaggaaaagttaggactctggattgaaatcagtgtctgtgccgcccacacggccaccgcccaagcccagatgggaacaggctgctgcctgggctcaagctttggggagcgtgcgcatacttctgcatatttgttcctaaggagcctcgtggccagccttctggctacggcgtcccaaaaaaatcctcagtgtgccacttcgggcggacacagagggaggggaggtccacccttctctccctgtctctccagcccctgtctcccaccctgagcatcagcaggtgaccaggtgaccaggctttccctgttatttacaaggatgccccaaccccattattagccacccatcaatcaagagcaggccatagccctgagccaccctgtcaccttcctcacctgtggtcacctcggcctgtggtccccctctttagaggtccaatcagtttaatttgtccacaaactccttcgctcctacactttgggtttgggggctcccaaacccaagatttgcttttgagaaatctcagaccaaaaagctgctgtgtccccagggccgctgtttcactccctccaaatgggccctagctgtaggagccactggagaagcaagcagtcttgtctgtcacttactatatccctggccaggctgaaaggagtggaggggcctcgcctgggtgccagtggcctctctgagacccgtaccctcaccggtaactgggccctgtggtcatgaggacccagtgaggccttgttcctgggacagcagttctagtgggtagtgggtgggtagtgcagggagaggggagttgggcgggaatggggagatgagtggcctccgttcctcaccctgccctgggctgtttctccagacgcatcctgtagactagaacattctcctttatcaccatgctggctctgcctactgtcactcccagacaggtcctgcctgcccagcctaaacaggagcccattctctctgacatggcctcatctgtcccttgccccctctgtccattctgagtggcagctgcagggttctcctctctgccaccgctcccacagcccaaaccgtcctcagtacagagcagcccctggcagtgcctggctggaggaggagccatgcctgacacttagttcaggagcaacaacggtgaactcgaactcgtggctgctgctgtaacaagcttgcaccccacagtcctggaagtcaggcgccactgaagcccaaggctccctaaactaccttcccagccaatgtcaaagtcaggattggaccttgagcctcctatcctggttcctctgcgtttcctctagggtagccttgaactctgtggaatgaaggcgtgaagaatttaatgaccccaaccccacacacagagagccagttgtgacagcgccacacctttagttccagtacttggagacagagtcaggaagatctctgagttcaaggtcagcctggtctacagagtgagttccaggacaggccaagtgatgcagagagagatcctgcctcaatcaatcaatcaatcaatcagcctttctcagagtgtctggttctgccctggaaatctagcttgggctggggtaggtccctgccccattcttcaccctggggaagtcccatcactgtgcaacggttagtccatctgtgggacagagatgcatcattactcacctcccgccacggcagtgagagtcacaggccatttctcccaggaagtgatggcagcatgtgtgtgtgtgtgtgtgtgtggggtcactctctgtccccagacttcacagaacattgctctaggctgactggccccagcgctcctgagctccagtgaacactgggctcttagggtggccacaacggccagcacctggccttgctcacctctttaactcctgccctccatactctgaggagtaactgtgcagaccacacgggaaggggtgggggtggagggctgttcccaccctgagtcacgcacctctctccctgtctcttatttattcatttatgtaggttgtgctgagaatcaaacccagagcctcatgcctgctaggcaagcactctgccacagagccacatccccagccttttttttttttttccttccttagcccaggtcttatatatcccaggctggccttgaacatgcgtcttgtcggcactcccggtttatggggagcacgggttgaagccctgggctccgtgcacacgaggcagcaagtgctagaccaactgagccgtaacccctgcctttcctttactaagtggcccaggcggccttgaatttataatcctcatgccccacccagcctctccaaccaagcccagctcagtgtcttgtttttaaatctccccattcatgtctcctgagaagcaagacctgcccacatttcttctggacacacagccagcaggaagcccctcagggttggcaaagggctgtccttggcctctgtgaacagcaggtagcaagaaccttttcctgccctggtgtggtcctttgacctggccttctggacccctgagccccaagctggaaaggtccccactcctgtggcctcctcagcctgcactccaccccccacccccatgtttatctaacttccctgacccctgcaaatacccggtgcctctctctttttcttaaaaaaaaaaaaaaaaaaaaaaaaaaaaaacaggccacaatagaaagcaattccttgaacttattaaaaaatctaaagttgtaaattaatttgttcgtgttgtacaaaggcagtgcaaatgggcctgttaccacgcacacaacaaataattagagatgaatttttagctggcctgcctaatgcgcttgctgggttaattatgtcaatgtataattacaccagcccggggaggcataatggcacaccccgctgagcagacccggcctaatgacaggcgtcgggggtggggggtgctgacagaggagagccattgccaagtcctacacacctgctcacctcagtacaggcgtgacaacaacgacgtccaacctctctgccacttaagctaagaacaacacaaggagcccccttgttccagccagacccgaaggcgcccccatgcaggcatggcccaagcctttctgccagcaaaaaaaaaaaacgttatcaagctccactttgtcaggcttcaaccaggctcagtgggaagggagaagcagggatgggtgtgaactcaagcctcctttttgggcatctgtccactaagggataaggagatggacttacagatagaagaggctgaccacatgaaggctagacctgtgaaggatgcacagggtctgttcttgtattagaagatgaacgcagtatggaggcctccctggaggaggtggcacttgagcggctgggtagggtggggagcatgttttcgatggtatcatgaagaaggaatagctagggcttctgtgtgttctgaggtctgggggacgttgtgttaaccattttctatgtgcctcatcacacacacatgcacacacgtacacgcaaacacatgctgccatctatggctaggcacagagagggacagctgctccacaggggactgtggaggccattcctgtgctgaggtccctcacctacaaggtgtctttctcctgggcttcttgagtgtggtgtgtaagatggtgaggttggccaaggcttacatctgggtgttggctttcttctacttaactgggatatgtcacacagcccacggtgcatccaaccagggatgaaggctttactggatatagggagtgaggggtatccagagaccacatgaccagtttgaagaatccaaggggctagacaggtgggaaccaggtcccaccaggtgggggcaccctcgttcagcttggcccccatagcgcttgcactgcctctgagtccctgggcatatggtcactatatgagcctctttgtggatctaccataatagcagatgtcagttccacgccaactgagacactgtggggctggggcaggggggaggggtcagtcccttatagtcatgtgggtaacatggcagtaagcaggcatggttctgtgagaaatagctgagagcttaccatcttcaaccgtgtgcagcagacagagcaccagacgggcattagtggcacatacctttaatcccagcccttgggaggcaggagcaggcagatctctgagttcaaggccagactggactacataataagttccagtactacatagagaggacctgtctcaaaacgataggtggatggatggatggatggattgatgaatggacagacagacaaacaaggacgattgagcccagcatgggctttagaaacctcaaagcccactcctgttgacacaactcctcaatgaggccacacctcctcaaagaggccacaccccctaatccttcccaaacatttccaccaactgagaaccaagcattcaaccatatgagcctaggtgggtcattcccattccaaacctccacaggcggctcggcatgtgctgcccttgcaggggaccccagttagtttcccagcaccctcagaagatggctcacagctgactgtaaccccaactccaggggttctgacacctttggcctctgaagacacctgcactcatgtgtgcatacacacaggggtttttttgtttgttttgtttgtttggttggtttggtttttcgagacagggtttctctatatagccctggctgtcaggctggcctcaaactcagaaatctgcctgccaatgcctcctgagtgctgggattaaaggcatgcgccaccacgccaggctcacacacacagctttttttttaattaatctttaaaataagtttaaaaagaaagaaaaagttgtctgctttctgcagacatcagagtgactccaagtggctcctacagaccgtgcccccagctttctgtggaagggtgtcttagccccagcctcccctacatcctcctacccctctctctccctgtctccctgcagaccctgtcccatcatttgaggtggcgcggactctagacgacagactgcagcgtcccagctttgaccccagtgggcagcgcctacaagacgtgcacatcgcgtggaagaggtgcccagagccacccagtgccagaggtaccaatgacaccactgcgggatgttggggacaaacctagatgtcagagctgcagccaaacctgagcagcctttggggatgggggtggggcagagggcaggatctgggtgacactgaattatggtagcagggccacagatgatggcatggttaaggagaaggtgtttattgtagagacaagggagagagtggccaggggtagccagaagagtccagagcagagaaagtagtagatcgaacacagccagcggactggacacggccagcaagaagcaggcacagagcaagggagaccaagatggggcggggaggggatgagagggagagagagtgtgtgggctgaagagggagcagagccaaaatggcagggttataaagaacacaagtggctgggaactggggatggatgggaagagctggggacaccatagggactgtaaaatgtctaacaggtacatgtgtcagtgtgggagcccggaggccagcatgggtgctgctgtgctaccatgcactacagtagtcatttgtcccttcagccagtgaccagggaaatgtctccttttggtggcaggggaccagctctacaagcccctgaggaatgttggcttttgtctaatccccaggattttgggaaacggagcctcctttggacctgacacacactagcgcacaaacagatactattgtggtgtcagttgaaaatggcttgggtggtagatctcacgtatattttagcataattttaaaagtaataaagatgactagggtgggcgtggatggttaaaaggggcccagggtgtgctggctaaggctggaactttgagagcttggctttgtgtcccaatcgggattatgactgctatgacgaaaccccacaaaacaagttggggaggaaagggtttgttatttggcttacacttccacatcactgttcatcaaaggaagtcagaacaggaactcaagcagggcaggaagcaggagctactgcagaagccatggagggatgctgcttactggcttgcttgctccttgtgacttgctgggcctgtattcttatagaacccaggaccaccagcccagaggtggctccgcccactgtgggcgggacgctcccatcagtctctaattaggaagatgcccacaggctctctacagccctttattagagaagcattttctcagttgaggctttttcctctcagaagactctagcctgtgtcaggttgacataaaacccagccagcacactttgtgagcttgccagcctgcaggccagtaggtccccccttccctgcccccaccccactatctctaatgaactgatctcaggggtccaggcgggcctctgcctgcagctgttggggtgctgagtgtggtcctcttgtcttctgcagagcagaacgaggggacgtgtcccacggggcacacgccagccaacggtaaccacctgccaggtcccgaggacaccctcgtgacagacaccttgctgcagaagaatgaggccgagagacagaagtgaggagggaggcagggcaggctgcccaggaagccctggggcagtcactggcaggagggagatgggaaagggtgagggactctgaggccggccctacaactcccagctcactcttccagtctcagttgccttgtctggggaatgggtacattcatcagccttatccagaagaaagatagagtgggattattgttggtggtggtagtggtggtggtggtggtttagggttttgttgttgttgttgttgttgttttgttttttgtatgtgttaagacacctctctggggtcacggggtcatggagctcttgtctattgtggcagtaacagaacccaggcatggctccagctctctgggaaccttggtcttaagattgtcagggggtaacaccaggtccaccggcctcatcaagggccttccccttgacacaacatgagtggacagtagccatcggtctcactcagagagagtctgccagaacctaggcttccacatagttgagctggcagaaggaaggaacagaaataaagacaagccacatcaatacaatagtgaaggaaagtctggcaagaacagggagaaccaatggggtggtctttctagtgcaccaagggagacgtggctccagagggacatggggagggggtgggtaaagtcctccgtcagtgaggctccggccaatggaaagggtgtgactggatgaggggagaggctgggcaaaggccctgaggtcagagctagcctggagcagccaaaaggtgagagtagccagagaggacggagccatgaaggaacggaggtaacatctgagtttgggggtttgtcttctattaggaaagagacaggtcggccgccagctctgtacatgtaactttcctcgcaagggctcctgagcgtccaagcgccggctgcaggaatgggaataaaaccagggcggctttggggagtgacacccactgtggtaggaccaggtgggtcctagcacgcagcctgagcagccccgtgtctctccaggggtctccaagaagtccacatcaccttggcagccaggctgggggaggcagaggagaaaatcaaggtgttacattcaggtatgactctgactctggggggcgggagccctcaagtggcttgaagcagcgtggggatgggggacaggggtggccagtgaaacaatgaacttggggacataaatccggtgtgcccaaagacaggggtcagaagctggggtggaaccaaatggggcaaacctttgacagccatgcactaagctgtgtcaaagatggtgactagggcacctgctagagccagattgtcaggaagatgactaatgccctgggccaccaggcagggtctagtggccccagagtgggtagcctacctgtcaaaacttggaaatgtaactggcaggaagctgaggcaggagaattaaggctagcctgagcgacctagtgttttccccaccagccttggccacgttctgaaactgtccctaaaaaaccaaaccaaaccaaatgaacaagcaaactgggatttctcaagaaatctcagcagcagctcacagacctggaactcccaagcctctatgagtcctcctgccccaggtcccccacctggccaggtcttcaatccctctcccactaagactgcctcccagcttggggggggggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcacctggccttcacccctcccagcgctaaaggccacacagacagagctgctggagctgaggaggaaatacgatgaggaggctgcttccaagtaagtgagctggggacaccgcctcctccctttgtctgccacacacaggccacctccttctgattctctgagcaagtgacccccaggcatgcacctgacccatcttcccttttattcacacaccagagtcacaacacccttggacccacctgagtgaggccactggacagcctcacccccgaccctgacccatgacccctgacctctggttctaccacctgccctacacattcctcagtttcccagtacaaccagtggaggccaagtgacagcatctaaacgactcagagtgcagtcacttcttccggtttaagacatcactcacgtcataaacacttattgaacaccaactgtttatctggtgctgtgctgagaccctggagggaacatgaacgcttcaccacccagtccctaaagcagacacaggcagtagcaggctatgacgaatccactcacagccaccactgagcacttactgtgtgcagtcactgtatcgagcatgaaattggtttctccaagggaagagctggaggcaggggtggcccaggcaggcagcctcaaatgacacactaggaagtgcacctcaggcagtacagacagtgcgtgcctacgaaggcctcaaggatgtgcaaggatgtgaccagtcatgtcccccagcccccagagtcccagcaagctaggcagacttgtcctacgcccccagtgtcacagtctggagggaatggcaccgtagacaagggccccaccttggggagtcactgcaagagcactgtccgattcttagagggaaggtgaggagaaagcccctgttgtagctccccaaagattgggccctgggctgcctttaagaagagctttgtgcaggtagcaggcgctaaccacctagcagcacttgggaagcagaggcaggcagatctctgcgttcaaggccaagcctggtctacagagcaagtgctggggtagacagggctccactgagaatccctgtctcaagaaaagagaggtgtaggggaggagttttgagacccagtccctagttcccagcagtggagattttttacccccacccagtatgttttctctctggnnnnnnnnnnnnnnnnnnnnctgtctcagggcccctttcctctgtgtcccagggccgatgaggtcggcttgatcatgacgaacctgggagaaggccaaccaggtgagccgtgagtgggagtctcctgtggagggtaggggtgggggtgggagcagggctggggggggggggagtggggcacctagctgggttgcggctgtttggacccaagttgtttggccttgcccaaggacctacaacaccctgattactgagtatctccctgtctgcccgtgggtatagagataaccccaagatcagcaggccagtcctgtggcaaggcacagtgtcattttgcttgggtcactgcgggaggccctgtggcagagtccctcagatcacaggccctggggcctgtctctgtgggcagcatgccagactactgataacctcttgagctctggcccccatgggagcagtgggcacccaggagaagcagggccagggccgtggtgatagtgattttcctggcttctgctcccatggttggctggaattctttctttgttttgaggcaggatctgctgttatctcaggctggtcttgaactcccagtttagctgagggtgaccttgaactcctgatcctcctgtctccacctcccaagtgctgggattgcaggtgtgtgccaccacatctggtttatgttttataaactgtgttactgattggaaccgggtggggcttccttcatgctgaacaaacactcccaactgagccctacctctccagccagctcctgtgttacttcagggatcattactctggtgctactttgtgggttcttctttcttccaaccttctccgcccttttttcccctttaacctttaagactaaataggagagaaaagaggccagaaagggagggaccgatgttattgttagactacttcctgccgatcagagctgtagagttccttgggataagtttgatcttcaccatcaggatatctcatttcttcttgtttcttctttgcacatgatgacttaacatactgcaaccaacagcaaccaaccaacaacccaccctacttctcggggctgtagcattatatatcctctgaaaagcccccagattccaaatgtcatacaaacagagaaactattcacaactggcaaaatcatgccaatagagcactaggcaaatcatagtcgactgctgtggacagtctgaaacagcccgtattccacacctggggttaataaaatgaaaaaatattatgtatttaaaaacaaaaaacaaaatgccaaaattgtcactacagatctccatttatatcagttgcatagcatttttagtggttttggttttttgagagagggtctcactgtagccctggctggcctggaacttggcatgtagaccagcctagccttgaactcacagagctctgcctgtctctgcctccctctggaactaaaaccaccatcacccagcccttgtcttacccttcaaataggtaattcactcacatagttcaaaattcagaaaagacaaaccagagcagatccaaggcagtgccccttgccccagcggcctgtctgaccagtttctgggctctccttccagggatgtccacccatgtacaaaccaaccagtagacccacatgagcctcacgggctctacctgcctctggtggatgtacccactggcacacattcgcctaatctgggacaccaggttctgcttcccacaacagcaaacagatattttagcactgtgagaaccacattttgtgtgccaaagaggcaacttagcaactgcagcaggaaaaattgtgtccaccccgagtgtgcacacctgcatgccaataaagctttatttataagaacagttagtgggctatagattgctaagtctgctctagccagaccactctagatgactgtttatagttaatgtccacctttcccctctcccaaccaacaccttcacgattaccctcgggcagacaccatctcacacgtgcaggagctgaaggatggatccagttccaaaatgggattactggggcaagggttctttgccctacggacatgcagatggggccaaaccgatcccgcctttgcagggtccagcctggctgtccaatgaagaggctagtaccctgttgccaaacccccagcgggaggtttcttagccaatgacatggccttgagaaaagagatcatagccaggtgtggtggcacaaacttgtggtagagaccggaggaccaggaattcaaggttatcctcagctgcatatcaagttcaaagccagcccaactatagaagaccctggaacaaatagccaagtaaatgtgtgaatagagttaagctcaaccacggactctatttacagtgtgccctgcttggccttcgagcacgagagcctcctctgacttttttttttaatacccctattctgtaaaagggaaactgaggccttagaaagccaagggagtcacccagaggctgtgacagccactgaactgggaccacctctgaagatagcagatacccccccccagtgtacagtcttgagccagagccagagaagggacacaggccccagtgtgggacagaaccacctggggatgggtgcagacagccccttcttgcccttccctccctggcagaaggagtgttctcaccttggggggtctcaggtaccctagcatcacttaatcacttagagccatccctggtggcctctgttcagtaataccatctcaccaggaaaggtggggtgagacatctcttcctttgtacccaccgtggggctcagtgacagggtttcccaggtccaggcctgcctgcattcaggactgtgggaacctaggcccttggagatccagggtggtacaggtgtagggcatccttgttctctctctctctctttctctcatccgctcccctcttctcttcccccagcgagcagaggctgcccagcgtgaggtggaaagccttcgggagcagctggcgtcagtcaacagctccattcgcctggcttgctgttccccccagggacccagtggggtaagaaggatgcacctgggacgtgggggaaggcagagggaaaagattggggaagcccatgtctctgcacatagggaaagtgggtgtcacttgcgaggaccaaccgactgacgtggatgtgagcagggacgcacggggtctctgagtgcagagagcattgttaaggtcagcatagtacaagacttactgtaacctgttgtagcaacagggtcttgttgagtgtgcactgcttttagttgtgcaagattctgctgactattggttaacaaaaagcctagtgtcttcctttggatgcctccctcgccttgcctggaaatgcccgaattgttcccaacgccaagaaggtaccacccattgcagggtgcagcaggatttggaccacggggcattgtgagtggtggccaccagagggtgctgttgaacaccagtctctcattgcctggtggtcgcttgggaattttcaagccctgaccaggaactgtaagaaggcttgtatttcagcccttaagtcctaaaccttacaggtgactctggtgggacccgccccttcctccagtgctataaagagccaattccagctactaaccccaaggttcctaagtgaaatcaacccgtctttctccttttcctggccagcaccctcaagagtcctggggtcactgcctgcctaaggacttaagtcacaacccacatcccatgggtcttgtacactgtcggtctccttcccggggttctgcacgctggagggttagagtcacgattccttacatcatcccaagtggcagctgtggtttccgccttccttagcacacgggcgccgatgtcacagcactttagtttccttcccatccacgctagcgtacaaggttatagagagaactgcttggctcatagattgtgctgggaaagagccaatgcttttggcggttaccgtgcgcagaatctggctctgctcctcagagttcactgcctcttgcgcccacgaatgtgcacgtctggtgtgatgtgtaacagtgactgtgggtcttcaatggccgaaaaggtctttactctgtgtgtgtgtgtgtgtgtgtgtgtgtgtgtgtgtgtgtgtgtgtgtgtttgcatgagcatccaggaaggtaaatgtgactctgtcccaagtctttggtgatttaccaggtgactgtcccacagaagcgagtctgtctggagagacaggggagctgtggccacctggggaggagtcaccagcgtttcttaattaacccccgaggaacctgcaaatgactaagcagccacactggaatccccggctggtttgggaggcagcttttctgagcacaacagtggcacttgatgctaattaatttaatgtattaatggcatccgcttcctgttttaattggcatttatctccaaggaagaaagctggattagtagtggtggggttgtttttttgtgtgtgaagagtttgttgcgattttttttctttctttgtaagtacttcttagattgtgtaataaagccagagagctgcctgacccaggtccctcagaacctgtacaagcctgtaccttgtcatagatggaacggagactccaggggcagtttccaagacctctagatgggtgacaggcgtggaacagatcaggggatgccgcagaaacactgcctgtggctgcaatgtggctgctctggccctgagggtcaatggtttcctggatgggtcatttcccttggcgacggacccagcaccccaaacctattttggaattgccactgctacagttccttcccacttttacttttgtgtgtgtgtgtgtgtgtgtgtgtgcatatacatgtacacgtatgcctatacacatggatctgagtgattgcctgtgtgtactgaagccaggggacaaccttggattctgttcccctgaggctgtccacctcactttctgagatgggatctcccactgacctggacatcatgaattagcgtaggctcacgggtaagctccaggagtccagttgcctctgcttcctgggttatacctggagacaaccacacccagctttttccagagatgaaatttaggcccctaatttaccaacagacaacttttttctccctaggggttttgtggttttgttttgtttgtgttttgagacagggtttctctgtgtagccctggctgtcctggaactcactctgtagaccaggctggcctcgaactcagaaatccgcctgcctctgcctcccgcgtgctgggatcaaaggcatgtaccaccactgcccagctaggttttgtttttttttttttcgtttgggggtttattttgtttcatggttgtttttgtttgtctgtttgtttgtttgtttgtttggaggcaaagtctcactgtgtagctcaggctaacctagaacttgtggtcaccctcctgcctttgactccagagtgcagaggtctttaccgttacacccagccatggttgtatttttgacaactcaagtcttgaatgaagcacggcttctgtaaggggaaccgtgcaagtggcacagcagtgtcagatcgccagatggaaagttcccttccacctgaggtccaggggcagcatgccatgctggggttcagcccctcaaagccactcactgagagcactctctgttcccaggagaaggtgagctttgctctgtgttcagggccgcggctggaggcagctctggcctccaaggacagagagatcctgaggctgttgaaggacgcccagcagcttcgacattccctgcaggagctggaggaggtctcagccaaccaaatcgctgacctggagcggcagctagctgccaagtccgaggccatagaggcaggtcccagggtggcaggggcgggcggtggtgggctgggagcacgggccagcttcattagatccttttgtcttccagaaactccaagaaaagctcgaggcccaggctgactatgaagagattaaaacagagctgaggtaccatgttggctgggactgttcagaaagctccttagctcctcccccacatgtccactctggggtccacatctctctctctgtcaaaaccagtccagtcacagctaggtgtggtggcaaaggctcactagtgcagccagcattcaggaggtcaagccaggaggcctggcagcctggcctgggcctccacaaaacaaactggttgtcctcgcctggtttctgttgctgtgataaagcgccaacatacgccatcttgtagcttatgggttccatccagtcccatcacccagggatgccaaggcaggaggaacctggaggcaggagctgatgcagaggccatggaggggtgctgcttactggcttgctcgccatgacttgctcagcttgcttgcttagagcacccaggaccactttggttgcagaggagctgggccttcccatagcaatcattaaatcaaggaaacgccccccacagacctgcctataggccagtctcatgaaggcaccttctcagtgaagacctcctcttcccaaaagattctagctcatgtcaggttggcagaaaaacaaaccagcacactggtccttttccgtgaagctgtggagattgtcaccttgtcaccttgtcactgtggtgtggaaactggggacttcctcggcagtcagataaacgcaggctgtgggcatgcggggctccccagacccaactcactggaacatgtgactttaagcctgcagttgatacagttttcagttgacagttgacccttggtgtcaccagggtgggatgactaagcccgggcctggtagcactgtggtagtgtcctccatggaacccaggtgcagcctcttgtgacttcatcatctcttctcccatgattcctaacacggtaactgcacgtccctcccttgccacgaggccacattagtactcagtgtgcagtcccgaggcaaatccagtttttgcattttggaactttctggaaaaaaatatgtatttggtagtttctacctatgtctagcctaaaaccacaaggcaggatggctcaatgggagaggacatgggtagtgtgccaaaggcctggggttccttccctggaaccccagaggaaaggagaagagggggtgagaatgggagggaaagcgaggaggaagtcagaaacaggaaacaaagggaagaacagattggtggtgctccagtccttgggaggcagaggcaggagaatcaggaattctagtctagcctccactacaaaatgaatttgaggctagcctgggctacatgagaccatatgcaaaatgaaatatagaaaaacgaaaaaagaaaggcaagtatgacttggtgtggtgagtgtggtacaagcctttaatcccagcacttgggaagcagaggtaggtagatctctgtgagttcgaacccagcctggtctacaggaccccacctggggtatctcctcctgctgacctccggcccctcttgttttctccccgcagcatcctgagagccatgaagctggcctccagcacctgcagcctcccacaggtacacatccctgccaccgctgtccctgtcccccaaagctggctgcttccaccaagtctgcaccagccgtaccttctcgcccttgcttcctcccaccccaccccccagacgctggccaagcctgacgacccgctgcttgtggccaaggatgtcttcttccccacacagaagttcctactggagaagcctgcgctgctggccagccctggtaggggacgaggaactcaccgagggggcacttgggctgaggggctggacaaggatgcccttggacttcttcatgccccaggatcactgcaattcatgaggcagaagaatccagaccggggatgtaggctgggcatttgctgggtgatgcttcccaggttcagggtcacaggtagacccaaggctcccagtgacttccctggaccctgactctagctggatactggaactttaataagaactcaggagtcaggggaggggtgtctataccctaccctacagccgacccccagggcatggcccacagcttaaaattgcccttcttcctacaaatggctcagtggccctgtagccttgtgaccttcgccaagatggcaggctcattattggtctcttaaatgggaagtgctgggtggcctgagtgactaggcactggaggcattagacccctggggtgactgtgactcccttcctgcttgctaggataatgtccccaatggcagcaggtgggtcccacaagctagcatttgaagggggtctgaggaggtggggttcgagaatgagggacaacagcaagcatgggtatttatggcttctgagacctatagctagtccctcatcctgtccccccattaccccatatcctctgtctctgctctctctctctctccctttctaaccatctctcttgcctctgcacatccctcccctccatcacaattggtccctctgcacctctgtctgtctgtctgtctgtgcatcccccctggtgttctagaggaagacccctcggaggatgactccatcaagggctcactgggcacggagcccccctaccctcctcagcttccacctccgccaggcccggaagacccgctgtccccaagccctgcgcagcccctgctgggccccagcctgggtcctgatgggccaaggactttctcgctgtcccccttccccagcctggccccgggggagaggctggctggggactcactgctgtccaaacatatgatgggcccagctgccttcaaaggggagacgggaaacctgctggcattccccccgactttctacggtggtgccaagcctccatcagctcctgctgcctccgtgccctgccccgagcccacaggggccccggaggctgtggatggggctgggccagaggaggagcagctggacacggctgagatcgcctttcaggtgaaggagcaacttctcaagcacaacattggccagcgcgtgtttggccactatgtgctgggactgtcgcagggctcggtgagtgagatcctggcccggcccaagccgtggcgtaagctcacggtgaaaggcaaggagcccttcatcaagatgaagcagttcctgtcggatgagcagaatgtgctggccctgcgcaccatccaggtgaggcagcgaggtaagccacggaggagccccaccgccatccagagctgtgggtgaccccggggtgggtgagccaccaccctgtgccttggtttccctatttcgagggacagactcgtgaccttgctccctcctgcactgggccacccctccctccctctgcagccctttctgggcagttaagccccagctctgggctgattcctcagtttccaccccccaccccattctcgacattggcccgtgggggaggggctaaaaggacccagagctccgaactgcttaagaagtgtccgctgttgccataatcatcctggcccattaaccagccctaaccactgacctagcacgcacagggtcctagttccagccccaaagccggagtcactacaccacctaccatttgtcaccctccccacccaccccaggacaatctggtccataccctcctgcccacctccagggcctgaccccgccccctgcaggccccacagccgccaccttcgtgcccctcccaggcagcatcaccccgagaatccgcacacctgagacaggctcggacgacgccatcaagagcatcctggagcaggccaagaaggagatagagtctcagaaggggggtaagtgtggcctctgcccatgacctctgatccttgcctgcatctcctctatcatcccagggtgttcccaggtcagttgtaacctccagggccccagaagggccttcctggaacacacgcaggtatgccacagctcaggtctctcccgtgtctcactacctgccccataacaaaatctcagctgttcagcaagacatccggaccctgagactatcccctttcccaggacatctagccaagcgccactctctttagtgtcacctcctccaggaagcccccccccctatcctggtatgcttcccactgtggcctacagtaccaaatacaagatagcaggactggccataaatcctggttcagctgttgattagctgtgtggccttgtattgatgacttgacctctctgtgcttccctcctctcatctttaagacgggaatgatattagctctcctttctgaaggctaaggggatcaccagccaggggcaggtacacagaagactgtaggcagagtcttagagtcaaaaccaccttctttgttgtgatcctgcctgccatcaatggctctggccttgtccctgccaatggcttgggggcttctatggctaggccaagttatacacttaacaccctgcagtgttggttgcctgggatcctgggatgctgggctcagttctcccaccccactgtgcggtgtctgctgccccctgctggtggatccgtgcatgtattccagttgcaaagtcctatgaggaaaatctatccgtgactgtggccttcagtggagacccgcctctgtccctaggagaggccacaggagagggagtttaccctgccctaccagctaatcctctgagccattcatgatttttttttttaaatacagggtttctgtgtgtagctttggctgtcctggaactttttctggagaccagacaggccttgaactcaaaagagttcttacttactcttactgggacaccttagcctcccaattgctgggattaaaggtgtgccccaccaccaccaccatcatcaccaccaggctcccactgaatgctagtccggagctgcagatgtgaagcgtgagctgcagatgtggctgaggcgtagcagcacagccttgagttcagttacacagaccctgggtgtctgacgttctcagtgcttcccccagggtcagaaacagactcggaagcattaaagtcagcaggggggctgaagggaatgttcacactcagtactaagctacaagggtggccactcccacttctacctcctaccccaatatgttccaaacagctgggaaggcccagcccagggcaccaggcatggccgactgccagctccaggcgtgttcttgacaaaaccaaaggaagtgtccagggtggaggtgggtgggcaggcatttatacaagctgctcataacaatgacaggctagtcagtgctggtggtggtggtggtggtggtggtggtggtggtggtggtggcggcggcggcggaggcggtgcacgcctttaatcccagcactcaggagacagaggcaggcggatctctgagttcgaggcctacactctggtctacagagtgagttccaggacagccagagctacacagagaaacnnnnnnnnnnnnnnnnnnnnnnnnnnnnnnnnnnnnnnnnnnnnnnnnnnnnnccgcttcccacttcagcctccccagcctgttgctggactttgaagtcatgtgactggcacttcctgggttgtcatcccttcctgttttaaatgtttttctaggttcctacttggatccacgctgggttcctttccgagactcaatgctggtctattgcttttagtttgaaaaacaaaatgtcattctaatggctgtgtcgtgggcccaagggtggaggctacccagggacacaggatcatggaggaaggccatggtgacctgtctggctcagtagtcagagaacactgtctagaagggagagagaggcagcccctagtcacacccggctccattgctgtcctgagacacggcctgggtctgtgacatcctctctgcttactccttgtgtggacttcctgtttgtcttcctttgcttattcatagaaccaactgagcccctgggacttatgactccgacccaagactctgtgtgcgtctgacctaacactccccctcccctccccccctccccgctcctccccttctcttccctctcagatagctgtcagcctggttttttcctatcagtccattgatgagactttcccctgcaccttgtggtttaattagcttgcttggtagcttgtggagacttagactttgaatcaccttcccttcccccaccccaaccctgagacaagctttctctgtgtagccctggctgtcctagactcactctgtagaccaggctggcctctaacaaactcccagagacccgcctgcctctgcctcctgattgctgggattaaaggtatgcccgacctcattaaccactggtttttctttttctttttttttttttttttttttttggtttttcgagacagggtttctctgtatagccctggctgtcctgaagctcactttgtagaccaggctggcctggaactcagaaatctgcctgcctctgcctcccgagtgctgggattaaaggcatgcgccaccacgcccggctgttttttctttggatggttgggtttccaccacgggcttttgctatagaattcatgagcgcatctttgagttactgcctctttcttgaccttcttaggctttcacgaggttggtttgtataaatgtataacagcgtgtataaaaggcgtgctttttgtgggttttggctttgttttttttgtttgtttgttttgggtttttttttcaatatttatttaatgtaagtacactgtagctgtcttcagacacaccaaaagagaacatcagatttcattacagatggttgtgagccaccatgtggttgctgggatttgaactcaggacctttggaagagtaggtgcttttaacctctgagccatctcaccagccccttggctttgttttaacactgcctcctctccttgttcactttctccacatatactaagatcttactattggcctgattttttttttaatgcctgcctaatattgcaccagacagtcagacaagacccaccatgacttacttaaccagtcttcccattgtagaacaccgaggttgcccccatgtttagatggtataaacacagatgccacatacaactatgtcacgatgatgggcccctgtccaccccatcacaggtgagtccaagaactccccagcctccgtgagcatccccaacggcacagcctcctccagcacctcggaagatgccatcaagaacattctggaacaagcccgccgagaaatgcaagcccagcagcaggccctgctggagatggagtcgggtcccaggggccgctcagtgcctccctctcctccggagcggccctcgccagccactgcgagccagaatggggccctgacctgcgtgaagcaggaagatggcggtggtggcagcggcagcagcagcactgtgcaggcgccgcttgctgtcttgtcccccgctgcatttgtgcagcggatcatccgcaaggtgaagtcggagatcggcgatgccggctactttgaccaccactgggcatcagaccgtggtttgctcagccgtccctatgcctccgtgtcgccctccctctcctcctcctccagctactccggacagcccaatgggcgagcctggcctcgtggggacgaggcaaccatcgcccctgaggacgaagcagctatgggcgaggacgaggcccccagggtgggagagctcaaggccgaggccggagccccggaggtgggcggcgggcgactgccctactatccagcatacgtgccccgcacactcaaacccactgtgccgcccctgacacccgagcagtatgaactgtacatgtaccgggaggtagacacgctggagttgacacgccaggtcaaggagaagctagccaagaacggcatctgccagcgcatctttggggagaaggtgtggacccgggggaggaggggggacccaggagcaaggcccactgagaccttagccctaagacctatagactggagggtgacccaggtaggaagccattcttctgggtgtctctcctgcgtctagccatccctggacactgaaccagttaacagccagtcccctgccctttacagccctttagctcccatggtccagcccctgaagggtaaagattcagcccagtccattccataatgtccccagccagtgctggaacattaaataggaggggataaaagaaaagatcagaactggaggaagagacttaaggggaggttcagagtagcatcttggaggagaccatgggatgccctttagggtcatttgctgagccaccctccacctgcaggtcctgggactgtctcagggtagcgtgagtgacatgctgtcacggccaaagccatggagcaagctgacacagaagggccgggagccttttatccggatgcagttgtggctgtcggaccagctgggccagggccagggccaagccccaacccagcagcccagcgctagccaaggtaagtgagggtacaatgcctgggctctaccccaagtcagtgggcttgcatgcccacctctgccctctctgcatcccagacaccattcaactgctgtcacctgaacaggggtccctggcccacaccccctttcccctccttcctatgggaggaagtttccactcagcagaggtgcagaaggcctggactcaggcaggacaacaaccctgtgtcccaacaaaatcacactcaccagctccctagagactccatgctgttcctcggaatctttcctagcacaggcctgggccagtcttgtgttcataggtgacgtcatggcagggtggagcctgaactttgcagagctagaaacaagagaggcttggagagttacctgaagtcacagggcccgtatgcagggctgctggggtcctgtgggtgacatttatttcagaacacgtggcttcaggcaggatggcccacctgccccggagaccacaaagaggcaacgattccggccaagggtcggtaaccccatctgtaaaatggggatccggttacaaaccagaacagagtgtcaggtggcagaatttgcaggtcctaccttagcaacaggcctggaggtccctttccatttgtggctacaaaacaaggataggctggtagacaggtagaaggcagactgtagacagacaggcaggcgggcaaaacaaatggcagacaaacatctggcagaaaccaataggcaagagaggtgacaggtaggcaggagacaggccagacaggtgttggacaggcaaacagcattctgggggcagaggcaggaggattgtaagttcaaagccagtttttgccatgtatggaggtccatagctcagaatgaaagttttgaaaggagccaagctgtttgggatagcaaggacctggctcacccctcaataccacagaacaaggaagggctatgttaccatgaagacctgagaggtcccttcctggggtgcactgtggtggctgcgggtgttttggtaccagcctcagctctggcaagccatgctacccagccacactcaacggccatgaccgctccaccgtctcttgcctgcagccagtcccacggagccaacctcctccccatcgcctcccccaagccccacggagcctgaaaagacgtcccaggagcctctgggcctgtcgctggaaagcagcaaggagaatcagcagcccgaaggccgggccagctcctccctgggtgggaagcccttctcaagcagccaggctgcggggggcatccaggagatggtggccatgtccccagagctggacacatactccatcaccaagagagtcaaggaggtcctcaccgacaacaacctaggtacgtggtgggggcccggagtgctccctgcagcccggagtgctccctgcagccctaggctagctcttctcagctttgagcacagcgccaatggggcttcccagtgacttcagggacagcctggaggtgccagctagccccgaagcatgcaggaccacacgctaggcacacggctctgaccaggaacccctactgacgaatgaaagagagagagcaccagcccggctctcaaaactgtgataccctagcagattcagtctgaattatgacccagtaatccgtcccctcaagatcagactagagggacacctgcccaagggcactaggcaggctcttgactctttgatggtgagggtaccaggctacccaggcatcccttgcatctgggcaagctcgatgctgtcctactttctgcctgccttgttccgctttagcttttgatttgtgtgttctgtctgaagagaatctctactgtagccgagactagcctcaagcttgcgatcctcctgccccaggctctcaagggcggtgattacagagatgagagatacacctggctccagccgcctgcatatggaaaccagaggtcaacctcggctgtcttcctagattactctctaatgtttttttggagacaggatctctcactgagcctagagctcggttctgcctgtttcttccctgtctctaaacactgagatggaccatcatgcccggctgttttgtgtttttcctcgtgtgtgtgtgtctccgtgttctgcctatccagacaccatgtgctgacctggtgtcctactaagtcagatgagggcatcagatcaccaggaactagagttagagatgggtatgagctagccatatggatgttggcagtttgctggggtgctcccctggggatagagagagcagttttctgtgtcactgactgtccagtgcctgccctccccagtctcttgtgcagggttagggttagggtcccgggcccacctcctgagagggggtctctgtgctgggcctggggtgacagttgccttctgccctgtcccccagggcagcggctgtttggtgagagcatcttggggttgacccagggctccgtgtcagatctgctgtcgaggcccaagccctggcacaaactgagcttgaagggccgggagccctttgtgcgtatgcagctgtggctgagtgacccccacaacgtggagaagcttcgggacatgaagaagctggagaagaaaggtgannnnnnnnnnnnnnnnnnnngcacacagcctcgccaaccttgtgcaagtataccagggtcccagtagttcctccaagggctggggaagtattgcagttgatagagtacttacttagcagtcattcacaaagccctgggctcattccccagcactgcctaagataggcatggtaatgcagcctgtgatcccagcatcacccaggaggcagaggcaggaagatcagaagttcaacatcatcccaggctacatagtgagttcaaagccagcctcggctgtgtgagaccctatatcaaacaaatcaacctgcaatgacctaaagacgccccctagaccccactccttaaaggtccctcctctcagtagcgctcggctgggaccaagcctccaactcggggcctctgaagaactttctagatctaatccacagcagacttttgttcatagtttgtaattgtgaagataccatgcgtcctacatgaagtgggttcattcagattagcccctcccacagcagactgttctaaaacttagtggctcttctgagcggcccagtttgagagccccctgcctataagcacccttcaaggctgtgctcaagaaacgtaggcctcgcaggcaacaccgttcaagcagaggacaggccagcatctctggagtcacaggaacagagagaatgggagtcagacagagaaggctctaaaggctacctggccactgtccctgttctagccatcttgtgcaagcaagtggacccgtgggatggtgatggcccctcagtctccccctccctctccctctccccagcctatctgaagcgccgctatgggctcatcggcaccggctcggacagcgagtcaccggctgcgcactccgagtgccccagcccgtgtttgcagccccaggagttgagtctcatgcaggccaagaagcccagggtggtgctggcgcccgccgagaaggaggctctgcggaaggcctaccagctcgagccgtacccctcgcagcagaccatagagctgctctccttccaactcaacctcaagacgaacaccgtcatcaactggttccacaactacaggtagcctggcggggggggggggggggggcatacctgagatcataggtacctaccccaagttatcaatctatttggatcagactctagtttggcccagtgagatgtttgtgggggtcacccagtgtccatcagatagttgctatgagaaaagtgaccaaggttggggacaatgtggaggggtggaccctagtgcaaggttgctgcagtgggacagctagacagttcctcagacagtaaagacagaaccacagatgacatgcagggacgtgagagggtctcaggtcctgtgtgtggtcacagcagcattatctaccacgctacatgcaggtgaacctcctatccctcagggggctctgggcatgcatacctgtgggccctggggtnnnnnnnnnnnnnnnnnnnnctataggctggatccaccagatatgccaattctgtgatccccagctaagggaccctgagccctctcccctgagccacaggttgtaagctgtaaacaaggaccctggcgtaccccctagtcagtgtccacaggatgtgtttgtaaacacgtggcacagccagctctggcagtgtgactcttgtcactcccactccatgcagtggcctccaggaaggcacagatcaggccagggcctgaggcatctccagccactaactgagaccaaagggaacacctgtctaccacagcaggcctctggcgtagaggttcctctgtgcatagctcctttctttctttcttttttgttaaagatttattcatccatttatttatttatttattttatgcatgtgagtacaccaccattgctctcttcagacacaccagaagagggcatcagaccccattccagatggcatgagccaccctgtggttgctgggaattgaactcaggacctctgaaagagcagttggtgctcttaaccactgagccatctctccaacccgagtggctcctttctttttttctttttgttttgtttgtttgtttgtttgtttttcgagacatggtttctctgtatagccctggctgtcctggaactcactttgtagaccaggctggcctcgaactcagaaatctgcctgtctctgcctccccagtgctgggattaaaggcgtgtgccaccatgcccagctccttttttaagcctttccattctccaggtcaattctcaagaggtcccaagtgctgtgacttttgtgaggccacagagggcttcccgaggctgggccaggaccccaagaagggaggcttggagattgcaaagatctgagccctacccactttctgagcaagaaagaagtgtcaccagtatccgtgtggtactgtggaagagtctaaccatccattctggggcagagagaagttccaagatccccaagaaggagcaaaggagacgggcaggcacacatttccccctccccagcctgcttattagcagcgcacactccgtagctgtgtggctgtgggcacgtcactgacctctcagagtctcatgacgagtccacaagatgagacatgtcacccatgttacccgtgcccccccccccccttgccagatgaagcagccgcaggaagggacagcctcagcagagctttctccccatgcagaaccagaccgtcgcatgataggcgacgtggtcacctaacagttttctctcctgagtggcaatggggacatcaactctgcttctagaatctgtcacattcattcagaaacatttgtaacatgtgcactgtgagctgggctctcaaaatcagtgttcaaagccacccacctcgagtggcgcacacagctcgagtcatttcacctcagcctgattaatatggccaaagaggaggggggcttagggaaggggaactcttgcctctgggcaacatgaatgaagaagaaatccttgatgtggggcttttttgtttgtttgtttgtttgtactgttttgtttttttgagacagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagtttcaagccagcccaggctgtacaatgagatctggtctcaaaaaagaaaaagaggagagggctggcgaaatggctcagtgggtaagagagctgactgctcttccgttctgaaggtcctgagttcaattcccaacaaccacatggtggctcaccaaccacctgcaatgagatctgacgccctcttctggtgtgtctgaagacagctacggtgtacttacatataataataaataaatctttaaaaaaaaaagaaaagaaaagaaaaagaaaagacaggtacacccaggatcccagagctggggaagaagaggtaggcagtttctggggttcactggccagtcggttcagccagtggatgagtggggggggggggtctcaatgagagtctgactgtctcaaaagctgaagtaaagacctctgacctctatgccccacccccaacacagttaagaggaaataaggtgtatacctgttgatgaaggcacccacctgctcttactttccttttgccatgatcaaatactgagcaatgatagcttgggaaggaaagggttacttgacacaggaggtcatggtccatctttgagggaggttaaggagggaactgaagccacacccgtggaagaggcttattggtctgctcgggcttctctagttcatttcctaaggtctggactctcccattcaaggaatgtgctgcctgcagtgggcaggacccccctatggccattaacggtcaaggcagtctcccacgggacagtctgatggcggcagttcttcagttaaggctccctctacccattctttttttgttgtttgttttttttttgtttttcgagacagggtttctctgtatagccctggctgtcactctgtagaccaggctggcctcgaactcagaaatctgcctgcctctgcctccgagtgttgggattaaaggcatgcgccaccacgcctggctccctctacccattcttagttgtgtccgttggataataaaaaccacacatcacccagggttgacttttggcttccatgcacactcaatgcgcgcgcgcacacacacacacacacgtagagctcacaatacagatacagtggcagaaggaaatacttaatgctaagtccttagtgtttgcctagcacttggtgtgtcctggcactggagggagggaggcagacgctgccctgagcacctcatgatcagctgctgaagccacatagggtgacagtctacactgggctctgggaaggaggagcagtgggcactgttagagaacatgaccgtagacctaagtgtcacttggggagagggaggggtttacagccactgttcctgtgggctgagtctggggtcaccagccccactcaggccccaggctctcatccccccatctctgccgcaggtccaggatgcgccgtgaaatgctggtggaggggacacaggatgatcctgactttgacccgagtgggggtcccaatgtcctgacgccaggccacacccacagagagcccaccccacagagccccgactcagagactgaggaccaaaagccccccatgaagagcttagagctgcaagagcctgagggtcccctacagcgagctgccccagacagggctctggtgaagatcaaacaggaagagggtttggaggtggatggagacagccagccccaggatgtgggggatccagaccgagggcaagatggccccaaagaggagcatacccaccctctgggaaacagtgacctctcagagctggccccagggccctttctttcaggcacacccaatccagactgtccttcattgcacaacccccaagaaaaggggactggggaacaggttcactcagagcctctgagtttcaagtccacctccgaatcctcctgctgcagcctggaggggccaccgaactctccctctgtcatctcctcgccagacctcacgacatgtgtgtcacctgccccttcctcctcagcccccatctccccatccttacctggtgccccacctgccaaagtgccgagtaccagccccactggtgacacagccgcagccttgcaccccagcactaaggtgaaccccaacttgcagcggcggcatgagaaaatggccaacttgaacagtataatctaccggctggagagggctgccaaccgggaagaggtcctggagtgggaattctgaagctggggttgagggacatagccccagaggtcaccttccctctctccctccctccctctcccagatgtggtggggtccagagaggcaagaactcagccatgcagatgtggacaacaaagttaagccgtttacgtttattgttgtatcactagttacctgaagttgtgtgtgagcagatgccgccgcctcttctttctgatggccctgctcgtaggaggcgctggaatcctgccctcatcctcgcccctgtgggaaggcagggccaaaaaggtaccacattctcactcaaaaaaaaacaaactccaaactcttttagaaaaataaagaaatatttatagacctctttcagctattttaataaaggatcctttggaatttatccccagccgatgctgttttgatattagagagttataaagtcagatgctgtcactgctgtcgtggagcagacacagaagttgtgtccttttttttttttttttttttttttgccatgagatgagattaaaaggagatgattacgcaaagccatcacaaaacactaaagacggaccaaattcagagaacccttggactgcaagtttggttgatttttcttttttttttttttttttttttgccctcatgcctgactgtgagacatggcactatgccagtgcccttccagagcctgtgttgcaaagagaaagtccaaaagactctaaatgaaaacctgggtgctgctaaggatgggacagtgctggagggctgtctgcctcctccacatcacaggaggtcctagtgctggtagagatgttgcccttagcgaatgtggtatcacaaaggcctccactccctgagttggaagccttctatcccaaatgagtacagacaacgtgtctccagaaccttcagaaagctgtggggggtggggggaaggtgttctaagagaactgttaatgtcgagtggccctggctcccatcctgaattgtggctgcacttagaaggcttctcctatgatctgagccaggtacttcactccagagaacactgtggcttccatcttccttgtttccagaaagggcaagcattagtccgccgtagccccccaaagcttagcaaccagctccaaacactagacgaacccagtcagaaacctcaactccattctcaccatcttcttcctccgttggtgtcatccctggaaggtgtccacgggtctgcggaacttggtacggctaacatcaccacagcacagccaccatatccctgtctcttggtctgttctctttttctgcacaagatctgcttgggattgaagatagggcctcccctaacacagaagcaatctcttccagcatcctgattgtgatctccagcgacaaaggttcccattggatgagacagcctctgtatctacctttgaatctccagctttttccggttttttttttttttttttttttttttttcccaaacggtggaagttgaactggtgactgatgatgtacatgtggccatctctgtggccattccagtgcttgagggggaaaaaaacggccactccatgcagtgactatcatgtgagccaaaaggtttccagaaaggaaaaaaaaaaaaaagataaggaacgttccggaactttgaactctcatgcacccagtccaggctacagatgatcaacatcaaacaggccctggaaaacctccttttccacaccataatcctggctatgcattgagaagttttccactctatacatttttatccagaggagggtatttttatattttgacactagaaaaccaggctgagtttcctgaggagtccattctgggacaaatgaacccctgtctcagcctccgccgccccacctttcacccccccacccccgttgcaacacacccactgggagaccacgtctctttctgccttgaaatgccacattgagtcaatgtacgacacatacagagatgcggctcagcagaattcactgcggctttggctcgagtgcgatgggatcgggtgtgacctttgaacacagaaatctggttgtgcggaagtccatagatctgcaaacagatccgtccactccacatcctatagtggtttaaaaagagaaaatacacacacacacacaactgtttctatgagagattgatgaactttgtctaaaattttaaaaaagggggacacattctgtaaacacgtctctaaatacagaattgtataataatcctgggtgtccccatttgttctggagcttgggcacaagatggggtcagagttggttctcagaagtgttgtaaaactgactggggggggcatatttttgctgtgggagtatgggtggtggccttttttttttttttttttaaagacaagggctcactttaaagctctggctggcctggaactcagaaagatctgcctgcctctgcctcctgagtttttggattgatttttattattatttgggtgtgtggtgtgtgagcatggacacgcgtgtgaagatcagaggacaacttgccagaggtggtcctctttcattatgtgggttccaaggaatcgaactagggccgtatgtgaggcttgcataaccagtgtcttaaccgcctcagcagctccgaatcgtgtatatataaaagccaggcttttggatctcttgtttgtttatatatttatggaagaagagtttctctgtgtagccctggctggcctggaactcacagagatcccttccctcacccccaccccccagccccacccccgcctctgcctttagagtacttggcttaaaagtaccaagagatctgcctgcctctgcctctcagaatgctgggattaaaggtgtttcgccagcacagttgggtttgagagaggctcacatgacccaggctaccctcggactcactttgtagtgaagggtgactctaaacaaccgatcttctctcctgagtgctgggattataggcatgttccaccatgctcagaaaatactgcctttccaattgagtgctggtgttcaaatatgggcgtgtgttcctggagcgttgcagatgttaccttctgaaaactctaaactctggccgtgctgggccatgatctgttgcgacaacagccagctgaagagtgacctcctttgcccatggcatctgtatgatctgcttggtgatggagtgcggggtcccggctgctctgaaggcagcaggggacttgaaactctgtcctctgtagtgtggcccgagagctgggtggttaaggttgagccttgcttatagctgtggccataagccttggccagcctctaaacggggtggggagtaggtctgtgctaaaaggtagcactgctcattctcagctgtgtaatgcaggtctcagtttccacatctgtcaagtggggtgttacagttgtgactcagggtgcatcctggggcatgggtacacctgtgaagtgcctgaatcaggagcttgccagccatgtgaccatcatatgaagtggggctacttgccccgtgcctcagccgccactcaccgatgaaccagagcgacatgccgtgcctcagaccgttcgagagtccagaaacctctctacgaaccttggtttccacatgtccttgtgggggaggattggttgactcattatccccaccgtggctaggagaacttgtctgaaccccaaaggctggctcccaggcaggacacagtgggggtggggatgttgtaaggggaactgtcccgggaaggtgaccttgcaggcaagcccaggtatctctgagtcaaggagccagaatgtctggcttccacaccagcaccagttctgagagctacatgtcagtgagagagtgcctaaagctctctctgcccgtttccccagctgtaaggtggggatggctatatatttccttacctggtagctataaacttcagattactgggcactggccattctggtcccaggtcagcactcctaggaaggataagaatcagagtcatgggacaggatgacgaaagagatgtattctcgttatcccagctactcagaaagctgaggcagggggattacttgagtctagtcatttgagaagtagcctgggcaacacagctgaggcaacccccaagacgcaagagcaatagggcagggcagaatggactttgtccaagataacccactagggagctagcctgtgaccctaccctgagacacccacatgtcagccttaaagtcaggtcctcattgggtcacctaggactttggactctgtttcctcatctgtgaaatggctttggtcagagaacagtgtttgtagcccctggctacagctgctgtgtgaagctgcccacctttggtggctctcaatgcttgaggcatgagtctgaggctggccaccctgcctctaagttccctccccaacacacacaaaaaaaggagacaaaacacatgggcccagaaaccaatgtgtgtgtgttttgagacagggtttctctgtatagccctggctctcctggaactcactctgtaggccaggctggcctcgaactcagaaattcgcctgcctctgcctcccaagtgctgggattaacagaaaccaatctgtagggttccagaaatactgccctctctgccactgtgggccccgggccctgggatatggataacagggatgtaatgatgcaaggctctggaagtgctcagccagcagcccggtgtctgcttggccctctctcagatgtcacaaccatccttgtccactgggaccccagggcccacaggtatgcatgcccagagccccctgagggataggaggttcacctgcatgtagcgtggtagataatgctgctgtgaccacacacaggacctgagaccctctcacgtccctgcatgtcatctgtggttctgtctttactgtctgaggaactgtctagctgtcccactgcagcaaccttgcactagggtccacccctccacattgtccccaaccttggtcacttttctcatagcaactatctgatggacactgggtgacccccacaaacatctcactgggccaaactagagtctgatccaaatagattgataacttggggtaggtacctatgatctcaggcctgagtgttccgccatccccagctgccccttagaatgttcctgaccacaccgtgcctcaagatacgttggaccttgcctacataaccgtagtaggagggcagagagggatgtcagcattgactttgtccccaaggccacctgtctgtcactccaaggagtattttgataaggacacacctgtgacactgcctcttggagcagcctccccacaccccccaatccttctacttccccgatcctgtgcccaggagggactgtagtcaccagtggcctgactcagttggctgtggccccaggcgatgggaggacacggtatgtacactcagcggcacatggtcccctgaccatagtgaatttgaacatgagttacacgtggcttgctcagatccgaaagtcccggaattaagtcccggaaggcacttgatttttccaggctgccaagggagagctctggcacgtcctgaggctacatttggaagtccctgggcttcaaccatcatgctgggctaccctgggcctgccccttcctttcccttcccttggcttggaccccttcccattttacatacctcctccgaactctcaggcgactgggcccggcccacctgtcaatcatcttttcatctttctttaggccctgtagtccaccatttattcccgaggtcatccagctgactctccagctgtgcggccttggcaacctctatggacctccacccccctacacacacacatacacacacacacacacacacacacacacacacacacacacaaagatgaggctagcatcttccctaagaggtgctgagactgcctagctagaggacaacaatccctcctttctaggaccccgcaaaatatatcaactgtggattctgcagggagaacaataatacacccagccatttctcgaccggcttttattttggccctcataccctgtccatgattgataactctcctagccccagaatcagctggtgttcaccttgtgctttggggagagggaacaactctgcccttgtctcccccacctcctgccccgtacctttagagtttgtaagcccgtcccagactagagtctacacctcagccgtatgactccagtgggagagttgaggagacagaccaagtccccagaggcaccacctgtgcagacagctgagctcaggagacagagggccaagtcagggccaagtcagctaggcgcccgtgtgtctcctgcgagggcctggctccctggagacaatgccaccccttgcagccaacagtaacaaaagtggcaggggtgagactggactacttaacttcactggtggaagacagtagcctctgtacttcaaagaaaaacccacagccaagtgccctggcccctgagccagcagagagccaagaggccctggcgacagacagaagcacccatgggacccagccaccccaccccccagaggagagggaggggccagggtgaaatctgttcataggatgcagcgattggagtgtcccctcagggcagggcactgaggaggactgtaaacaagaacccaggtggggccggctgtcctgcccaaccctctggaagacagccagcactgtggtgagagagaagtaggcccagtcctgaggcccactggtcacctgcagtggctagggacagtgcctgggctctccctgctgcaggcatggaatcagtcggaggcctgtctcctccaggtgaaactgggaggaagctgggtcccaggccaggaccgaggtcaggggaggccctgcttctgcccgggctcacctacaaagctggacacagtcctgacttagctggttccaggccaggagcctgggggacctatccagttcaagtcccacattccacctactggtgtaggcccacagcagcccagacagcagcttccaggttcaagctttagatccttgagaggcaccaggtaaaccctgggccccatgggcctgtggccagcttcggggctgtcaaggtcacacaggccaccctggcgcggagttctctagaaaccagctccttgggctctagaagcaccctcaggttcacgttccagattcttctcagaagtaagtgcctctgaccccaggggcacaggtctcctgagtcatatgtcctatgtcccctgggagcctggattgcaaacaggccattctacggaacggaatacatgtaataccttacacccactatgtccccttagggctggctggtcctgggtctgagtctcagcagaaccaggatgccaggggacctctaagctggctaggccagcctggcctccgcgccactggtccctaagggcctgcacctctagtccatatcgcgcatgcagctgggcgaaggatgccaagggcccgttggccgctgaggccctgcggcggggtggcagtggcggcggccgctgaggggctaccgagggctgctcgggcagcgtgctccacactacccagccgttctccttgggtctctgggtcaaaaccgggctcgggttggcgggtaaggcgttggcggggcttccctcgcgcatggcagccagttgctgttccagctcccgcaccaccaagcgcagatagtggaagctggcccgggacagtgccttcacccagccctccagggctgcctggctgtcagcggccagcacgtacggccgggatcggcccccggcaaagcgcactgcgaaggcgaactcctcccgggcatccaccagctccaccgtgcagccctccagcaggatgacgcccagcggctcgcggctgccttctgcctcgaagtaaaagaggatattgccccggagcacgaaccagcgccggtgcgagccggtcccacggccaccacgcttgtacaggaagccggcgttgtccaccggggcatcgcaggttgcgtagaaggccaagctgcgctcgttgagcttcatggtcacgaggagctgcaacctgtcccctgcgcgggagcagatgttactactaggatcatccaggactcccaggccaccagcagcctcctcccaccacacccaccccaaggcccctcagtgagcacagtgagacaggactcaaaccaggatctcgcacggccatctggagggctcctgctgcccttgaccagggaaggtagcattaagtgtcagctcaccagacattttgcataggttagctctatctagcaatgaccttgggtggtgtgtgctggttttatgtttgcatctgtgtgtcagtgtcagatggggaaacaaaggcacaacctttgtcagccaccaagcaaaggtcacaaaacaagctgactagagcctttgctcgtgcctggagatcccaggtctgtgactcagccttggtttgtaggtcaggttggtgagagagggagctgtagggaagagcatgagggcgcgaggtggggtgggtgaggtgagggggaacaacatggacagagggacaacaggatagggacaccacagcaaacacaaagttaaatcctccggctgtggagagggtgaccagaggagggcaggagtggaggaaaccccagagtaccggagcaactgttggaaaataacctagataaaatgcaggctcagcccagactgtcagggcggaagggacagggcgccctaacatagacctcccgaaaagtacacactggggcagcagcgggcagtagggcctgtcggggagtggcacgtgggttaccagtgtggccacttggaggaggcaggccctgcacccgtagggtccccgtcacagccttgcttcgtgcagatggctggcatacttttgaagagcctggaatgtctgtagcaggcaccccactaacacccagcccctctgcctgtgccgtgctttacccttggtctgcagggatgaggtcagggtggtggctctgtagggccaggctgcgccacctgacctgggtggagagagaaactgctgccagacaaatacttaatttttgccacctcatgccacccacgttacagttggggacagcttcctgccagatcagaggccaagacttgtttggcccagagcattggggctggggcctcggggtcctgaaggctcaggtgagtttaatccctgctttgcctctggctgctgtgtagctttttatgccagctgcacctctctgtgcctctgtttttctctgcacaagggactcacacacccctcccaaatcaattgcacgagactgacaggcctacttctcccagaacctaccacaggctgcccacccagttctgctcaatcactttgaaggtcagctcacagtctccaggctgggtcacttcaggggcacacagtcagtctctctggacctctagctcttcatctataatgtaagagcaaaattatccacgtcaaggttatgacaatgagacagaacacagggaaccagggcctctggccatggcagcaggtgacggtgtactcggcttccttctagtccatcctgcttcagcaagtggcccctgctgtctctctcacccccacatctaatcactgaggccaggtgatcctcccacccctggctgtcttctaacacatagcttgtttagctcccatttcaagatccccacctaagtttgctggaggcaccgcaggcaccctccccagctgcctccacctttgccccttcctatctggccgcctcaaggtaagatcacctccctagggccctcccctgggaccacagcgggactcttccctcctgtgacttgtacctgatgcttagcccagcccaaacccccaatctcagctccttccccaacctctgcccgcctttgtcagcctttgtcagcctttgtcagctggcctcagccacctggctaccttgctcaaaggcaacaaacattttcttccctgaggtgcctttccctaccacaaggcgggctttgccgttgcctaggaggaagcatcctctgaccgaaacagaccaccagctggggattacctgcgtcagtccagagagggggtgtgggggcttctgtctggctttgagtgtccagtgtgtagcctgtgctggggagcctacacggcaaagcaaacctttgtcaacgtgaggactgtgacaaggggtcatgcctaatcgcacacttatagatgtgggaaaaaatgacctggccaaagaacagagctccacacaaacagccccatggggcagaaaccttggggtccttcttccccaccaagactgacaatattacctggtgcccatcagccatcctcccccaactgcccagatgggggcaccctggccaaggtcaccagcagacagaaggcccagccaggtccctagcccttgcctgctctggctcggcaaacaagcaggctctagcttccccttggagggagggagtgctccctgctattcaaccgtctctgctctgttcaggttcaaagtctgctgagggctccgagctacaagcaacagggtctaagcacgatgctttagggaccaaattcttgtctgggctggcccaggccggaagcccagttaccaacacttcccagacctcagtttgcctcaatgggcttcatggaggcaccgatgagctaaactaaggacagcctgtgacaaactatagggggaaagtattctaaagcaggcgaaggcacccaatgtggcgctcacacctgtcattccagcacttggaaggcagacaaaaaacgccacacatgccaggtatagtggtgcacacctttgatcccagccctcgcgatgcaaagataggtggatctatctgtgaggctagcctgttctgcattattgagttccaggccagccaagggtacacattaagcttctgtctcatttaacaacaaaaccggccgggcgcggtggcgcacgcctttaatcccagcactggggaggcagaggcaggcggatttctgagtccgaggccagcctggtctacaaagtgagtcagggctacacagagaaaccctgtgtcgaaaaaccaaaacaaaaaacaaaaaaacaacaacaaaccccaccaaaaacaaaacaaaataaaacagtttagcggataaagacgctggctgtcaagctttctgacccgagtttgatccccagaaaccaagtagaagaaggaaagcccggactccccccaagttgtcttctgacctccacacacgcacacgtaaacaaaagtaaatacataaaaaattaagacaagtgatgagtcctccattcgtggggtcacagctggccccgcggctaggactcgagggaaacggaggcagggcatcaccaccgcggaacctcaagcccccgtggtgcgccggccgggccgcgatggaggccgcgggcgggtcccgggcgacagccgcgcggctgccgaccccgtcgcggtcccgtcccgcccggctttacctggctctgggaccggcgcgacggtctgtcctgcccatggcccggaacagctcgggggccggcgacgacagggccctttgtctcccggaggccgagtggcggcgacccgcgggcgcccctttaaccctgagcggcccgcccaggagggggaacgcctccgagccacacgcgcctgcccattggtcagccctgcaaggtcccgcccccgaatttaccacgcccccacacgcgcgcctgaaaaatccctcttaaagggaccgtgccagggtcgggagttcccagaattcggtcccggagcaacctggcgagacggctcaacggcgcttgtcgccaagcctggggaaatataacgtgaaagatgccagggaaccgcctcccaccagttgtcaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaataattctttttttttagatttatttattattatatgtaagtacactgtagctgtcagtgctcttaactgctgagccatctctccagctcagtaaataattctttaaaaaaaaaaaaaaaaaagcacctctccatgatgggccgatgagatggctccataggtgaagacgcttgcccctgagactcactgcttgagttggctccccaggatccatgaggtgcaaggaaaaaatcagcttcccacagttgtcctaggaatttccaggtgtgtgtgtgtgtgtgtgtgtgtgtgtgtgtgtgtgtgtgtattgtgggaaacacaacagaaaagaaagcatattttaaaactccacacggatcgggccggggagatggtcgcttgccatgcaagcatgccgacctgagttcagaagcagagtccgcagaactagccaggcaccccgatttacatctgtggtcccagcattcaggagctggggacagaaggaaccatggggctggccagccacaaagtcttccctgggagctgccccttaacaaggaactggtatgattctccatcgctctccactggcctgggacaggaaagaccagagccctccacttcaggagccctcttctgatgcacgcggggagccatcacaaaacagacgtatagggacctgaagacctcctccagtggtggattgggatgtgcaagtgtaagccagataaaccctttcctcctcagctcacttctggtcctggggttgcatggtagcagcggtggccctgactagggcagtggggtgctggtctctccctcattttacagatgaggggattgaggcttaaggaagttgcagacctgcccctccccacctccccttcctccccaaggctgctttcaccagcctggaatttagagtcaccaacttccaactcagacctgcctgccattttgcctcaatgattcatggtctccagagtgctttgttcctgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagccagcgctacccattgctttacagcatggtatgatcgcttatggggaagcagatgaacgcaagggccacgtgtgactctgcaacaccagccagccttatccgagagagtagaatgccagctccatctgtcctggaattcaggcaagggaatgagtattgcttacaagtcacgaccactttctgtcacagaaagctacacccctcccgggaactagggctgtctttaggcggaggtcacgtttcaggtggttttgaagggtgcgtaggagttgaccacacaggaggaagggagaagcaatgggagaatgagatgagttccttagccagggcatggctgcttggcaagtacttgatgagtctgaggtaatagggagctctggctggcacatagatagccacctgcctctgcctcctgagtgcattgatgtaagcctccatgcccagcttggagttctttcttatcctggctttacgatgaggaaatgaaagctagaagatactaagtcgctgggggcgtggctcagaggccgactgggttgccaagccggtgcgccaagccctgggatcccgtccccaatatcttcctcctcccctcagtcttccctccaaagaaaggggggtgaatggggaaccagataaatgattgattgtttgtttgtttgtttgtttgtttggaagagcgccttctgagggagagaaccctcttgaaacccaggttttccacctttggtggcgctgaagccggaggggaccgggtctctcagggcggcaggttgcagttgcgctgccgcccatgaccagcagagggcgcgcgagcctcgtgcccgctgcagtcgtcaggcacccgcccaggaagcgcgcgtggatccgggagaggaccggagtctccgagctgcggagcaattagggtcctttaattaccgggattggaagtggacgagcctcgaggggcctcggggcactgagtcacttccccagaaaccagattcccagggccggcggaagagagggcggctgcacttccctgcgccgggtgctgcccaggactgggctgaagccaagaccaggacccacgggggtggggcatgggcagtgggtgcaggttcctgttggccagtccaccgctttgcggtcttggcgagggttcctgcgtctctgtgcctcagtttcttcctccatcaagtggaatagagcagcccccttcccctgcatactgttggccaagcaagttgtgagcccgtggaaaaccctccaaattgtttctgcaggacccacgcgaggtggcccacacatataaacccagcactcaggcagaaggcttcaagttcacagccatcctgcgctacttagtgagttccaggacagcctaggtcagcctcaaagccaacacaaacacttaataatcattaattattctcctatcgctgtcctttatttccagcgctgggtacagtagatgagagagcccccgggcagagtgactgcttcaggccctctgtatctctgtgaccttggctctgggcctgtttcttcataaatgtagggcaaataaacaaacagccccttccttcacagcaggcatggccttggctgggcgcacagagtcgcggcatgacacctgactatacatgtactgagcagggacttgtggcagacttcacgtggaagggccacggagagcacagaaaagggaaccctagccccagagaggaagcagcggggatagatgaagcctggctccttagctcagcagatcagatccacaggagtccttcttgggagttctgagtacagaagctccagcagatgtgcgtaagctacgccaaggccaaagctgccctctgagcctctttcagccattgctgaatccaagtatggggagcagattagataaacaccatagaaccttcttaagctctgtattagctagcaattgctgtgtaacaaactgcccccttccccgcacccccaacccggggtcagtcgtttcataggcaacagtctccttcactgtcacaaggtcttggaaattcagataaagttttcctgagttgcgactcaaggtcatgaagtagggtggagtctcaaacggaatccaggcttggccgctggatgtttcctgtaacgctagcagttggggaggctgaggcaggaggatcaggagtttccttccggtcagggtcatggcacctgtgtggaggtcaggggacaacatataagagtcgattgtccctccccttatgtgggtcccagagatggaactcaggtcaccagacttgacaccaagcaccctcacctgctgagtcatcttaccaacccaaaataaaacagagaaatcttatttttaaagattttaatgtcatgggtctgagtatttgcatgtgtgtacctgcagaggccagaagagggcgttggatcacctggaaatgtagttacaggttgtaagcagccatgtgggtactgggaacctaacccaggtcctctgcaagagcagccagcactcttaactactgagccatctctccatccccataaagatcttcttaatattttaaatttatttttttgaaaatttcatacatatgtaatttctatttttttctcttcataaatacttctgtttgagacaggtttctctgtgtagctctggctgtcctggaactcactttgtagaccaggctggcctcaaactcagagatctgcccgcttctgcctcctgagtgctgggattaaaggcatgtgccaccaccactaccaggccataaatgctaatttttaaaaaggagctggaaatccagcatgtggcacatgcctgtcatcctaatatttggggtgctgaagcaagagggttaccatgggcttgaggacaacatgggccacacaacaagaccctttgaaaacaaaaatcaaaagtgggggctattgggtctgtctttggtgggaactcttaaggtctggctaacccctcccaagatggcgtccttccacatctgctcaggcctggtggcctgtggcctcttcatgaagcagtgggaatgtccatgctgaagaagtcctcctgtgtctgcctgcccactgctggaatattataagtgtgccagcataccagctgtatatttaatttatttttcagcacaaagcctcaactatgtacttctggctggcctgggactcagggtgatcctcctgcctctgcctccagagtgctgtctttacgcttgtgagccatggtggcagcttgagttgcatgttttaattaacattaagattatacgtacagggtgggtctggaggctcacacctgtcaatgcttagcaccggaaaggcagaggctggagaatctcaagtcggaggccacctgggcaacagagcaaagttcttgtctcaaaagcccagtaacaaagccaactctaatagcacgagctgttaccttggctactcagaaggcagcggcaggaggatgctgagttgaatgccttccttgaccaagtctcaggctagctgggcaaaccaatgagaccatgcctcaaaataaaaagtaaagagagtttttttttttgtttgttttttttttttgtttttttttttttgttaaaagtcctgggtttagccgggcatggtggcacacgcctttaatcccagcactctggaggcagaggcaggcagatnnnnnnnnnnnnnnnnnnnnnnnnnnnnnnnnnnnnnnnnnnnnnnnnnnnnnnnnnnnnnnnnnnnnnnnccaggtctatacagacaaaccctgtctcgaaaaacaaaaacaaacaaataaaaaaagctctgggtttgtgaccaatggtatacttcaggtagtaggttctcatgtctttttttttttttttttttttttggttttacaagacagggtttgcctgtgtagccttggctgtcctggaactcactctgcagaccaggctggcctcgaattcagagatctacctgcctctgcctcctgagggctgggattaaaggtgtgaaccaccaagcccagctttttgcgccaccacgcccggcttatcttttcttttttcttaaggcaggattttactctgagatcctggctagcctctatgtagaccaggctggccccaaatttagagtgattcacctgcctctgcctcttgaatgctgggagtaaagacattggacacacacacacacacacacacacatttttgagacagagtatcttactgcagtaaccagttggatgggtctactagattggctgacccacaagccccactggccctgcctgggttttacatgggtgttgggcctcgaagtcaggtccttaggcctgcacaccaagcactttacctatcctgccacggccctggtcatatctggttaatgtttgttgcttggatcattgacttactaatactcttggctctggttagctttcattggtactgttcagttggtttgatttgagacagcgtctcatgtagctcgggcaggtttgcaactcattaggtagccaaggctcacctcctgtctccgctgctaagtgtctcagcctccagtcgtccagtgcacctggctgatattttgaccctgaccttgttgatttatagaacctgctagattaggcttggttgtacttctgacctggccacctgggtccttgcaggtggacctggggtgccgctgccctcagcaggaaggaagggcgggtggcccggcccctggaagtggacagactgcttccggcagtccccgccagccgtgggaaccggcgtcctccccaccccccaaccccctagccctgctgggtggagtcaggtccccaggggcgcagaaccccggggtcgtcgctgctgtcaccgcagggtcccgcctcagagtcctttgccctcggaatgagaaacacaaataaacagaaggctctgacgtcgcagggctttcagggaacccggactggggcgggccccgccggggcgagaagaaactgagcgcgaggaaggaaacgggtttgggcctcggagaaatctggcaggcagggctggcctgtgattaaaaagaggaagaaccacaagtctccatttaactcagcagagctgcagtcggctacgagagggaaagtgcttgcggctggcagattgcagccaccatttggcaaggactgccaatacctgatgctccgcgcgcgcgcgcctcctggccccggcgaggctgcaggtacccggcagtcgccccaggtgtcgtagggagcgtgctacgggctaaccaagctagtctccaccgcagccctccttaggtgctgcgtccccgaatggggacacctacaccagcctctgtggcagagctcatctgggcctgctctttctcgcgattcttcatagctccccagtgccctcaggaaggaccctcccttccctgagaaaaacaaacaaaaaacaaaccaaacctgactctgcacctagacctctaaaatagcacgtgttccttcgttgtaggtggggccattgctacttttctaacaaggcactttagagcctctgcatttggcgctgcattgactgggattgccttcccccctcatcatgtgggagatcgcagcttaaatattactcaaagatttctcttcctgtgtcccaaagacaactccacaacggagctgtcaccgatgctgtctcccaaccagagtggcgcccccacgagggaatcactaactgatgtccacaaacaccttatagtgcctaagacattgccttggctcgttttttgggggtgggtgggtgggggcttcttccaagccattttgctaccaggctccagcttgctgccgtccgattgtagtggaaatccccacctacgggggagtcccttcttcgggctccaacagcaggcccggggactgaattcagcccggttggttaggctgctctaatgtgagcaactcacttcttccagtccctgagtgggctggagacacgtgttatttccatttcatagatgaaaaaactgagttggagggggtcaaatatttggtcccacgcagcaaggggaaggctccagggagccagcggctcgtgggagcctgtcgtctgggaaggcttgcagtggcccctccaagctgggggcgtgggcggcctgcttcctgttgggggagggggaggggacaggcattcctctttcccctccctccgtagagtcacggggaagactggcgtgcagtgagtgactccacttcagaacaggggcaccccactgttagccaatgtggcgatagagaaaaggtaaagggctaaggggcgcgcaggcgtggacgttcaaagggctcggctgcctgggatgcgaaggagctcttggagaaagtttcatcaagctagagaatgcggccgggcggccaggtagagaacagcctactcggcccgttccgggactccgaggaccttaggaggggagcggacttcaaatggatggcgccgcggaggcaggacggctcggcggagtcatggatagtggggccagggtggggctggccccttcccctggaggtgatgaaaaccgcggtcgcagttgctagacccggccgggcaagctcagataaggttgggcttggagggagtccgcaggggcgcgcccctaggaggtcccgaaggtcggggcagccacgcccatcgcgcgcctagccccgccccaccccttctaggggccccgccttgccgaggcacgcggtgactggccagcgcgagaggggcgggaccgagcacgctcctccccttcgagattctttattttattattattttttttcccttctttagggggcgcgacgcaacttgggtgcagagagcgcgccttatgggggcggagcttgtcgctatgctacctcccaccgggcagcgggcggaggcgcgagaggagggcggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccgagccggggtttcctgcctgagcgccgagagccgtgcgacgccatgggccggccgggccccgacccgcagcttgcgcggtaagcgcggcccgccgagcgtgttggaggaactgggccgggcggccgtccccgggtcccgcttctgttttctggcgtttcctcattctgtttctcttccccaatcccagaccgcagtgatgtgggcgcggaggtcagtgctttcagctggggcctccggagaggagcctggcggggcgccgcgggaggaaccgagagctgtcccggcacacagcgtgcttgggcccctgccgggggggggggggtgtgctggcggtgagggtgggagggggggacacgtgtgtcactagtgccccggtgatcaaccaaggatgatatgcggagtcctaaaggtgaaatcagccagagatgggggaagggggtgggacaggccatgacaggccagggcccgctgggggaagttgaggttataagagttttatgctcttaggacactttctgaaccttgttccccaggcctcctctgggaggaaacgccatctgagccaggaggggtgaatacattctggaacttgtgcagtcccaatgggtggtcagctgggaaggggctggcccgcagcagcggcagcagctgtggtttggggatctcaagggctgggcagtgacaagagaggaaaccgagggtcctagaggcagaacttgtgttctttctcctctgctctccaagatgagggtcgcgacctcagtttccccgctgttcagtgagtgagaagagatttgtggtgcagttacaatgaggtggagttttaatgaatgctgtgtggaaggcacctgcgtccggctgggagaagggctcagttacaggccgttgggagaagacctcagttacaggccgttggttttcagactgtccagttttattgaccctggccctgggaccgtcctcggctctctcctgagcatagctgctctggggtttcccgagtctgtgggcagggaactctgaaggaccctgggcagggtcagatgacaaaccccttcctggcctgggttccctcagttgacacctaacttgtgagggccaccagagcacaggatggcttgatcaggagggcaggcagtcatgacaagggtgttatctgttttgttgaggtcatttgctgctcctcttccttcctgactctctggcaccaaatgtcacccagtgcctggtcctcatcgttcaaaatgttcttagagaagtgacggtcctttcctttgagtagctgggctgtgccatcagcttgtgtgcctcaggctgtctaggctagttgggccaccatctggtttctcccacttctgcgatagagctgaaggtgcttgggagccccttccggctgcctgggcctgtatcacaccctttccagagcaggtctctgggggtccagcccacattgtgaggctagtcagctgctgaatgtcccattgctgtgactctttgggtgggcacttctgtgaggcaatgaaaaagtcatcaagagcgggaagggttttaactgctggcacgaggagatgggacagatagtactgttaaaactaaaacgagaggtctttcctttcaagtcctcatttctccctggagcagcacttgtgtggagactaatccagactctgctagcttcaggggtgaggccctgggcaagttacctgacatctcttgggacctgcccagtgtcagccaagtcttgtgcctctctaggtggttgtgcactatgtaggagcccaacaaggagaagacatttgaagcaggtaggcagtaactggcctgactctgagatcttaggcttgggttgtgctgtctcagagttacaggtgtttcttggaagtctgaagtggaggtgctgaaggacagagtcggggagaggcatgcagtattggcatgttagtgctcaataaatttaagctattgctattaatccattgctattaatccaggagtggctggcccttaattgccaggtttcctgggaaaacggtccccagggccccttgggtgttgagcatctctggttgggcagagcaggaagcagcttccatctggagtttctggaggggctgctccttcctgccaggcctgttcccggccacccaccctccccgaggaaactgaggctggcacaccgcttaggggaaatgactcagtgggggtcactagctgagtcatacctagttggacccaggagccttgcaccccagcttccagcttccgggggcttgaggtccttcagggaccgggtacacctcaggcctggttgcatgcccttgggcactgttagacaccacctgcttgcgccccatgatctggacaacctgtgtctcttggtcagtgatctagggatctcagtgacgcccccgcccccacctcctgcattgagctctccagcccagtaccattctcattgggacaagagacaagtccctaagggacctgatggcctgccccgccctggccagccggaaaccccagcagctgagcagatggctgaaagatttttcctcccacacaaccctgtcaagggtcggcaggggggccagccccctggcttccttgtgagccagtcctggagccccttggggcctgtccggatgtgccccccctagctgctgggggggggtgcagcttggtctccagggaggcctggagggaggaagtctgtgccctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctccctccctcccttccttccttccttccttccttccttcctagggcttctctgctctgtccctgggttattgcaagctcagcagctgcgctttatcctctagcagtggaaagtgttgtcagtcactggaggggaccagctttatgctgcctagcttccctggccatccagcctggggccacctcacccggggatgccctgtgttccatagccctgctccccacactgctgcctcacccagaattgggtccctccggaggcttgggccttgctgggtggcttgactcacctccattgtgttaagtgtcagcgacaaaccgcacagccactctcttctccagcctatgccaacctaccacagctcttagtgccactggggttatcaaagcctgccctgctgcccctgctgcccctgggcagagttggatggaggcagtccctaaggctcctggggtaggtcttaagggtgctctcttccttccagggatgttcctagagtcccatgttggagttggagtggctggcatgtgacctgaaactggagtgccagactgccttgccctgttgccaaggtatctggggtacttggtctgagtgcgccttgggggtggcaggtgcacctcagaaaggtgaagatggatagggcactgtggctgattggagttggtgcttgtgagcaggctggttgggatccatcccctctagatggtggccgggccttgagtaagcccacctcccatgcttcgtttccctatctttgacttggccttaaggactggacacccagctacttcccattctgggagccattttaatgtgctttgttggtaggttacaactgtttctaaacaggtggagggtttgggctgtgaacagggctgaagcagtccttcacattgctggctctgggctgtaagctctgtagggtgtagggagcaagttagttcctgggggtgcatctgggcacttccgagtgcctctgtgagtgctgttcctggtaccctgtggtttcattcccacaccataggggttctgtgatgcctgaagttcacctttgcaggagtggtgggtgccacgtgagggccattagagtgagcacacagccgggcctggcatacagagtgactaggcacatgttccaggtgaagggggatgtgtggacagagcacagggtgcccagaagaaggtaggctaggcaagatggtggctagtggatgatgttggtcattaggcattgtatacaggcggttgttcttagactggtgaagcttagttgggagggtgctttctttagcatgtgggaaatctggggtccattcctagcaccataggaacctagtacatgcctgtaaacccagcactcaggagctggaggcagaaggaggtcatcctaaagagaaaaaatattccttattcatgccaggcctgcaggaggacagggtacacccaagtccagtttgggctacatggtaagacttaagtttttgtatgtgtcttagaggccctgctgtggcaggagagcaggtgtgctctgggtctgatggagatggccactgacaaatcctcacagcacttcaggactgtgctcctcttaggggtgatgagtgatacaagaagacagtccagtggccctcgcagtctacaatggggctgaagttatgtgtgcactcagctgtgggtcagccaggctatgaaggctgcgcctggctctcctgtgccaaagcctggtgtatggcgatatggcactgaccaaggctgggaatctcccagggagtaggtgctctccatggggagggggacagaatgagatgggcctggttaggtttagtctatttcgttcttactcctggcttttgctgctgtgtactaaggacctgctacgtgctaaggacctactatgtgctatgaaccttatagctttgtggcatggtatgcaaagtactgacagagtacagagtgcctcccagtgagttgacaggcctttgcattagagttgaagtgtcctgtcaggtgctggtcacccttctttgtctgttttgggtcttacagagcacagaccacggagggaaaagtgacttgtagggcaggaacagcagagagagtccacttctagctcctgacaaatatttaatgagtgggaaactgaggtgccacatggccagtgcctggtcctctttgcgttgagctctgggttgggggacaaggcttgtttgtttgtttgacaggtctcacacagcccagggtggccttgaactctttgtagccaaggttgatcttgaactctggatctttccagtcctgggatcacaggccaccgcactagctaagattttaaatatctcacctgttcaccgtgtatcccctgggcgcactacagtgcatggtacacagtaggccctcaggatattgtggggagtgcctgagtagatggaggtgggtcttgtacacaggttgctcagtgcttatcctgaccagacaacacagacatcctgactgacttgcatgtgtgtctcctggagttctccatcaagcttagaggtgtttacatccctgtgtagagtctggtcactacaggctgcttttcatctgtgtgactgtccccacactcccaacattttctctatgaggacagtagccagtcacattgaacttccccagattttttttttttttttttggttttttgagacagggtttctctatagccctggctgtcctggaactcactttgtagaccaggctggcctcaaactcagaaatccacctgcctctgcctcctgagtgctgggattaaaggcgtgcgccaccacgcccggctacttccccagattttaagccattcgtaattgagtctttctttgtagcacttggaagtgggcagggtgagttagttcctctggcatggaaactgaggtggagaaccatgggaggtcactcaggatgacctagctgctgagagtgggcttcagagtccatgctctgaccatgctttctagagctaagtagtactcctctgcttcagtcatccccccaaccccaaatctgccttcacagtcttccatttcagcatgggtctgcccttcaggcttttcttgttcaccattaggtgttcccttaacaaatgtggtcgcatacctgtaaaaactagctggagaaacacgcgagccttggtttgtgtgcagagtaaatagttcctacagggtggagggtgggttcgagcctggagctccctggaagaggtggtagatagccccagactcctactaggggacgaaccagggtccttgcgtccccagctttatctgctggttggggttgtcaccaacagcagggagctgtggctctgggcctatgagcaagtgtttacattaaaacctttttttttttttctccaagacagggtttttctgtgtagttctggctgtcctcactttgtagagcaggctggcctcgaactcagaaatccgcctgcctctgcttcccaagtgctgagattaaaggcgtgcgctaccacgctcggcaacgttaaaaccttttaattgtgggaaatgagtctaaaattcctcttgtgagactgtcccccacagaagcagctgtactgctttagaacacctaagcatgggcggtggagagcctgtgttttagtctttacaaagcagccctggctatcctgtcagttttcacttggatatgctgtgaacagcctgtttcccagtagggagttcccttcatccgaaatttcacttcatatggtcaactgaagcctgaagagactagatggaaaattattgaaaacgccaagcatggctctgagtggtgcacagctgagcccccttgaaggaggtagcgcctctctggtagatctcatctagccactgtatccaccacgtgggagctgcaggcccgcttgcttgctggcttccacgtgctgggtgttcccgggtggtcgctggggcggggatgttctctgggctcattgctttctgacttgtcttacagcccggccgccccgcctcgctctccaccatgaacgagcccaccgtgcagccgtcccgcacatcctccgcacccgcctcgccggcatccccacgcggctggagcgacttctgcgagcagcacgcagcagcggcggcccgggagctggcccgccagtactggttgtttgcgcgcgcgcacccacagccgccgcgcgcggacctggtgtcgctgcagttcgcggagctcttccagcgccacttctgccgggaggtgcgcgagagcctcgcaggaccgccgggtcacgactaccgcgccactgctccgccccgccccgcgctgcccaaggcacgcagctccgaggacctgggcccgcggcccgcctgtgccctgcagcacctgcgccgcggcctgcgccagctcttccgccgccgctcggcaggggagctgcccggggctaccagtgacaccaatgacatcgacaccaccgcagccagcaggccgggcccggcccgcaagttgctaccctggggcctgcgagagccgcccactgaggcgctcaaggaggtcgtattgcgctatagcctggcggacgaggcagcaatggacagcggcgcacgctggcagcggggtcgcctggtgcttcggtctccaggtccgggccacagccactttctgcagctcttcgatccgcccaaggtgagcacctggagagtgtggtgctacagcgtgcccacagcttcaataggtaccctgtgggcccgactctgccaggacagtgagtctgcgaccccggagagttgaaggactgtttgtgctgttgatgggttggagcatattggttcaaagtctttgaaagtccagatatacctaacgtggacattggagctttcaggaagtccatgaaggctgagtggcatacctggtatgccgactctgcagtttcttttcttttgcttcttgctggcaaatgaggcctagggtctcagtgcttcagcttgcagctggcatccatccctcctgtgtggatgtgtgaagcctggctgcctgctgtcatttcatcttttctctgtggtcccattttgtgtaacagcttggctgtagagtaacagtgatgtgagcccaaccccgaggcactactagtaatattcaggcatatgctttgcaatgatcacaggccagataactacctactgtgtgctaagcacacattacgggctgggagctgtggaaggagtaagccccaggaacatgcagctggcactgttgcagcagaaaggcagttgggtgtgctagggtggcaaaggtcttataagacatcttccttgccagttactgctaaatgggggtgctctgagtttcagtgtgtaccttcaagtgacccagaagcacacacatttccccactctctgccttttctctccaggttggatatatggttttgtttttgagatagcatgttgcctagcctgctcttgaactagctatgtagaggctgacctgaggtttgaacatgtctacctcctggctactgggattataagcatgtcccaccaggccaacttttgtggtgctaggtattgaacctggggcattgtgcatggttagcaggactctagtcaccagcttacatcctcagtccctatgtgtttacttttaattgtgtttatgttatgtatgcatatatgtgagcatgtgtaagtgcagctcagaggccaaagggatccatccagtaccctgatataggtggagttataggtggtatgggtgatgggaatggaactcaggttctcttccaaggcagtagatgctctaactgccaagccctctctgcagtcctgtgagttcatcttgtttggtgtgctcttcagcaccagcactggcccgcccgctgttttactgatacctgttgctgggtggttcggtggtttccacttcaatgccttcttccccatggatagggacttgcttcattggcctcccaagcactggcgccatgagcatctacgctcctgttcttggctttcttgggacttttctgagtaatgtcacagtgacattcacacatgggtctctgtagggcatgtgctttcgtttctcttgggtgtattcctagaagtgattttcctggtgacaccatgacttttcccaagtggctgtgccagctggtgtcctcagtggtggtggcagagagatccctgcttccatagcctaacccattcttgcccctggtcagtcccagtgggcatgtgctcgtcccaggagcttagtgccgcctgttctcttgccacctgtgatttcttctctgtgtatccccagcctgttgtatccccagcccgccccatccttccctttgtgtgtctgtgtttgggggtgcatgtatgtgaaggccaggagacaaccttgggggtttcccctttgctctctaccttattttttaggacaagctctttgaacctggagctcatcaattcagctagcctgcctgctcagtgagccccagagggtctgcttgcctgtctcctctcagtgccctgagttcctggggtcctcatgtttgtgggtcatgcattgtcagctgatccatctcctcagcccctccactgccttttctaagggcttcccagagcttgtgtgtgatgcaggcgttcttgtattgcagatgtcacaccacacagtgtgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgtattctatttaagaaatgttagcccaccacaggctttgtgggcgctgttttttcttctggaacttccttgtacccttcatgggcatctaggctgagttggattgaggcaaggccaccacgctgtgcctatggatacttggctgtaagctggacagactgtctttcctgttaggcagggactgtgcttctgcttctggacaccatctgtcctgctggccagtgctctagtttgtgacaacagtgctgtctaaactgcaagtttcattctctttcttttcctccccctaccccccaaccccagggtcttcctcagtagccttggtggatgtagagatcactatgtagctcaggttagccttcaactgaaggtaatcttcctgctccagcctgagtgctggggttataggccggtgctaccacacttggtcatttgtgagtttgaagaggaacccactgactggcagcaggggacagcgggccaaaggccccaaggtaggagttgtgacacatatttgaagggagagccatgaaagctggccgcctgggttgggtggaggccatgctgaggacttaacactgtgatccagacatgcacagggggcaagcggacaccttcatgcttattcaaaagaaaccctggagaggaaacaattctgaggtctaaactgggtatggtggcacaacctgagaaaccacagctgggcagtgatagcatcagttcaaggttagccttggctacatttcaacattgggacccagcctggggtacataagttgctacctcaagaacgtttaaaaaaaaagacataaggctaggtatgatggatgtccctcccaaccccgccccgattaacccagcgctctggaagctgaggcaggaggactgtgtgtccaagtttagcctaggatacaaaataagcccatctcaaaaaaataagtaaaatgtcttgagacttgacagaggagtagcttcagtgaggttctccccagggcagtgaccagggatgctgtagatgctggggctgaagacggccttgtttcaatgcatgccccagctgaggtactataggatagccccagcttctgcacttcctaggggaccagacgctttgggctgctggtccctactgcttggcccagttggcaggagtggttttcaggcctggtgtctcccacagccccttggaacagcaagtcaggccaggcttaactccctttggtgatcctgaaggcctagtgtcaccactctttgtggctttatggggtgtcaggaacaggagtgactctggagtatgcctgggtcaggccttgcaggagctgctgctgagggacaaaggtctcacagctggtgctgggagtgagggtccgagtgtagagtgcagcaggaagggaactgggtgcaggccatcctagtgcctgccagtggccccttgtgtggctctgtggcctgaggtgttgcagaagctggggtggtgatgggcaggagggccgtgtacttgctgggcacaaggacagggaggccaagaggcctgaggagcctgggacatgcagggacctggcctcccttcttccccactgtgtgggaaagaggaagcagaaagaaagggctggccactgctggcctggcggtttcctctgggctggggaggaggtggcggggaggcaggaagcctggttccaggctctgtggtcccatagccccacccccactgaggcatgggaacgacacttgaccctcaaaagcaggtctccccttgggccttttgagctgctgtccctggtgtagtgcctatccttttcattgctttcctgtgacaagcactatggttgactcggccccattgaggggcctatcatgaagtcaactctcagagaagactggtccaaggccacacagcctagaggtggaggaggcagaaatggggtcttgtgtgagcacagggcagaggtcattagggttggggttgtgtttaagtcccctccccactgcccccagtttgtaaaacaagcccagcctgcagaagccacacatggtgtcaccatgcttgacaggcccacccaccttaggccacagaggtagatgcctatgcctttctgagctgtgaacaagtaaggggcttgctctgtgcttatgggactggaaggggaagagagggaaaaagaagtgtcagggctcccaatgggcctgttatatgcagcccaagtcctgctcccagagtgggttctgttgaaaactggtggtcaccgctcaagctgtgccaacactgctggcagctggtgactctcaggcctctttcagctcattctgtaagtccagagtagaacatgtctgccagcatcacgaagtcagggctgtgggttcagtgttggggtcctggctaagggcactggggaggcgcaggtctgagcttatatcttggcttgtgttcgtgggctgagaacgtgagcttgtgaacctgtttctcattagacagagccctctggcacactcccggggcagaaatgagactccctgcatggaaggctccaggctttaggactgtgtctcccaggtgccttcctgcccctgttagtagctccatggccatgctggggaaacccctgcccactgctttgtgagtggaaaaggaaaccaagcgctccagcacagccctgtgggcaagcaggcgtccagccctcccttctgtcttgcccatggccaaggttgggatgagtgaagagagaccctgcagggggagaccagccacccgactctggccccaacacaggcacaggaaaattcctgttcctaggcagttatctgaaaggggccaaatggcctgagactgctgccaccacctaggacactggtaaggattgtctaactccccaacacttactgtccctggatgcagagaacagtgcatcacagtgtcagtatggcagacagatatgttctgacccagcaccctgtgcccagtgcagacccttgggctgtctccctagtgcagttaattcagcactgagcactgcatcatcagtctccttgggtagcgctcctaagagggcagtaattgggctggctcctctccccaactccagggtccactggaagatgatgtctctaccatgaataagttcactagtccagaaaggtgtggccaccaccccctcctaggacattagcttgtttcaaaaggactcaggctggacatggcctttgtatatctgtcgtatgtcctttaggaggctcccaagtcacatctattatcttgttccttttaatggccagataatagtcccttgtatagacttaccattattttctttcctaatttatgactaagtggaaatcaggttgtttccacttggagagttatagtgaataatgcattgaacatctgtgcaatgtatcttagtaagttgttcaatctatgcttaacattttgaggagctgcaaaattacaacaccgtgatattcccacaaaagcacacccaggtggcctcgtgacttgtccctttgtatctccttattgcctgcagctgttcgggcctgagggaggattgggctctatgcactgacttcaactctgctgtatcctgcatccaggggcaccagcactatcagctatcttgaatacactatgtattctcaacttagcctggaatttgtaactattttgcctcagcttaatttcagctcaaggttttatgtttctatacatgtgtgtgctctggtgcctgtagaggtcagaggagggtattggatcctctggtgtgggaagtggagttgggtattatggaatagcatgaagggctctaaactgcttaactgtctatttctccagcccagtcccttttggatatgagtatgcctgaccatttttcttttcttttttttaaagggaggtttttctgtggagccgattgtcctagaacttaactttgtaaaataaaccaggctggcctcaaacacagatccacctgcctctacctcctgagtgctgggattaaaaggtgtgtgccaccacactcagctgctctttatcctataccataacatttgccttaactacattggccttagtgtatttacacaattgcacaactaattttagatctcacttgagaggcgtgcacctctcagcagtctgtctgttccatgtgggcagtctgctcctggcctgtggatggattctgttcccgttgtttcttggtcatttcattggagctcgggccttatgatgcatgctgggcagtctgtcacggagccacacccccagctgctcttgtactttaggtctcagtaggccatgacttgtttctctttaccttaaggtcacgatgtagtcaaggataacctgaacttctgatcctactgaaatctgtgccatatctggtttttttttttttttttgtgctggggcctaaattaggcctttatgctagtgaggcaatttactctaccaaccaagctccatcttagcttgtgttgtctgtcttgctgatctgcctcatgccatgggtcttggtcctgtcatgaggcaaggaacttttccctctgatctgagctccctggcataaggccacagatctctgccacagctgatcatcagtgctacctgcctccagggctcaacagtgtcacttccgttccagcctcgattctcaccccataaaggtttcctctgaggaccccaacatctatctcgccctgacaggcagtgttctgcggctcccttatgcctgtgaagggtgcctacttggggctcttaacagggcttccatctgacacacacagagccttacatgatgctgagggtttgctcgggaacttttctttctgctccttggtcctactagctctttctcctcagttatgcactatctttcctgagacttcttagccactttgattagcctgcaaaccccatctcttggaagcattctgttgggcagcctgtgtcccagtgctgaggatgtcctagctacagctactgactggtgtgctcactgcctctgagcatgcagttagggtcatgatgtgctcagccagggctgctgtgctgggacagagcacttcccaagaggcctttgtaccaagtctttttgacccatagggaaccttgagtaaagagggccagcggagtcagcccgggcctggcagtcaggtgccacgagcatggaatttgtaacttcctctgatagcctaagataaggtccacaatgggaaagaacagagtctggaagaatagtatagcttcaacagtccactgccagacttgtcttcagatagtctggttagctcccaaatgtctctctgtaaccctataatctgactggaatctattttggaacaaagcagggttatctgtgtttttgttctgaaaaaggcttcatattatccagtcacacatgccaggacttagttaccctaagacctcagctctcttcctacatctgtaagccctattccttgtccttaggtcagagggtgatgatggatggtagtggccctgggctctagaatggaagctgcttcagcctgggggagggttcactaggcatagtcctggcatacggccattatcatggttcctcaggcttccagtggaagcttgtggtctgctgaggaattcaaggcagccacaggttctttctctggcgggtgtggcttccctgggccaggtgtcttcagagccctatgaagaggaaggtaccctaatgaaatatcttcaacaggctgttgaagatactactcagtgtaaagcaggttttttcattcctttgacacatgaaaccatgtggctttaagagtgactagaaatcagtacaaggacccaagaggcagtcatggctttaatgtcagccccatttcccagcaggctggaggtgtagtggctggtggcaggactcctgacttctttgttatgtatcactgtgctggggctataggagtcaggcaactgcagtgtcatggctcacatagaactgaccaccaccccagaaacatctcaggcctttaattccaccaatcagacccacatcatctatccaagttaaagtctggagagtcaaaagcccagcctgggcctgtagaataagggcagaactgtaccctgcaccacagagagggcagggcaaagcaaaaggaattagaaagtcaagatatctgacttggtccggaagtgggtagtatagaacgtagtagttggcgccagtctgcttatactgaggaaaccacaaatgtcctggacactcctgcaaaaagccgagctaaagccgggctctgaagtgcttggtggaacacctggtagtctctaacctgggacagaggggaaaaggcctgtcaagtcctgtccttcctacttctctggctctcccagttacttatctctcagtctctgctgaagctggtcctcagccctctcagccagcaagaacaatcttgtcacaaggaaataaaggaccagaggtcagggaaggggtggcctccctcctagaactctgagcccgagaactggcatttgtgggaccagccaaacccagaaagctggcctctccaagccatgacatatagggttcttgcagcttgccgagaactgttccctcaggtgggaagttgttgcaagagaaggatgctctgtgcctccttcctctggagaaactacagacaacctgagaggcctgaagggtgggagcagccttgaatgaccaaccctcttgccctctcctagagctcaaagcccaagctccaagaggcctgttccagcatccgggaggtccgaccatgtacacgcctggagatgcctgacaacctctacacctttgtgttgaaggtgagtgccaaggctgtggctccttgggagctctgttctctcctcagatgcagagctgcacgcctcctttttgcaggtgcaggaccagacagacatcatctttgaggtgggagatgaacagcagctgaactcatggctggcagagctcagggcaagcacaggccttgggtgaggattgtccctgcccactcatccttggttccctttgataatccctgctggttcccttcttacccagctcttcccctacaggctggagcacccggacaccgagttacctctttccttagcggcagagcctggtccagctagatccccaaggggaagcactgactccctggaccaaggtatgtgccaggtccttggtctctgggtgtccttggacatgtggcccccctgcgggtcaccaccaccatctttccgccaggtgcttcacctggggtgttgctggacccagcctgccagaaaacagatcacttcctatcctgctacccctggttccacggccccatctccagggtgagggctgcacagctggtccagctccagggccctgatgcccacggcgtgttcctggtgcggcagagtgagtcccggagaggagagtatgtactcacattcaacttacagggcagagccaaggtaggggcaggaactggtggaccagggtggggcaaatgcagcctgggcagcaggctgatctttacccctttccatagcacttacgcctggtgctcacagagcgtggacagtgccgggtgcaacacctgcacttcccctcggtggtagatatgctccgccacttccagcgttctcctatcccactggaatgtggagcagcttgtgacgtccgactctctggctatgtggtagtcctctctcaggcaccaggtaggaaccacaaagttgttgtcaagggtggtgtcaccgcaagtacacacatgcccaaagctgcttttctggtgcgcttttttcggttttaagactcatccacatccatgccatctctccaggttcctccaacaccgtcctcttccctttttcccttcctcactgggattcggagctgggtcatccccacctcagctctgttggctgtccccccagccatggtgcagaggctctccctggccaagtgacaccacctgagcagatcttccacctggtgccttctcctgaggaactggccaacagtctgcggcagctggagctcgagtctgtgagcagtgcccgggactcggactatgacatggactcctcttcacggggccaccttcgggccattgacaaccagtacacccctctctcacagctgtgcagagaggcagacgtgtgaatggaaccattttcctcccctccagagaactataggctgctgtcagccttccccagctcagatgtgccccgcttccaacacacacaaggctgtcacaggcttcctgtcagccagagctagcccccggctttctcccactgtttacagatgtagttcttgtgcacaggtgccactagctggtaccctaggcctagtccccaacccaaaaggaggtggggctacaggcccagagctggcagtggaaactgacagagctgatgacagacttcttaccaggcagggtcatcgggaagcacaaaacactaacagtccctggattctcacatggtgtccttccctgtagcttcagatctgtggcaagtcctcatgggttccatgccacaggcgatggatgcttcatgatcctgctcctactcttagctttacgacagaagctctgccagagggacaagcttaaagatcaaaattgatttaaacattttacctcagagtacttttttttgttttgttttaaaggattcaggtttccatttaatattaaagcttattcactgcactgccctactaggacccccctgtcactctgaagtcgggggcagcgaagcacccctggttcgcttaccctgagccaagctagcatgctagtgtccttgtctgctccctcaggacagttgcctgctgtggggtagccactgtcctccctaatgtagagaatgaagtgtgtcaccctttcagggaaaaccaggcagcttgcagagaggagggtggcaagggacattccactccagtgccttatgcattaacaaaaaggactctgggttacagcagctttacagaggctgggaggtacaggtgggcgaagggcttgaggtcatctttataccctctacccctgaggttggctcctctgtgagccaaaaaaggagctggcactgtgttgtgtagaagctctgtcccaggtggcagcagggtccccatccatacaatctctccatccagacagtgccaatactgtgattgttcctaagggacaggatcacagggagtgggtagtgcttgcagcagcagtggctttagagaaccacaacttaactcctagacatgttccagggcaaacattccgctgccctgctgaagccagcagtactgacctcctcctctggttactctgtactctgcaggggtgtgggctttggggagggaagcagctgcacctcctcttgaacactccccattgtgttcacggaccgaggtgggtccaacacaggtgcagattcgtgttccatctttaaggtaacttgctttccttcactgcatagaaggtatgaaccaaagatataagcaatatccaaccagtggtccagattcgcctctaatctacataggatgggtgcacagctgtatcccttcacctggcagaagctaaactaacttcaaacttggggcacttgtttcccctgggccttcagaagagagacttgcccgacgctgtaaaccagcacctccacccccactgtggacagcttcctttcaagaagtgtctaagataacagaaaacataaggcaaaaaggtattctcgtgactgtgggacagagtgacaacactaagccaacacctttcctttctgctagagtaggtccagttggctgaaggggacgggcaggtttgcgaagctccaggccagatgccctcccagtgtgttggcaccaggcaccgttcccaccccagcagtctttactggccaccactggctcgacagtccccgtacccttgcttccttctcctgagtactcaactacaaactaaaagtcaccagcaccaaagagttgggtcaactaacctgccttgactttaccagcaatccatatggctttatctgtataaatcttctgcctctgatcatttctggatggtgtaggagaaaggaatagggatcattacaatctcgggccacacaacactatctttacctaagtttcttaaagtaaggcttcaccccttccctgagggctcagtctcttgtttaatattaccttggtgcaaacaccaagtgataaactgtcacccactgcctcctagtgaagacacatctaatggccagtgtgtggccggaataagcagcattgtcaccacagaaacagggaatctcatcttctatcattacagcagaaggtatttggcaaatcttcgttttatgtactgtatgagtaacttattcttgaataatgcaaattttgctacaatgtacaaattgctgtatgtcaattaaaaaggtttccagtattacaaccatgatctctgcatccacacacccatcccacttgcctgcctccctttcgggcagcctggcctcattctgtgctgcccccccctccccaatccctggctacactgaggagggacaaggctctgtgctactagacaagtgcttagccactgtggccacaccttgagcctggtcagattcctctgtaaagaaggagcttctgccccctactggtaacacagaactgaactgggataactcagatcaacaaggaaaagtgagcttacagtctgcacctgcttgcagatgtggacttttgaacgctgcccacctctggccagcctgccttctgctgaagccaactgctaatccacccgagagggaatcacagtcttgactttttctagataccttgagccagaactaaaggtgaagaagaaaagtcatttggtcagcacctcctcagagattggagcagcacaaccagcctgtcttccctggggtctacctcccacagcagcaggagtcaacataaacacacactaactgggtatcagtttttaaaactttttttattttttaatttttttttttagtttttattttatattatctacaaagtaaaagttttcccttaacttaaaagttgaaccactgtagacagtgatcgcctcatcaaacttgatttataaataataatccgtcagtttggcggtaagaatttactgaacttctgtcaagtttagtaaaagggcgttccaagtcttgatttttttttttaaagcggtaatagcagcaagaatcactcttgttacttctgttgctagctgatgtgttcatgactctcaagggccattaaaaaataaataacttccagtttcagcaagcagagctgggtacttgcaggaccctgcaacagcacatggaattatggaacagccacaagtccctacatgcctctactcggtccaaaacatcctccactgcaagtgagctgttagcattcctatcagatgttaaatcagtgtatcttttaaaaaacaaaatcaatgaagttctagttttctgtgcttccggttggcagaagcaggagaagggaggaggggatttggcctttcggttcctccagggcagccttacaactgctgttggtggtgggcttgtactgtaaaaaagaaaagtggctatttaaacaacacaggcaccactgcccgccagcctagtgtccgcagcacacgactgtcaactactcctgtgctagtgagtaagactggagggttaatgctgcccctctcccccaactgcagccaaggtagggttggggagggaagggggtgaggagaaacaaaccagtcagacgtaaaccacttcagatannnnnnnnnnnnnnnnnnnnnnnnnnnnnnnnnnnnnnnnnnnnnnnnnnnnntcctggacttgctgcttgtggagcaggccttcacaccccctcccactacactagccaagcaccactgctttccaagtcacagggaagacaggtgtcgtcacagcagccatcagtacgagacatcatgggcgtcctgtgtcagggcacaggctggggctaacactacactcagaccagtccgcacacagcacgtgttcaccagtgctctcctccaagctacgatcaaacttggccatgggcataaaccccccacatcagcctataaaggactcaggacggaccacgctgccctgtccagcctatcatacatacataaccaggaaggccaactgagtcctcggcatgcatcggctacccagaatgaggctgctgcttctcaagccaaccctgaaccagcagaacacacacagagcctgatgtttcctgaccgtcacgatccctcctgtgcacacttggatgggcctcgctagtcaggtttgcagcctgaagcactggtcctgcctgccattctacctctgcgagcagaacgctcggggtgccccggcggcccctgcacacacacgcctcacctgaagggtgcgtcatataagggaaatgcgctgttgtcgagactggaatgggctgtagtgcactttgagcgagggcggcctggggaccgccgggtggctgtgtcgtcattagcatcattggcgcatgggcagttggatgagaaggaaccattcctgactgtacatgagcctgaaacagagagctcttttacgcatacaggcaacatctccttcttaaacaacaagtcagctattcctttcattggactagggctcttgaaggagcaagatggacttcttgggtaaccttgaggtagatccagcagggctaagatggggaagttgcctcctagtccccaactcgtctgctcagataccacacaaggcaaggtcttcaccaaaagcagccgctattggggtgggaagggcactttcttagcttgctatggtgcatggccaaagatatatcaatgcccttttccagtcagaaagcaactgacaagggcctgtaaggggactgcctccccagcaccctcagcagcttcctgagtctctcctcttccgcccttccccagttgtagtgggttccccaaaagtagggtgaagcagcacttaggcccctcactttaaaagcttaactgacggagcaaaggctgagtcactggctccactgagatgacagagtgatctgaagctgggtcaacccagtaccaaatggcagcaaatttaagttagaaaggtgatgttagctacctggtcggtaatctcaaccttggctctgcagggagtgggcagagcaggaagaggcggcttcctgcctcccatcctgtgcattgctctagaccatcaccccagcgaagcactggttcacaccttcaaacaggcccatggctctctgctttccctgttagcctcttactctcttatgcaaatacatgagtgaggtttgggatgagctcatcttacacataaattcacagcctctgctggacacttagaggaccctgattctcttaagtctcactccaccaaagcacactgaccacactggctaccctccccactgccgccagccaacaggagcatattctacactctcagctctgggggaaggacaggaacaagctagccttctgcaagagacccaactacacagcagcgttagctcacacctcgccagagcctcactggcacactgagacaggaaatagaatcattcaggaactcttctaagtgagacccacctcagggaactgtgatcaaaagtagcagacatctgatccagccaccttacgttaacagctacagagagggcctccccatggcccaggctgccctggctctctcagcaaccacagctttcaagctcagcctttacactgggggaaggaagggaggaaggaaggaagggaagccccagacggtctgggctactctagagcctgagttctcctgcaccacagcccaaggtccaagctcaggaatcacagcagacagaggcaaccaggcaacagctgggacactgctaacccgcaaaccaacaatcctagtgcagtccctcagagtgagagccactgaaggcctgcctgccaccctgctctaaggctcgcgtgtgtgctcccgtgtagaggtgtctgcatgtgtgcacatatatacacagtggagaggctagagagacgcagcgaagcagacacaggaaggaaaggactggggtgcattccagactcagaggtttaaggtctcagctgggaaatgctaagtcacagtttcactgatccaccacaaaaccatagcaacattcactgagagccagaagatcacgtgctaagcaggaaaggggcagacaggcagatggcaccacacacagggtttcctggcttggggagcaactggctccttgctgcttatctgaccaccactccctatgtggccttcacaaaaacttggctagtgctggtttacctgaggtacgtgggccatgtggggtggggtggtgtatgccggctgaacatgagaagggtggatggtgaagactgtctgttgtgctgctgggaaactgctctgtggagactgtgtattagaggcaggtgtcatggaaggtggtgttggtgccagccccgcatgataaatggccgactgctgctgtggactggccagatgaagagcctgggcagcctggtgctgatggtgctgtaaagcaatgggaaacttcatagagtgaaggcgacaggccaccaccccacccccaccccgggaggcgcagaaaggagagcacaaagcatctctcatgcagatggccttttccggggactcaagcccaagcctcagccgggcagttacaggtccaaacaaggcctcactgccccattagcacatgggactgaggaagccaacaggaaggcagcattgcggcttgccttcaggaatgaaattccagagggctttagacttaactaagaacttcaagatcaagcagctttttaacacttatgtttctggcattcaaccttagggaatggcctcccccgtacccacaactgctcacagctaggcacacacaggccacgcctctccttacctgaacaggactgggtgcagggtgacttccaccatgctggctttgctgctgtccggtgggagtggccgaaggctgaggatggggagtatgtggatgcagggcggcattaggatgtgcatactgctgagcgagggagccggtggaaactgagatgaaaaagaaaaaggaatgtgtacaattctgacgaccactgccagcccactatgcctaattcactgcactctaatcactgccacgctctacagccatgagagcaagcacagtctggaaacagacggaagggctctgtctaccaaggccagcacgtgacccgtgtgctacatagctctacacactacactcacaccgacttagtttaaatttactcagacaatccctgttcctctcggaggcttaggtagaaacaactccaccaatcacactggcccacatgaagacaggtgcagcctctctctcaaggtcagcatctgattacattgctatgctactgctctggaacggtccctgtacacacaccagtgaggctgggcgcaaggacaacgtcactgccatctcagtcaatcacagtacccactcactattctgttccctactgaatgatgcagctcctgacaaaaagcctggagatgaaactgaccactctatcctgttagctagaaaaataccaaaggaacagtttttcttaacactcttaaaatgtgactctacgacaatgaccctgaggctgctctttatgcatctaggaggggccccaccttggtaccaaccaaggagatcaagtattaagtgaacctgtgcctttacagagcagcagcctgggaatgagaactccaggaaggtcgctgctcctgtgactctggacagctcacgacacaaactaaacatcaagcagaaaatggactgctctcaagctatctctatctctctctcagcactgaacccttagccctccacagccaagcccacacacagatgtgtcacagtttcatgcactttagataatatgtcagcaaacacagctatgatgtggacagagaagcaccaaaacttccaagaatagcacacatggaggactctggctgtgtgccagctgagtggtgtcccgggttagggacaggaaacattcatgagatgtcacagtgcagggcagggcattctgtttccaatggtcggagctggcatggcctgtgtgtccacctgccaaggccacagccctcactcaccagtgtccctcagtatccaggtgagactgatgaaggcaactgtgtttagaacctggtacagtttccctgactgtattagtcaacagatgtgtaaagagaaaactacggcagcctaacgtcacaatgttttcagtgagtcagggagaccagtccatcctctaattccctgactgtgaaaagcacttaagaacgacttttgtttttagagacaacaactacaggtctgcaactatagactaggctgctagatggtgataactggtccacatgtctcattctaaaaccacaaacattaaagccccatccagtgtttagtaagtgtttcctttatagcaatgttaagtccaactgagggaaagcaaccctaaatgtttatttatgagatttcataaagatagaggatataggagctcaagtattcaaactaaaaaaaagtttaagaaaacataaataaaaggcttggagacacagctcagtgcaaagctttgcacagaaggccctgagttccagtcctggaacaggtgggaaaacaagtaactctgaaggaagctctagcaaaatgcagtggaaacacggccaccgcagtcatagtaactatgtccatcaagtctcagaattacatctgtcaactgggaaaatgggaaagtcttgatactgtcacttggaaagagaattaaaagatcctttcccttctttgtttggtttttcttcttttatagcttaagttgacctggaacccaccctccccaactccatcttccaagtggatccgcaccggggtaccatacccagccaggatcaaaatcaaacagctttattactcatagtttatgcttaagattggagccagagcctcctgcatcctaagtacacagtctaccactgagctacactgagccatgttcttaagattgaataactagaggcagggcttggtggaacccacgcaaccctcaagcttgacagcagctgaccctcccaccttagctcttcacatggcagggccacactttcactaccacatccagtttaaaattttatttttatataaaagggcatttaaaggctaggctctcacaggaagtgtgttcttatcattgagccaccttcctggccctattagacatcttttaaaaagattgatttttattatatgcatatgagtgttttgccagtgcaacacacacatgtgcagtgctcacagagaccagcacagaatactggatcccatggaactacagttacagatatagttacacatgggtgctggcaaccaaacctgaatcctctgcaagagtaaccagtgctctgaactgctgagctgtctctccaggccctagtatgcattttaacaaaacactttcaggagcatccagagaaatgtttccatctgctcactttctggctcaaagaggcctaaaaaacaagtaccttatgtaaccctttccccttgactataatgtgagaaatcgggaaatgggaaccaacactgtaattccagcaacagcaaaactaagggcaataaaaagcgggagaggggctggtgagatggctcagcagttaagagcactgactgctcttccgaaggtcctgagttcacatcccagcaaccacatggtggctcacaaccatctgtaatgagatttgatgccctcttctggtgtgtctgaagacagctacagcgtacttacatataataaataaataaatctttaaaaaaaaaatcagggagagggaaattagagaaacaacagaacagaaaagactggggaaggtaaccaagagcagtctttggagagtggcaagcaaggctctcagccaagggcaggattgaatggcttttcctctgctggttaatttaactacttgggagactagaaagaccatgaatcccctcagatgttctgaaatcgttattcagcagctaaactactacttacaaggctcaaacagtctcccgagagttgggtgagaggacaaagcgcttcttgacttaagtattta

SEQ ID NO: 206 - DNA, 1886 bp, Mus musculus
ggcatcagctcccattacagatggttgtgagccaccatgtggttgctgggaattgaactcaggacctctggaagagcagtcagtgctcttaacctctgagccttggagtggctggcatgtgacctgaaactggagtgccagactgccttgccctgttgccaagcccggccgccccgcctcgctctccaccatgaacgagcccaccgtgcagccgtcccgcacatcctccgcacccgcctcgccggcatccccacgcggctggagcgacttctgcgagcagcacgcagcagcggcggcccgggagctggcccgccagtactggttgtttgcgcgcgcgcacccacagccgccgcgcgcggacctggtgtcgctgcagttcgcggagctcttccagcgccacttctgccgggaggtgcgcgagagcctcgcaggaccgccgggtcacgactaccgcgccactgctccgccccgccccgcgctgcccaaggcacgcagctccgaggacctgggcccgcggcccgcctgtgccctgcagcacctgcgccgcggcctgcgccagctcttccgccgccgctcggcaggggagctgcccggggctaccagtgacaccaatgacatcgacaccaccgcagccagcaggccgggcccggcccgcaagttgctaccctggggcctgcgagagccgcccactgaggcgctcaaggaggtcgtattgcgctatagcctggcggacgaggcagcaatggacagcggcgcacgctggcagcggggtcgcctggtgcttcggtctccaggtccgggccacagccactttctgcagctcttcgatccgcccaagagctcaaagcccaagctccaagaggcctgttccagcatccgggaggtccgaccatgtacacgcctggagatgcctgacaacctctacacctttgtgttgaaggtgcaggaccagacagacatcatctttgaggtgggagatgaacagcagctgaactcatggctggcagagctcagggcaagcacaggccttgggctggagcacccggacaccgagttacctctttccttagcggcagagcctggtccagctagatccccaaggggaagcactgactccctggaccaaggtgcttcacctggggtgttgctggacccagcctgccagaaaacagatcacttcctatcctgctacccctggttccacggccccatctccagggtgagggctgcacagctggtccagctccagggccctgatgcccacggcgtgttcctggtgcggcagagtgagtcccggagaggagagtatgtactcacattcaacttacagggcagagccaagcacttacgcctggtgctcacagagcgtggacagtgccgggtgcaacacctgcacttcccctcggtggtagatatgctccgccacttccagcgttctcctatcccactggaatgtggagcagcttgtgacgtccgactctctggctatgtggtagtcctctctcaggcaccaggttcctccaacaccgtcctcttccctttttcccttcctcactgggattcggagctgggtcatccccacctcagctctgttggctgtccccccagccatggtgcagaggctctccctggccaagtgacaccacctgagcagatcttccacctggtgccttctcctgaggaactggccaacagtctgcggcagctggagctcgagtctgtgagcagtgcccgggactcggactatgacatggactcctcttcacggggccaccttcgggccattgacaaccagtacacccctctctcacagctgtgcagagaggcagacgtgtgaatggaaccattttcctcccctccagagaactataggctgctgtcagcct

SEQ ID NO: 207 - protein, 569 aa, Mus musculus
NWSARLPCPVAKPGRPASLSTMNEPTVQPSRTSSAPASPASPRGWSDFCEQHAAAAARELARQYWLFARAHPQPPRADLVSLQFAELFQRHFCREVRESLAGPPGHDYRATAPPRPALPKARSSEDLGPRPACALQHLRRGLRQLFRRRSAGELPGATSDTNDIDTTAASRPGPARKLLPWGLREPPTEALKEVVLRYSLADEAAMDSGARWQRGRLVLRSPGPGHSHFLQLFDPPKSSKPKLQEACSSIREVRPCTRLEMPDNLYTFVLKVQDQTDIIFEVGDEQQLNSWLAELRASTGLGLEHPDTELPLSLAAEPGPARSPRGSTDSLDQGASPGVLLDPACQKTDHFLSCYPWFHGPISRVRAAQLVQLQGPDAHGVFLVRQSESRRGEYVLTFNLQGRAKHLRLVLTERGQCRVQHLHFPSVVDMLRHFQRSPIPLECGAACDVRLSGYVVVLSQAPGSSNTVLFPFSLPHWDSELGHPHLSSVGCPPSHGAEALPGQVTPPEQIFHLVPSPEELANSLRQLELESVSSARDSDYDMDSSSRGHLRAIDNQYTPLSQLCREADV

SEQ ID NO: 208 - DNA, 73995 bp, Homo sapiens
gatgggggtctcactatgttgcccagcttggcctccaactcctgagctcaagtgatcctcccacttcagcctcccaaagtgcagggattacaggcatgagccatctcacctggctttagctaacattttgatgcttttttttttttttgagatggagtctcgctgtgctgcccaagctggagtgcaatggcatgatctcagctcactgcaacttccacctccctggtttaagcgattctcctgcctcagcctcccaagtagctgggattacaggcatgcaccactacgcctggttaatttttgtatttttagtagagacagagttttgccatgttgcccaggctggtctcgaactcctgacctcaggtgatccacccaccttggcctcccaaagttctgggattacaggcgtgagccactgcacctggccttgatgcttcttttaatgtagattaaatgaggcgggtaggattaagctgttcttagtaatccactcctcattgtaaaagaaagacctgagaacaggtttagctagtaatagtcagcattatttgtttatttatttatatattttgagacagtctcacgctatcacccaggctggagtagtggcactatctcggctcactacaacttgtccctcccaggttcaagcaattctcctgtctcagccttccaagtagctgggattacaggcatgcaccaccgcgccaggctaatttttgtatttttagtagagacagggtttcaccctgttggccaggctgctctcgaactcctggtctcaagcagtcctcccacctcggcctcccaaagtggtgggattacagacgtgagccaccacgccccactggtgtcctcattctttgttcccattttacagatgcggaaactgaagctcagagagcccaagtcatttgcccaaggtgacccagcactgaagggagaagctagccattaagctgtccccaaacccgtgtactcaacgttgatggctactcgatggtggctgagaggcatccaacctggagcctgggaagcttccaggaaggcttggggggaatccaagaggaaggttctttgcgggagaaagagtgaggcaggggagtttaggaggccgcttcccagccctcgatcgccccacagccaccagggggcgccagagccccgcgcaaagcggctgccaccaagtggctgccaccgcgcgttaccaccctcagggcctgatgcctgggactgcggccaagtcccggccccaggagctcgcgtgccccacgttgatcccgggtcacgggtggggacggctggggtaactgggttgtacgtcctctgcggagctattagggactctaattaccgggattggaagtgaataattatctactgggcctcaggctactgagtcacttcccccagaaaccagattccccaggctagcggaagagggggcggctcgcaggctgaggttggggcgggggaaggtggaagcgggggtctggggttggggtgcgcggccgccgctgtttttggtcaagatcagaactggggagcctgggtgtaaatcgctgctgggccacttaccagccacgtgaattggggaagtcacttcacctttcgtgcctcagtttcctttctgtcaaatgggggaaaacaacattctctccttacagttgttgggcaaagtaaattgtaatctacctaaactaagccctcagagtagtccctggcacataatcctctaataattcattaatcactcagaattattaattaggccgggcgaggtgcctcacgtttataatcccagcactttgggaggccgaggcgggcggatcacttgaggtcaggagtttgagacgagcctgggcaacatggggaaaccccatctctactaaaaatacaaaaaattagccaaccgtggtggctcatgcctgtaatcccagctacttgggaggctgaggcacgagaatcgtttgaacccgggaggcagaggttgcagtgagccaagatcgagtcattgcactccagccttggtgacagagcaagactccctcccccaacccccccccaaaaaaaaaggacaaaaaagaacattaattaatcattaatcattgggccgggtgtggtggctgatgcctataatcccagcactttgggaggctgaggcaggcagatcatgaggtcaggagttcgagaccagcctgaccaacatagagaaaccccgtctctactaaaaatacaaaaattagctgggcgtagtggtgcatacctgtaatcccagctactcaggaggctgaggcaggagaatcgcttgaacccaggaggtggaggttgcagtgagccgagatcgagacattgcactccagcctgggtgacagagtgaaactccatctaaaaaaaaaaaatcattaaccattaattcagaatcattaattctgttattattaccattttttatcacttgggctcagtaagtgattaagaggtagggcactacagtgaggccagtctttagtccacaccagctgcttcattgccagtcgtgtgacatggacatgtcacttcactgccctgtgcctcagttccttcatctgacaaatgggaaaatgaatagcaaaccgttcatttggggtggaagagataaggcctgtgatgttctcagtgtggcgcacgcttccataaatggagtccagattgtaaatactgttcatgcttttcttagggaaggacttgtggcaattttagcttctaaggcactgggaggacagaaaacagaactgaatccaagggaaggaagcacagggagagatgacatcaggcacttgagctcagcagatcagaccctgagcccaggaatcggccttgggagttctgcccacccaggcaaaaagggaagaacccagtaatgtaattattttctggcctggggcagatgtgtattgaccaagggggaccatttcctgagccctcttggtctctgttggaccctaatgggtgggaaaagggttggttggacctcacccccccaaggtttcttgagctctgtgttaattattgattgctgggtaacaaattactcctgcatttactggcttaaaacagcaaacctttattatctcatatggttttaggaattcacatgcaatctgacttagcttgtagttcagggtctctcactcctgagatggtagtccgaaacatgggctggtggcacgcacatgcagttgcagctatttgagaggccgagacaggaggattgtttgagcctagaagttcaaggctatagatcgtgctatatgatcgtgcctgtgaatagccattgcattccagtctgggcaatgaaacaagaccccgtcttttaaataaacaaacaaacaaaaatgggttaggactgttctcatctggggtccaactggggctggatgattcacttccaggatagttggaagtgatggtttcagtcctggctgttgccaggaggtctctgttccttgctggctggtggcaggaagcctcagttcctcttcacacggacctccataaagctacttgggtgtccttaagacacggtggctggcttctcccagagtggatggctcaagagagtacaaggagaagcctaaatgcttcttatgactcagtctcagaagtcacacagcgtcacttccactttagtctctgttagaaatgactcattaaggccaggtgtgggggctcacgcctgtaatcccagcactttgggaggccgaggcgagcggatcacgaggtcaggagatcaagaccatcctggctaacacagtgaaaccctgtttctactaaaaatacaaaaaattagctgggcgtggtggctcgtgcctatagtcccagctactcaggaggcggaggttgcagtgagccgagatcgcaccactgcagtccagcctgggtgacagagcaagactctgtcagaaagaaagaaagaaggaaaggaaggaaggaagaaaggaaggaaggaaggaaggaaggaaggaaggaaggaaggaaaggaaggaaggaaggagtcattaagtccagcccacactcaagggcaggggaatcaggttccaccttttcaagggaggtatgtcaaagaagtgtggactgtttttaagccacgaggagcacctgttatgtgccaagaactgtgctcacaagagtgagcaagacacacaaatgcctggccgagtggagctgacctgctcctgggggtgggggaaagagactgccaataaacagatgaatcaatgattctggtatcagtcagggggccacaagggtgaggaagaaaaaacatgcagaggcaagtcaggcgcggtggctcctgtaatcctagcactttgggaggccaaagtgggagcattgcttgagcccaggagtttgagaccagcctggacaacatagagagaccctgtttctacaaaaaatagaaacaattagccaggcatggtggggtgcacctgtagtcccagctccttgagaggctgaggcagcaggatcgcttgagcccaggagttcaaggttgcagtgagccatgattgtacaactgcactccagcctgggtgatggagtgagaccctgcctctaagaaaaagaaagaaaaaaagcaggagcagaagagagatggagatggtcagcaatgggggcagggctggtttaggtttggtgggcagtcagacatctcctgggagtgaagaaagcaagggtagacagctgggcgcggtggctcacgactataatcccagcactttgggaggccaaggcgggaagattgcctgaggtcagctattcaaggccagcctggccaacatggtgaaaccccatctctactaaaactacaaaaaattagctgggcatggtggctttcacttgtaattccagcttctcaggaggctgaggcagaagaatcacttgaacccaggaggtggcagaggctgcagtgagccaggattgagccattgcactccagcctgggcaacagagtgagactccgtctcaaacaaaacaaaacaaaaacatctggtggaagagcattctgggcacagggaacagccagtgctaaggccttgaagtgggagcatgaaggtgagtttgaggaacagccaggaggagcccagtgtgctgcagtgtcctttgataatgctcagcactctgtgcattcactgaaggccactagggacaaagtgtcctacacaatgtcatttcccttcacccaactactatcatgcccatttgacaagccagagatactgaggctcagaaagtgggagcctgttgctggtggcaagaggggacctttggaggttgcacagcagtgccgtgatggaaactcgggcatgggaaacaccagcagtagccattgcccagctgggggccaggccaggccaggtccccgggcctcctcctcgcctgtggcccaggcctgcagaagcacattttacaaatgcagacagcaaggcctccactctggctgggtgaccctgggcaagatctttgctctcaaacctcagtgtctgcatctgtaaaaggggtgtgaagctctgttgtttacaggactggtctttgtggccactcctcttcacaaccctcgagggacacgggactctcacacccaatcatagattataatcacattctttttttttttgagacgaagtctcactcttgtcaccaggctggagtgcaatggtgcaatctcggctcactgcaacctccgcctcccaggttcaagcaattatccctgcgtcagcctcccaagtagctgggattacaggcacccaccagcacgcccagttaatttttgtatttttagtagagacagggtttcaccatgttgacaaggctggtctcaaactcccgacctcaggtgatccatctgctgcagcctcccaaagtgctgggattaccggcatgagccaccgagcctgcactatattcaacattctttatcagtcgttgctatgtggaggtacctcccccactcctaagccctcaatgtgagttttctcatcaaattccccctcaacccaatggggtcagtcctgtcactgtccccattttccagatgaggaaactgaggcccagagaatctatgtgactgcacagctaggagatacagaacagagaactcttttttttttttttggagacggagtctcgctctgttgttgccaggctggagcacagtcgcgtgatctcagctcactgcaacctccccttcctgggtttaagcgattctcctgcctcagcctcccgagtagctgggactactggcacccgccaccacacccggctaatttttgtatttttagtagagatggggtttcaccatattggcctggctggtcttgaactcctgactttgtgatccaccgcctcagtctcccaaagtgctgggattacaggcctaagccaccgcgcctggcccactttttgaatttttatgagtatatagtaggtgtatatatttatggagtatgtgaggtattttgatacaggcatgcaatgtgtaattatcacatcagggtaaatgaggtatccatcacctcaagcacttatcatgtatttgtgtttgtactagttaacttttgttgttatttaaattattattaatacgaattgctaatatgaatattaatagcattgatcattgttaatttattgctgttgactcgtgttgtaatcgttatctttttaattttttttttttttttttgagacggattttcactcttgttgcccaggctggagtgcaatggtacgatctcggctcaccgcaacctccacctcccgggttcaaacaattctcctgcctcagcctcctgagtagctgggattacaggcatgcggcaccacacctggctaattttgtatttttagtagagacggggtttctccatgttggtcaggctggtctcgaactcccgaccttgggtgatccgcctgcctcggcctcccaaagtgctgggattacaggcatgagccaccgcgcgtggcctgtaattgttattaatcctgtgagtctccggctttctggaacttggccagcaggaggtgttggtgtttttcacagcaagaaggaagggcggttggacctgctcccctaagacggcctggcttgtttccgggagctacggatcagtcatgggaatttgaataaccctttctctccttaggtcccagtgacctgccgagtgggaagagccgtggctggccggcctcccagtggcgacgacgacctcgctgtgttcgtggcagcggcactctcaaatctgggcacggtgatgggaaggttatttgttggaatccctttgcctttccaagggaaaataaacacaaaaagtgagaagtcttggggtctcagcgagcgccaaaacaaaaaactggactctggcggggatgtgggcaagaagcgactaagcgaggaaggaaaccagtttgggcctccgagaaatctggcaggcgagaaggtttgaaccgtgattaaaaaggggaagaaccacaagtcccaatttaagtcagcagagctgctgtctgggcagtgagagggaaagtgcttgtggctggcagatttcagcagccatttggcattggctgggtaccgggctgctctgtgggtgctgcctggcagctgcatggctacagacaagtaactgttctctcttggccgcagtgtccccaggtataagaaagtgatcaaataatatgggatgatccattcagactttttttttttttttttttagagacagagcctacctctgtctcccaggctcgagtgcagtgatgcaatcttggctcactgcagtgtccacctcccaggttcaagcgattcttctgcctctgcctccccagtagctgggactacaggtgcgtgcaaccatgcctggctaatttttgtatttttagtagagacagggtttcaccctgttgaccaggctggtctcaaactcctgacctcaggtgatccgctggcctcagcctcccaaagtgctgagattgcaggtgtgagccactacacccggcctcgtttagacttcattgacattcccccaccccacccctcttcccacatcctcagatgccgtgtgaacagcttgaatcccacactccacaggtccttctcctcacaaccctccatggcaccctactgccttcaaaataattcccaaagtccccaccaagaccttcaagacaccatgtgatgggcccacctttgaaacatcatctcttaccagtataggtgtcaccactgcctttatgactttattccaaagcaccacatgtattcccacctcagcacctttgcacatgctgttcctttggcctggaatgctcttccctcagacgttatagcacctggatccttcttgtcatggagggttctaagctcacatgttagttccgcagaggtgtccttcctgagccctggatctaagacatccccttccagctctccatcccgtaactgttttgtcattgtcatagctgatcccacttgcttattcgtgccttatgtccccccactagaatatcagctccacgcaggcagggatatctgtgttgttcactgctgtgttcccagcgcctagaacagtgcctggaaatgtgcggaaagcagatttttgtggcctttttcttcaaggtcattggacaccaggaatcctgtagcagaccgctcccttcccccatctactcggagtctggaaatccccaccttctggggaaccccttcctgtagttctaaggtcaggactggggccgatttgtttaacacagagagcttcctggagccaagcctcgagctaactgctttaatgcattaactcacttaattctcactgccaggagagtgggtacacattatttccatttcataggcaaggaagtggagaggtacggagaagtcaagtcatttgcccgggtaggaagagggggaggcagtggaatggagacacttgctgcctgggaagactcgaggtggcccctccaagctgggggcgtgggcgacttgtttcctgttgggggagggggagaagagtacattcctccctccccgccctcccacatgttgggggagaggctggctgagagcatgtcccactccggactagggggaaccccactgtccgtctcagctccccatgaggccgtggagaaaatgtaagtagcccgggggcgggcaggggggtgggcgcagaggccacggaagccagcggtcggagagggcttcctggagaaagatgcacccctcctagaattgggggacaggacgggcggccggagcgaggctgggctatacgggcaccggctgtagcaaaggcaaagctgagggctggggccagaacccaaatcgggggcctggggccgtggcgggtcgggtcagcatgatcgcagatagtcagggtcgggcagggctgggctccctccctggggcgatgatgaaagccgtggtcgctattgcaccgcccagccctgcgggcactgataaggccctgcaggagggagtcagcaagggcgcgccccctggaggccaggcccctcgaccctgcccgccctaggccccgccccttcatctggccccgcctccaggcgctgaggcacctggtgacctgccggcgttgagtgggtggggctaaagtcgccccgcccctccgatcctcacttctatcttcagactgtgggacgcgaaatcgggtgggcacgtggtgggcgtggcttcgcaaggcctcgcctttttccggacccgcgccaggagagccctccgaccctggcagccgcggactagcgggattggtaggcggggccagtccgggctccgccctcatggcccgcccctccagccgaatctccgactcgcgcgcggcctgaggcgtggctcctggtggccccgcccctgccccgcccctgtcgcggccggcctcccccgccgggctccgctcgcacggccggttcctctttacataacggcgcggggcggcatgggcccgggccaccgcctccgcccggctgcccgcccggactgtcgcggcccgcggtggcgacggcggccgctgcaaagtttccccggcggcggcggcccgggggcgcatcctcccgcaactgtcaagcgctggcggcggaaatgatgaggcgctggccattttccgagcccgggtttcctgcctgagccccgctcgagcgagccgcgagcgaggagccggcgggcgggagaggacgcgcccagggcgggggcccgcccgccccctcgggatttcgagggcccgggggcgcgcgacgccatgggccggccgggcccagagctcctgtctctcaggtgagcccgcgtttgcccgcgctcccctcctccggggccgggagggcttttgtggggaaagaggaggccccgtgtccagttctgcccgggctctgcgcgtcacccccagcccaaaatactgccctgcagccaactcggatggaggcgttccggggtgacggctcccagcgcctacgaccccccactcagccactacccccacccacacacgtgttagggagagcgttggggtaactgaggccgtgggatgggggagagggcatcgctgacgcccccagcccaccctacggtagcctcgccggttgggggcggccctcccctcaacttgtgcctggggaggagcggtcaggggtcacccattgctaccctgaaagtgaaagtagtcaaactgaggctgtgagcacagatgagcccttgggtgtgggggcagcgggggaggatgcgccggcccctccccactccccattccgggccatgtggctaagagggtagcgccctgattcaggaagcccctctccccagttcctgcactgccgaggtcgaccgggccaggcccccgcatgctgctgaattgggcggttcaccagggctaggcgtcccagagacaggtttctggtattgatcctctcacacctcttgcctggggttccctgggaatcccccgaccaaaaaacgtctggagtgggtgttggtcttctagatccgcacggtagggatggtatttcagaggtctctgatgcctggtgcagaaatccccttccctcccttccctccctccggccaggggagctttgttttgagggagggggactgcatttgaggaactggagaggagggtctgcctgcctgtcccgcttctttttttctttagtttcctcattctcctgtttctcttccccattcccagccacaatgatgtaggtgaggaggtcactgcctgcagctgggggcctccagggaggggcacggccaggctgggctgagtgggaggaagtgaaatctggtggggggttcagagcagaggccccggcaaggcaatgtcggcaaggccagctttggtggcaggagggaccgagatctgacccgcagcccctcgccggggagatgacagttccctaacaccggctagcagccaggcctcagggcccctgccagggcagtgggcctgtgggtctccagggatgcaggcgcaggttgtgtctgggtttcccatcactgacctggctgcctgagtggaaacagctctggaggctcctcgggacctgccctcgtggagggagagccgtcagaggccacctgggcaggctgggctcggaggatgagagccagggcctactgggggaagttggaagggtttttagtgcacttttcctgagccttttcccactaccccctctgggagggaaaatccttctgagccaaagggtgagcattcctagaacttttgtgagtccctgtgggccacagagcggccagctgggaaggggctggctcagagcatcagcagctgggggctcagggtctgcaggggctcagcaggaagtggaggaggatagtgaggagggtcctggagactgtgctttgctactcctattgccttcgttcagctgaaggcgtgggcaagtgactctgccctcagtttccctctgtgtaaaatgggggagtaacaggtttgcagtggagatttaatgagccagtgtgtaatgagcacctgctgcctggcaaagagaggttcagttgcaggtggtggtggtggtagtggtgattttatcattgccttcattagtgttactgttattggctatgaggtgttccttcagtagtctcccttgagcatctcttgcatacatagcactggaatttcctgggtctttgggagcagaattttgaagatctgggcacttccttagctataaggccttgcttaactgccccacctcagtttcctcatctgtgaaatgggtgtgctaatagtacctacttcctagagtcatgggaaccatgaatgagtgaattcacagtgtccagagtggcttggtcaggaggaagagaagaagtagccttggggccggaatgatcttttttgttgtgggtgttagctctgctggctttctttcctcatccccccacccccacccccatgcctctcaaacctgggcctgatcctccttctccgataaatagaacttttgagtacaaatcagatcccacaggactgctgggcccttggatttctggctcccgctgtgccacccccagacattctccatatcccaggtggagcagagctggaggcacttggagggacctcctcgctgccagtctcagtgccacctgtctgtggtgaggggagaccgggtgccctccccagccaaggtggggagggtcagtgaagggggtctcagggacatagtagggagctgtcccacagtctgggccaatacagctccttttgctggaaacacctttgggacccagtttacatgaccccacacccttctgagggctggtgttcatgagggtctcccattgctggggatccttgggttgatcacttaagctctctgaggcaattgagacaacatctgtgaaaggctttaacagctgtgcacttgctgtgacatggcacataaggcactgagcgctgagcctggcactcaattaacaatagtagatattattgctattaataaaacaagaggcttttcctgctaaattcccacttctccctggtagcagtatggactttggggccaaatctgggctctgccagcttccaggtgtgaggtcctaggcaggttacctggcttctctgatctggacctcgcctgcccgatggaagccaagagttccagcctccccagggttgggtgtgtgaagtacagtgtcaggactggaactgtgttggctgtacttgctctggctgtgtgatcttgggctggtcccttagcctctctgagccacaggtctttttgtctatgaaataggggggttgccaactccctgttagggtggttttgagaaaaggaggcatgcacagtgcccggcatgcaattggcactcaataagtgcaagccattgctgttcatgcccaataggggctggcacttaattgccaggtttcctgggaaaacggtccccaagggcccgcgggcgttcagcatctttgacgaggcagggcaggaagccgctgccgtctggcagaccggagacgcctgcctcggcgagtccagaggtgcagtgctagctgctcattccctgcaaggccccattcctcactacccacccttcccaaggaaactgaggcgggcaggctgcccaggggaagtgactcagccggggtcacttgctgagtcaggccttattggacccaggagtcctgcaccccacctccccagcttcccggggcttgagatcccttggagactgagcaggtcctgaggcctggcagcaggaccaggccaccactggacatctgctcaatggggccctgctgccggggtgacaagcatccctctaccagggctccagggttctgctggccaccactagccatccttcctcccagcaggggcagaggacacttccccaggggaacaggtcctcctggtgcccccccactccccgccccagccggaaacccggcagctgagcagttagatagaagatttttcctcccacgccaccctgtcaggggtcggccagcagggccgggccacaggcttccttgtgagccaggcctggagcccctgggggcccacccggatgtggctaccccccggctggccagtggggagccggctgctgcccaggacatgtgtccccagggaggcctgggaggaaggaagtctatgccctcctcacaggggctgactcacaggcgcccaatggggggccccagctgggagactgggaatgtgatcaatcagggaggtggacacacaaggggacctctgacatgggatctgccctttcagagctcacacactggtgtcatctcaaggaggagaggcccagagagggcagtgtatgctgcgagaggcgaggtaattgagggcttacgcatgtccctcctgatgtccccaagtagcacgtggggaggaggttcacccacaggctgccctcctagggtctcccctgtctgccctcaacccagaggcagtgaaaggaagaagccacggccttgggatggggggcgtgcgggattctgatggtgctgcctctccgcagggagatggttcttggctttccctacctcctgaaacctagctggggcggtggctgggatgtcaggctggcggtgtgggcagaggaagccagaggacatttcctgttctggcagactgtgctggcctgataaatgtccccggggcacaaggtgaccccagcaagggtgcatcagtgtccagccagctgccccgtggcctggggtagaacccacctctctgcctccccagggaccctgccttcgccccctgcttcccgtgggcatctctgcgtctggcaacttgaatgctgtgaaagggcagcaggccgcctgccaggcagtgtgtgtcagaatcccacaactctctgggcctccttaggccacagggtctggactctatgaacagttggtgctaggcatggggaagatagaaatgttccttgtggcctagattcaaccaggaggcctccctggaggaagtgtcccctctgaaggtgtgagacttcctgcctatatctgtgagctggggcaggggagagtggaggctctggactggcccaatttaacttcatttaccacactttaagaaatcttccccaggctgggagcagtggttcacacttgtaatcccagcactttggaaggtcaaggtgggaggatcacttgagcccaggagtttgaaaccagcctgggcagcatagtgagaccctgtctctaccaaaaaaaaaaaaaaaaaactgggtatggtggcacatggctgtggtcccagatacttggaaggactgcttaaacccacaaggtcatggttgcagtgagctgtgatcatgccactacactccagcctgggtgacagtcagacctgtctcaaagaaagaaaaaaaaaaaaaaatcctccccaagcctcagcaggggaattcctaccatggataaaggctttctctgcatgtgggcctgatcattaaaaggaaaatttcagcctcccgaattatactattatccagggtgattagatagaggagaggctgagaagccctgatctcagcggggcatggattaaggggaccccacagctcagccaggttcccagcgattcaaggtcctgcgatttctcaccgacttggtggctccagggtgcctggggctggctgtgcttcttggggagcaccaggtaccactgctgcttcgaggccctcaatagccctttggtggacccggttgtgttctgagcttggggtcctgagatgcagacaccccccagccccagctggtgggcgtgcagctagctgccttcatgtatttgctgcagggagggaattgggggtgggggacaaggatgcaccaggctgagttattccttctgcacatcatcctgcccctcacctggctgcaggatttggggaaaccctggagacccccatagctgggaggttcctgccccagaaggaagcctgagcaggtgaggggggtctcctgggtgctagggcccctctgtggggaaggtggtttatttctctggctgaccaggctcccccgaagctctgtgctgggatagaagtgtcccaaagacaccctgcccccaactcataccctacagtcgaagcctgagggccccaggtccccctggcgtgatcatcattgcttcctgtccacagcttgtcagcccctgatcccagggttgtcaccatctgatcaattgctttttctctgagcctggcacatagtaagcactcaataaacgccactgcctgggccagggtcagggagggatccaccttcctgtggcctggctgccctcctggccaaaaaacctccctggtacagtcccttccatagcttgggctacagctgactgctctgggctggcaacttcctgcccggagcagcctgagcagccgcctctcccctgagaagatcttttgttccagctccccatgacgccccgagcccagcccatgaggcaggcccccctgtggcttcccatggcgggcgagcctgactccgaggctggagctcttttctaacagtgatagtaagaaaatagcagcagccacttatgagccccatgccaagcacactgcagacatcagttctttttttcttatagagatatggtctgcttctgtcactcaggctggagtgcagtggtgtgatcacagctcactgcagcctcgacctcctgggctcaagcagtcttcccgcctcagcctcctgagtagctgggactacaggcccagccaccatgccaggctaatttttttgtatttatagtagacatagggtttcatcatgttgcccagcttggtctcgaactctggggctcaagcaatcctcccgccttggcctcccgaggtattgagattataggtgtgagccactgagcccagcctctcatttttgttttcttccttttgccctgtgacagttttcctgatcattggtgggtttgggacctggacagagctactgccgactcctgactccagctggagctgaatgagacttttatattctctcctctgggactcactcattcatccaataagcattcattgggaagtgagcccttcttgtgtgcatttaggcactgatcagacattttgggggtcccttctgtgtgggggtctctataatcactagctatggggccgctctgtttcagcttccccatctgtaaaatggaagtaatcgttggacctacctcctagggctgttaggaaccttggaagaggtaatattttgtaaaagtagttagaaaaatgcctgatatgatcttggcatggtgccatgagcctgtagttacagctactctggaggctgaggcaggaggatctcttgagcccaggagttcgaggcagcagtgagctatgattgtgccactgcactccagcctggaagacagagtgagaccctgtctctaaaaagagaaagaaaaatgtctgatgtgtagcagacgctcagtaaatgccattgttcttatgggaggactggtggaaggggcccaatgaggggggttcccagccgttgcctgggcagtgagggacctggagtgggcgcagctgttttgaggaaggctcctgccagggtttggccctgcagttgggcttcaagactctgacatacaggactgtgcggaaggtaggacggcccagggggcgggggaggttggttcatgctggttgccacgcatctgccgggagagcaagagtttgcaaatccaactgatctcttgcattcatatgttcattcattcaagaggcattcattgagctcctgctgtatgctaggagctggagatgaagcagggaatgactcatggaactcagtctgttggagagatagtcactaataaaagcatcctgtcaagtgataatgtgtgaccagtgtgctgaaggtcaagttcagttgggagctcagaagaggcttctcttatgtgcaattggaagcagacagggcagagggaatggctcatgccaacacccacaggcagctggcgtgactagcggcagatcgtgtaggtggggcaggagcctgggtctggaatcacagctctctgggcatcctccaagccacgagggcagcgcctgtctcacctgtgtcaaggctgggtgtggggaacagtaggattgaccaagaacaggtgcccttatgcaggggttagaccctccccccttcagggacaggaagaacatggtggccaagggcagatgtggcccctccctctcccttcccatctgcctgacagcttttagtgactacttactgtgtgcaaagtacctactgtgtgcgggtcccaaggaccctgtgatgtacaaaactgtcgactgtagcagggcacggtggctcatgcctgtaatcccagcactttgggaggccaaggtgggagggctgcttgagcccaggagtttgagaccagcctaggcaacatagtgagaccccatctctacaaaaaatacaaaaattaaccaggtgtcgtggtgtgtgcctgtagtcttagcactttgggaggccaagatgaggatagcttgagcctgggaggtctaggctgcggtgagccatgattatgccactgcactccagcctgggtgacagaacaagaccctgtctcaaaaaaaaaaaaaaacattgtcgactctgcatggcccccttccatcgagggcagaggcacctacttgtgctttttggggtttcttgtggagatcggctgtgggggttccaccatggcctcatgtgacaggggcaccctttgttgccactgccctgcagacatgcccagcgggacatggccacatgcagagacggtgcctgtggaggggtgtgtggcagagagaaccccatttgtaggttcgcatctccaccttgcattccctttcatgggttccttacaaggtggatgccatgctgccacctggttggcagatgaggaaatccaggttcagagaggttgagtcaggcatcaggagccacacagccaatacgtgtccccctttgtaatgtgagccctgggagagcagtgttcgtctgtgctgttcaccgtggtatctcagggcctagcctggtgtctggcacacagtaggccctcagtaacacctgaagagaggatgaaggagggcgtgattggaggcagcaaatgtacccaggcccctgtggctctgtagcttgtgttgtgcagccactacccctgcccagggagggagtcactggagtggcactgctgttcattcagggtgtgctgatatcagggatctggggcccagttttgtgcctgagtagggagagcatttcttctccatcttgaagagcgacatggatatgtggtctccagcaggggcccaggcccagcgagggtcaggaggaaggaaggatggtgcccacagaggtcccaactgttctgcaccgtggacagcagaggggtggggggtctcagtgccattctggtgatgttgtgcctaaggaaaggccctctggccatgggaggagaaggatgccccagttgagatgggcaggcaaaggtctgctagtcctgagggtcccctgtcagtgcaggaaatccctctggacccccgtgacttttgttaatttattcctttttattttttgttttatatttatttttgtttttgtttttgtgtgtgtgattttttttttttttttttccaggacagagtctcgctctgtcacccaggctggaatgcagtggcatgatctcagctcgttgcaacctctgcctcccaggttcaagtgattctcctgcctcaccctcccgagtagctggcattacaggcacacaccaccacacccagctaatttttgtatttttagtagaggcgaggtttcaccatgttggccaggctggtttcgaattcctgacctcaggtgatccacccacctaagcctcccagagtgctgggattacaggtatgagcagctgcccccggcccatttatttatgtatttatttatttatttatttatttagagacggagtctcgctctgttgcccaggctggagtccagtggcgtgatctcggctcactgcaagctccgcctcccgggttcatgccattctcctgcctcagcctccccagtagctgggactacaggtgcctgccaccaccccccgctaatttttttgtatttttactagagatggggtttcaccgtgttagccaggatagtcttgatctcctgacctcgtgatctgcctgcctcggcctcccaaagtgctgggattacaggcgtgagccaccgtgcccggccctatgtttattttttagacaccaataatatactctcaccgcaacatggaaataacaacaatgtcagccagtctttatgaagcattttctacgttctagggctttacagctatcaattcatgctcataatatgcctatgaagtaggcatgatcatggttcccctcttacagatggagaaactgaggtagagagtaatcatgtaagtcacttaaggtcccataactaataagttgttgctggttttttttttgtttttttgttttttgttttgagacggggtcttgctctatcacccaggctggagtgcagtggcaccatctcagctcactgcaacctccacctcctggattcaagcatttctcctgccccagcctcccaagtagctgggactacaggcgcccgccaccacagccggctaatttttgtatttttagtagagatggggtttcaccacgttggccaggctggtctctaactcctgacctcaagtaatccacctgcctcggcctcccagagtgctgggattacaggcatgagccaccgcgcgtggctggtgctgggatttgaacccacattccagaatctgtgttcttagccatccttgctagagataagcagtaacaggcttcttggttacttccccaccatccccacatcccaattctgattcctccccagaggtacccactgtttcaggatgagtttgcttctgccagacctttcttgcccaccatttacaaaatgtttgtgtacacataaacattagtagtttggttttatgtatgttcatgtaaatgggattgtctagggtgtcttgttctgccgtttgctttttcgcttagtgaatagccctggagctctcccagaggtggtggggtgggtcttcctcactctttccccctgatgcagtcttccagcctatagatgggccagattctttcactagtctccagctggtgggcatttaggttgtttctagtttttccccattataaacgttttagcaggaaatatgtagcagggagcaagtatttctcttgaatacttaaaagtgggattcctagagcctgattgctctggctaggactgtcagtactgtgttaaatagaagtgaccagagtgggcatccttttctcatccctggccttaaaggaaaagttgtcaacttttcaccattaagtacaatgttaactgtgtgcttgtcatatagggcctttattttatttatttatttatttatttatttattttttgagacagagtcattctgttgcctgggctggcgttcaatggctgatcatggcttactgcagccttgacttcctcaggctcccaagtagttaggactacaggtgcacgtgctgcaatgccaactcatttttgtgttggtttttttggagagatgggctttcaccatgttgcccaggctggtctcaaactcctgggctcaagtgatcctcctgcctcagcctcccaaagtgctgggattacaggcctgagcctccgacctcagcctttatatagggccttcagtgtgttgaggtacaacataccatctatgcttaatttgttgaaaatttttatcataaagatatgttgaattttgtcaaatactctctctgcatctatcgaaatgatcatatggtttttgtacttcaaaagcaggattccagagtctagaatcaattctgccaaattggccatgccccttacagaatgccacttggtaggggagtgcatgtttccctgcatcttcaccagcactgggtgttatggtcgcgttggatttctgctgtggtgcccggtgtgtaatggggcctacacctgcttgcccacctgcttactccttgtcgcccccccacccacgtgtctttcagcccggccgcaccacctgggtctccgccatgaacgggcctgccctgcagccctcctcgccctcttccgcgccctcagcctccccggcggcggccccgcggggctggagcgagttctgtgagttgcacgccgtagcggcggcccgggagctggcccgccagtactggctgttcgcccgggagcatccgcagcacgcgccgctgcgcgccgagctggtgtcgctgcagttcaccgacctcttccagcgctacttctgccgcgaggtgcgcgacggacgggcgccgggccgcgactaccgggacacaggccgtgggcccccagccaaggccgaggcgtccccggagccaggccccggccccgccgcccctggcctgcccaaggcccgcagctctgaggagctggccccgccgcggccgcccgggccctgctccttccagcactttcgccgcagcctccgccacatcttccgccgccgctcggccggggagctgccagcggcccacaccgctgccgcccccgggacccccggagaggctgctgagacccccgcccggcctggcctggccaagaagttcctgccctggagcctggcccgggagccgccacccgaggcgctgaaggaggcggtgctgcgctacagcctggccgacgaggcctccatggacagcggggcacgctggcagcgcgggaggctggcgctgcgccgggccccgggccccgatggccccgaccgcgtgctggagctcttcgacccacccaaggtaagtaagccctgcccgcggggttgcgcactgcactgcgcccttcgccttcaccctggggagagcgcgggctggggaggtgtgatggctttccagctggtggccacagagtgtccagagggaactaggccctcttaaaaaagaacttttaggccgagtgcaatggcttatgcctgtaatcccagcactttgggaggccgaggcaggaggatcgcttgagcccaggacttcgagaccagcttgggcaacttagcgagaccctatctctataaaaaattagccaggtgtggtggtacgtgcctgtggtcccagctgttcgggagactgagaagggaggatgacttgagcccaggaggtggaggctacagtgagccgtgatcatgccaacacactccaggcctgggtgacggagtaagaccctgtctctaaataaatacaataaaaaagaactttttattttagaattttagatttacaggccaggtgcagtgggtcacgcctgtaaccccagcactttgggaggccaaggtgggcagatcatttgaggccaggggttcaagaccagtctggccaacatagtgaaaccctgtctctactaaaaatataaaaaattagctgagcacagtggcgcacgcctgtaatcccggctacttgggaggctgagtcaggagaatcacttgaacctgggagggaaagttacagtgaactaagattgcaccactgtattccagccttggtgacagagtgagactctgtctcaaaaaaaaaaaaaatgtttagacttacaggaaagttgcaaagatagtagtgttcctttacacatggtacccagcttcaccgaaggttcacatcttacgctgctgtgtacattggttgtagctaaggaaccagcacgggtacatcactattagctaaacgccactgttcctttggctttgccagttttcctctaatgtcccttttctgttccagctcgccccccaggataccacatgaggtttagtcgttacgtctccttaggcgcctcttggctgtaacagtttccaaccctctattgctgatagccttggcagttttgaggagtaccagtcaaggattttgtacaatgtccagggacacctttttgccttcacatttgggtgtcatgtgggctggtagcaggtcactctgagatccttgaaaactctgactcagactggcattgacagattggtgttttatttccagagggctcaaaaccttcagagaatttctctgcacctcctgtgccttggtgatattttgcaagttaaaaagaatttgtcctttggcaaaaccccattgctacaaaaaataccaaaattagctgggcgtggtggtgtacgcctgtggtcccagctactctggaggctatggtgggaagatcgcttgagcccagaagaccaaggctgcagtaagccaagatcgcaccacagcactacagcctgggtgacagagcgagaccctgtctcaaaaaaaaaaaaaaaaaaaaaaaagttcttttccttcacagctggcttaattcctactgtgctgttgaggctgaaaggtcactgtgttctactcacctgccaggctccatctttgactcaggtatgcatgacaggaccatatggctttcatctaattgctctctctttgggatcctgttacgtggtagggccttactctagagcatgagcaaaaccgatgtgatactggccctgaggggctcacgatgtgggtggaggaaacctatggttactctttcattcattcgacagatatttatggagcacctactatgtgttaggcacatgctaggttctgggggaccaggcgggcctagtggaggctgttgaggaaataaacccacagatgagcatggaattaaaaatggtaaattgtgttctaaaactggtaaactgtgttctaaaggaaaagcaatggggtctctgggaggataactgaggggtcccggtttggcggtttgggagagtcatccaagaatcctttgaagtaacgttttcaaactgactgtggcgtaacatgcagacctggaagtgcgtgaagtatgagacacatctgaagctctgtgtttccgtgtgtgtgcaacgcaagtgaccagcaccccagagggctccttcatgcctcccccaggccagtgccctgtacccccatacataccacctcttatcaccacaggttcgatttctctgttcttgaacatcatgtgaatggaatcacacagtaggttgcctttgttttattttattattttattttgagacagggtctcactgtgtcacctaggctggagtgcagtggtgtgatcatggctcgctgtagcctcaacctcccagcctcaggttatttttgtgcctcagcctccccagtagctgggatcaccgtcacgtgccaccactcccagctaataaataggttgccttttatttctggctccttttgcccagcataatgttttagagattgatcacattgatcgtacatgtcaatagtgtcttccttttttttttttttttttttttttttgagacaaggtctcgctctgtcacccagctggagtgcagtggctcgatctcagcttactgcatcctctgcctcttgtcctcctgggctcaagcagtcctcccacctcagcctcccgagtaactgggaccacaggcacgtgccaccacacctggctaatttttgtattttttgtggagatgggatttcaccatgttgtcaaggctggtctcgaactcctgggctcaaatggtccccccacttcggcctcccaaagtgctatgattactggcatgagccaccacgcccagccgggtttgtttcttttgagtactgaatagattccattgcacagctgtctccatgtcccacaactggtttatcccatcctctgttgatgaatatttgggttgtttctattttgatttatgaataaggctgttatgaagtttgcatctaagtctaaatatggacacacatcctttcatttctctcaggtggattcctagaagtggcattgctcagtcatagagtaggtacatgtttactttagagaaattgccagacttttcccaaagcagctgcaccattttgtgtcccaccggcagtgggcgagagttccgggtggttccacttccccaccaacacttgagcacttggtgggtttttttgtgttttgttttgtttttgttttgagacggagtctcgctctgttgcccaggctggagtgcagaggcacaatctcggctcactgcaacctccgtctcctgggttcaagctgattctcctgccttagcctcccaaatagctgggattataggcgcgtgccaccacacccagctgatttttgtatttttagtagaaatggggtttcaccatgttagccaggcacttggtgttaagagtcaccggtggctgcgttcctggatctcaaggtggctttactttgcgtttccctgatgactcatggaggttaagcaccttttcatatgttgattggtcatcggaatttggtcgtttgtgaagtacatgtttttattgtctgtctagccttttttaaattgatttgtaaaagtcgttatatattttggacaatttctttgcgttttaaaagtcatttcctacctttatggcctggcttttcatgaaaagcagttttgttttttttttttcttgagatggagtctcactctgttgcccaggctggagtgcagtggcgcaatctcggctcactgcaacctctgcctcctgggttcaagtgattctcctgcctcagcctcccgagtagctgggattacaggcgcatgctaccacgcctggctaattttttgtatttttagtagagatgggttttcgccatgttggccaggctggtcttgaactcctgacctcgtgatccacctgcctcagcctcccaaagtactgggattacaggcgtgagctacctcacctggcctcaatttttgtatttttagtagagatggggtttcaccatgttggccaggctggtcttgaactcctgacctcaggtgatctgtccgcctcggcctcccaaagtgctgggattacaggtgcgagccaccacgcctggccaggaggtcacttactttcattctaagtaaatcactgggccttccaggcagagggaacagcatgggcagagaccctgagtggggaatgtgtttagcatgttttgaagaaaggacaagatgaagaggccggtgtggtgggagcagagagagggagatggggagcggggaagtacatgtgggtggaggacactgggaacgggaggacttagtgttttattccaagcacaatcagaagctgttgggaaaacgcaagcacagataaaaaacggttttctcatcatttgttaaaaatctcaaggctgtgacaccatgaaagacaaataacggccccaatacatgatcttatctgtgtgacactgtagggtttttatttttttattttttatttttttgagacagagtcttgctctgttgcccaggctggagtgcagtggcacggtgtcagctcactgccagctccgcctcccgggttcatgccattctcctgcctcagcctcccgggtagctgggactacaggtgcccgccaccacacctggctaatttttttgtatttttagtagagatggggtttcaccgtgttagcccggatggtttcgatctcctgacctcgttatctgcccgcctcagcctcccaaagtgccgggattacaggcgtgagccactgcgcccgtccagggttcttaactttgaaaaacaacctcagtggctgggcgcagtggctcatgccagtaatcccagcacttagggagaccaaggcagattacctgagattgggagttcgagaccagcctggccaacatggtgaaaccccatctctactaaaaaatatcttggtggccaagcgtgtggctcatgcctataatcccagcactttgggaggctgaggcaggtggatcacctgaggtcaggagctcgagaccagcctgaccaacatggtgaaaccccgtctctactgaaaatacaaaatcagcctggtgtggtggcacatgcctgtaatcccagctactacggaggctgaggcaggagaatcacttgaacccaggaggcggaggttgcagtgagctgagatcgtgctactgcactctagcctgggtgacaagagcgaaactccatctcaaaaaaaataagtgaatatataaaaaataaaaataatcttggaagaccaggtgttgggagccagctggccctgggtttgaataatgaataagctgctttctcagctctggggcaagtggtatcacctttctgagactcagtttccccctctgtacattggggagtactcatagttcctaccccatagggctgtgtgtcttggtggggagagcgcatgtgccacgtgcctggcgctgggagcactccatgagtgctgtgttgctgttgccacggttgttgtggtttgttatggttttgacttcgggcggagagcccaggtttatttccagtgcttgctgggccctcaggggaaggcatccccaagactcctgttctctgggagccctgatggtagggccccatcagattccctagggcttttcccaatccagggaaccagggaggtcccagagggctttgccgtagccctggctggctggggctctgtcacaggcttggtggttgctgcggggcctggggtgttgcctgcaaagcaagcagccctggggaggcttctcctagcccctcggagcatcaggtggaacagtccgggcggctcaggagcatcccctcagtgaatctgtgtccaggtgatgggccaagggtgctcagaccacaactcttgcatgtgcttgccaggtagtcaactgtgatccctgacctctgacccaggggttggctctgggaacagttttaaacaaaaggaaaagaaagttctgacaaccagtgggtggtggcgaagggcttaagctttggatctgcacttgcggtctgtcacttaaagggtgccctgcaggagagggagcagatgtaatcccagtgccagcctggtggaggccctgctgcccagggctggaagaggctttggagggagagagccaagagaaggcagctgcccagaagtctgaggccaggtgggctcagcccacaggtgagcctcacctgcagttgggccccagctctgcccccgacctgctgtgtgaccgcgggcctgtggagcagggtgatggtgtagcacctccaggggcactatgagggctgcgctgggagagagcactctgtgactgggggtgtgcaaggggaggccacagtctgccaggggtgggggtgtgggtggaggagatgtctgtgttttccaaggtcaggagaaggggagaaaagtcccagctttctctggtctcagtggccactgcaggtgggcagcgtgggcccttgggaggtgggagggggctgccttccctggggttggtcagcaaaggcctcttggcaggaggtgccggtcctgatagatctgggtgaaggagtcccaggctgaggaatggcaggttcacaagccctgcagtgagcgtgaaccaggcaagtctgtggaatagccaggcagcctggggttcgagggaacagggaaaggtgagactacaaaggtagtggagctggattgcagaggcccttgtgggccacagtggggactttaggttttacattaagagcagtgggaacaattggaggatttaggcctagagggcctgagacacttgctggggccacctgcgggtgggagtgggtgcaagggaccctccaggctacctgtggtctcccagctcaggcccgcgatgggagagtatgacatgatttcctctagagacctccttcccctgggcaccgctgagccccaggcagggcaaggacaggggagcagtgtgtttatgtgggggaaaggtgacatgcctttcatcacccatcatcgggctcacgaccgacactcttgcaacaagacaggtcagcaagagaaaagcatcacaaagttattgaatcaaagttttatgtgacatgtagctttcaggaatgaagaccgaaagaccccaggaaatggtctgtctggtgtttaggtttgatggagcagggatagctgcgtaaaaatgggattgggatgaaagggtgtgatctactgagctagacggaggcggggtcccagcaaggcctgcttgctcccattcctcttggcctctgcatggtgttccttcctcccagtgtagggcaggacctctctggaacttacaacctgcctccctcagacaaggtaggttggagaatttctctgtggatggctcctacccaggaaggtaggggaaggttagagttatatttctaggttttatggctggctttcagggagaggggttctagattctatgacccaccttgaggaagaattctggttccgtttttcttttatctttttttttttttttttgttaagagagatggggatttgctatgttgcccaggctggcctcaaactcctggccctaagtgatcctgctgcctcggcctcccagtgttgggattacaggcgtgagccactgtgcccagccgcctagtttctatgactcacttcaggggagaaggagggtgagagagacaggaaggcagaaggaggtgagagagactttgcttctgagggccccttctgagcccttctagtcttctttagttcaagtacgtagcatgccacagcacctttctttggggtgttgttttctgagccccaacattcatggccctgaatgtgtgcctctgtgtgccaggtgttgccctaaattcttggaccttcccatgagctggagttcactgacccatttgacagatgaggaaactgaggcactgggagaagcaaagagacttgcctgggatcatgaagtgaaggggatctgaaccctgagacaggaactcttgatcccaaggggcccctaaccccaagcccttggccccctgctgaactggttcaaaccagagagtgtataacccagctccaggctgggctgggcctgaggtgtgcgtctcacctggcagttacaagaaaaggaaattgcactggttgccacatttacaacctaaagtggagagatttcacagaatccagacttctggtttctcttatggaatccggggatcggccgggcacggtggctcatacctgtaatcccaggactttgggaggcgaaggcagatggatcacttgaagtcaggagttcaagagcagcctggccaacatagtgaaacccagtctctactaaaaatacaaaaattagctggccacagtgacgtgtgcctataatcccagctactcgggaggctgaggcaggagaatcacttgagcccaggaggtggaggttgcagtgagctgagattgcaccgttgcactccagcctgggcgacagagcaagactccatctcaggaaaaaaaaaaaaaaaaaaaaaaaaaaaaaatcagaggatctggcggtgccaggccggcattggagggggtcccagcctggcctgtgctgccactggttcagcagtagagcctgacggggaggcgacagcagtgggggccctggggaaggagaaagattccagaagcagctgctaggctggagtagctggccttgggccccagaccttcccggggaggtggggctcccatttcaaatggagcatgcccagcctgccgggcctcagtttccacatatgcccaggcatggattagctgagatggtcttgaagtcctgccagccctggtggttctggaggttgagcctcagtttccctcatctgtacagtggaggacatgatggagttctagctgttgataaatgccctttaaaccaccatttattgggctttccttatacagcaggcactttactgacctggcttcattttatcttcacagcagccctgtgagggtagctgcgccattaggcccatttcacagatggggagactaggtctgagagagcttaggtggctttcccaaggtctcacagcccctgtggctgagaggggcttggaacctgggcagttggctgcccctgtgagcagtgagtccttagaaggacttactgtcagtattattgatggcactgttaactagggccctgcatgggtgggggcacctgttttgggctcttggactaggaaaagctcctgtggccattttatccaatgccaccattttatagatgccaacaccgaggcctggagggggctggccagcgcccctcacctggcacagaggactctgcctggcacatcccacccatggcctctgatgcccagcttggagaagtggtagaagaggggctgggggatgcctcagggggacttagccctcagccctgagccccccgctgcatcacaggcctgagtgcccaggaggcagtggtctgggtaggagtggctgcgactcgggggtaaatgtgcttcagagccatccccactcatcccctttcgagccaggtgtccctggtgtgtgacttggccttgctgggcctcagttttctgtaaaatgggaagtgtcatggggggcaggctacggtaagcactgatagggcaggtgaggggcagcctcgggcccacccttctggcaggagacatttggggcacccagaagccctggaacaaggccactctgaccttgattttgggagcacaaagtccccccaagagatagcacaggagcccgggtgtctgatgagtgacccatcccttgggggcctcagttcctgggtgtgcctgggtctgcaggggaggcagaggcacaggtgggcagctccctctgggtgggctgtgaccctgcctgggcacaggagggccgtgcccgtccgtccttgccgtgattcttccaggtggcaccgccctcacacctcctttacagaggaggaaactgagacccggggaggccacaggagtcgggctctgggcccagagcctgggcggggatgcaggagccacccccatgcctccgggtgtgggaaaggggaagcagaaagaaagggacgtccgccggaggcctggcggtttcctctcggggcaggagtgcgaggaggaggaggaggaggaggaggaggaggaagaggaggaggaggaggaggagggacggcaggaagccgcctcgggctctgacaggcgcggccctggcctgcccctgcccttctgagcctgtgacccgggggaaggcactttgccctccctgtgcctcagtttactcaagtaaaaatagctgaatgatggctctggccccaggatcaactgagtgctgtctgggaagcacctagagctgtgcccaacacagccagtgttcgctggggcctgcaaggctttgctgctgcaggcatcactggcgttgtcatttttatttattatttatttatttagagacagagtctcgctctgtcgcccaggttagagcagagtggtgtgattttggctcactgcaaccaccgcctccagggttcaagcaattctcctgcctcagcctcccgagtagctgggattacaggcgcccaccaccacactccgctaatttttctgtattattagtagagacgcggtttcgccatgttggccaggctggtctcgaactcctgacctcaggctgtccatctgcctcggcctcccaaagtgctaggattacaggcgtgagctaccgcgcccggcccatttttattaattggttttcatgtgacaggcactgtgtccgccacatcccatggaatccttatcacaaaccccggaggtggggacagtgatgaagccatttcacagccaagaaaactaggcacagagaggtccagaaacttgcccgaggccccagagctggtaggtggccaaggcaggaaatgagagtccctggtgggtctgccaaggccggggggcaccaggggcagggggtttgtgtttaggccccagaacaggcagagagaaagcacccaccctccaccgtcagaacgagcctgtatcccggcaagcagggcagactgagccctggtcttggcaggcaggcagagctcaggtcctggcgggcacacaggcttaagaagccggttttttcctgggcccacgtctcctgggggaccagcggcagaggctcctggggtaggaacggaggtcccatcctcactctgtcctgggctgccatgtgacccaggtaggtcccagtcctctctgagctatgaagtgggtgcctgcagtggccttctgggagtgatggggaaggcggagggggttgggcagggctcctgcggccccagccacacacactgccgccccatctgcccccttattggggttccatgcaaaatcgtttttgaaaaagtgctttgccgcttagaagaaacccccgaccgcgctgaaaccacgggggcagatggtatcggggcgcttcctttcagctcaaattctgcgaatccacagcctagaaagtgccctgaatccaacaaggggggaggtaattaagttattatggtccatccccaccccgtcctgcttaccaggcctggctgctcttactggcttcttggaagttggtgtggtatttttttgttttgtttgttttcgaggctggtattgagatgagaccattgtggggtcagggctgtgggcttggaggttcagggtcagggtccaggggcgaagggtggacgctggagaagggcagatggacagggtcaggttcagatcttggctcttgtatccttgctgtgtggctctgggccaagaacttggcctctctgcgcctcagtggctcattacagaaaatgggatgccagcacttgccttagtgggttgttttgagccaactgcaggctcagggagtagctggcatgatgtgttcctaccctgaagggcagaaaaaggggaaggaggccaccagatcccacaggtgggtccccagggtccctccccgggatgggcagcagcctggctgctccccacagcaacccctggctggccccattggcgctgctggaaatcccccacccagttctttgtgaatggaaaaggaaactgattgcgctagaagaggtctccgagtgccggccgggggtggggggcggggggggcttcctctcccagtgcaggaggggccacctcagcttcctttctggggccccataccccctttttcctatctcccctctgagttgaggaggaggctgtggcccccgcccactgtttggcctctggaaccactgggtgacagtgtacatcggggcgattaagggccacctggcctctggacctccctcgctgtggctgctgcctgggaccccccaccccatgcctgactcgaaccccaacctcagctctacacacaggggcaccactgtaggaggagagagaaacctctctctagggaaccacctggaagggggccctgccctgtcttcatctgggtaccccatgtaatctaggaaactgtctttaacttgccgagggcctccatgtctgagttcctaatgttttttattttgctttttcaattaataaagctcatggcagaaactatttaaagaaaaaaaaaaacagtaacagaaaaacctcccacaatctcactacccagagagaaccagcatttccattttggtagatgtcattattgtcatttttgttttgtttttgagactgggggacactgctctgtcccccagactagagagcagtggcgccatctcggctcattgcatcctcaacctcctgggctcaaggtgatcttcccaccttagcctcccaagtagctgggactatttaatgctgctattagcatagacattagcaggacaccatgccctgctaatttttaagtttttttgtagagacaaactctcactatgttgcctaggctggtcttaaactcctaggctcaacagtcctcccgcctaggtctcccaaagttctgggatttacaggcgtgagccaccaccacacccagcctcttctctgtctttaactttgcctccgcctccaaattccaattccttcagcaattgctgggaagggattactttttgcacaattctgtctggagccccttgcaggcaggagcttgtggacaaaagcttcagcctttgcgggcctggcattcctcatactatttggtcacctgcttttttcactttgtgtcctgaacatttttctgtattcttttttttttttttttccacctcctaggttcaagcgattctcgtgcctcaggctcccgagtagccaggattacaggcatgtgccaccacgcccggctaatttttgtatttttagtagagacggggtttcaccatgttggccaggctggtctcgaactcctgacctcaggtgagctgcctgcctcagcctcccaaagtgctgggattacagccaccgcgcccagcccatttttaacttttttgctggtatagatgaccctgggatgaacaccttatgtcagtcttggtgcccacttctgatgattttcttctgctcagttcctagaaggggagtgctgggtcaaggcttttatgagcacttctgatccgttcttgctctcaaagctttattgagatataatttacaaaccataaaattcgcttgtgtaaagcgtataattcattggtttttagtatatttacagagttgtgcaaccctcaccataatctaattttagaacattttcgtcatcaaaaaaggaaaccttgtacccatgaacagtcactccccatacctccctccccagcccctggcaaccactcatctcttttctgtctccagggatttacctattctggacatttcacatatgtggaatcagactatgcagccttttgtgtctggcttccttcacttagcatcatgttttccaggttcaccgaagttacagcatgtattttgttcctttttatggctgaaaaatactccattgtatggacttgccacattttgcttatttgtttatcacttaatagacatcaggttatctccactttctggctgttatgaataatgctgctatgaacattcgtggacaagtttttgtgtggatctgtgttttcatttctcttgggatacatctaggagtggaattgctggggcatacagtaattctatgtttaattacattgggctgggcacggtggctaacgccagtaatcccagcactttggggggctaaggcaggtggatcacttgatgtcaggagtttgagaccagcctggccaacatggtgaaaccctgtctctactaaaaatcaaaaattagctgggcgtggtggtggatacctttaatcccagttactcaggaggctgaggcagaagaatcacttgaacccaggaggtggaggctgcagcgagccaagatcatgccattgcactccagcctgggaaacagagagagactctgactcagaaaaaaaaatgactatatataaaataaatatgactgccaacctgttttctgaagcaactgtaccattttatattcccaccatcattgcgtgagaggactccagtttctccatgtccttgccaatatttgttattgtctgtcttcttgattgtagccatcccagccatcttaaagggtgtgaagtagtttctcagtgtggtgttttttttgtttgtttgttttaaacggggtcttgttctgtcacccagcctggagtgcagtgcagtggagtgcagaggcagctcactgcagcctcaaactcctgggctcaagtgatcctcccacctcagcctcttgagtagctaggattacaggcacacaccaccacactcagctaatttttgtttttcactacactacgtgatgtggttttttgttttgttttgttttgtttttgttttttgaagagctggggtttcaccatatttcccaggctggtctcgaacacctggattcaagcagtcctctcacctcagcctcccaaaatgctgggattacaggtgtgagctaccgggtttagcctcagtgtggttttgatatgcatttccccaatggaaaatggtgttgagcatcttttcatctgcctaatagccatttcttattcttttgatacattatttttgagtagccttccagaaaggtcatacgcatatatcttcttgtcaccagtggtgccagcactgggtattattttaaaaacctttgccaccttctggatgaaaagtggttatcttatcctaagtgtgaccatttctctttgttaaaagttgagatatgattcatataccataaaattcacttgtttaaattgtacaatgcattggcttttagtatatttaaacaattgtgcaatgatcaccactatctaatccagaacatttctatcaccctagaaaaaaaccttggagcagtcagtccccaaactccctgcctccagcccgtggcaaccactgatctttctgtccccgtggatttcgactgtttctcttctgttccttggtcatacacatttcttgtgatttatcaggctatttactcagcatgtttgtctcctgcactgcttgcctttttcttgatttgtgaacactacacggcacggatattagctctgtcccatgttgcaaatatttccctggtttccgatttgacttttcaattttgttcctgcatttcttgacctatgggggtttgcaagttccaggcagtaaaatccagtgatcttcgcctttatggttttattctttgcttttttaccttagaaaggcctttccccacccaggatcagataaataattatttaggttttattctagttctgtcttggtttcctttttcacttttaattatttaatccagctggcttttgttatgggtggctggtgtgatttcctgttgttttgtgatgtcagtgagaggctgtgtgtcaaggcctgtgacatggtaaacgttcagtaaacaggagctaaaatgatagtaatgagagtccgtgccgggtggagctcagaaggacatgggattcccggtgctgtgccgtggctggaggaggacctggcctggctgtgccagttggctgggagcccctccaccccagaagcccttgctctcacctcttcttctgaatcatcgttcttcgaaggcaggcagtagctaccgttgtctggggctttggggatcttggtggtgatgagtcccctctcctctggtgcactctccccacccgagacgggcgacagaggttttttgttgtttcttaaccacatctttttccacccacacccggtgcagagcagatgcttggccggggcttccccgagctggtcctggctttgtggcagggggatgggccgtcggtgccccattcaagcctggggacctggccccactggtgtgtgctacagtagacccagccctggggccccatgataccctcggtgatcgtcacagatgcggggcctggctacagtcctcactggtgttttttttgtttttgagagggcatcttgaagtagcccaagctggagtgcagtagcacgatctcggctcactgcaacctccgcctcccaggttcaggtgattctcgtgcctcagcctcctgagtagctgggactacacatgcaccaccacgcctggctaatttttgaatttttagtagaggcagggtttcaccatgttggccaggctggtctcgaactcctgacctcaagtgatccgcccatcttgacctcccaaagtgctcgttacaggcgtgaacaacccccacccactgcagggagccaggcttgccccctccctgccaagggagctgcttgctctcccttctgtctggaggccagcacagcctggcactcgtggtttggggcgtccatggccttgtggtggcgaggcgcagaaggcgtcacctgaaaaaggtgtggccaagggcaggggtgctgggcttagccaggctggccacagtgggggcaggaaggattcctatggggacagctgggagcaggatgtggtcgtgcgaggcgtgggctgacggcagctggcatgcagcaggggaggtgtgctgggaccaggcctggagtggggtctggtggccctgccgtgtatggagctgagtgccgcccagagatgccatcttgtcctcagaagtggctcaggcctgctggggacagggcaggtggatggaagctgctgcatgccctgtgccatgtgctggtccgctggctgtcactgcagcgcagctcccggtgcctgacagttgtttgtccttatttggcacttgagagcccagcggtttggccagaatggtgccctgtgcggagggcacagcttgagtgaaggtgtggagggaaaaggccctgggggtgtggctcccctccttccatcctgctccttgcaaggcccatcccaggacattcctcctagccaggtgggctggatggggcctggacttcctgtccatgttttgggatgagagcgctggggaaggtgcccactgcggggtagggagtgtagggctttccaggcatcatccctcataagccactgtccccaggccttgcgcatagccccaccatagccgactcgagagtagaagcgtcccaccatcctcacagcaggctgcaggggccatgtgtaactggcccctccacccttggccacctggtggagtcggcacccatatctgaggaggggaccatgttgctgctggggactctgggctggtctggaagcaggtgtggtgggggctgtctttccctgtgtgaaggtcttcctctgggtgtctgtcgctgtagggaggccactctagcatctgaaaggggctctgtgtccttgccatcatgattctgtcttgggggtggttgctgtctctctgagagggggctttgtgtctgtgtccctgtgattctctgacatgcaggaggaccatgatgggaactgaggggaattcactctgggtggggttttagacaggtccccaagtcctgtctgtcccagcatctctggctaatcacttcccccgcccccctcccgccacacacatacacgggaaaagcaggctggtgtgtgtcctgttgcccacaccacactcagtcactcagtgtgagctggggtgccacctgcctggaggggggatctgactctgaacagggattctgtatttgggggtgtcacactcaccatgtctgtctctgcctctaccatctgactgggagaattcctctcagggttggggtgggcaccaagccttgctcccagtaggggcccagccctgggttgggcccagaggaggtgcttggagggtttactgggtgacggatggatgagcacttgggtaggggcctgggacccccaaagccctcagatgtctgggaaatagggggatgttctggctggggaggtttctgtttctggcattggggggctcttgccaggaaagggcttttctggcagccatgtggcttttctggaagcttctcccttctctttcctcctcccctgtggggaaagggcacctgaggcagcagggtgcagaccaaggggggatctggcccataatgaacagggtggtgggggtctaggagccgctgccctgtggactgggcccactgggcattcagggcagcaggcaggctcacttgcagaagtccaaggagtgggttccattatcatccccattttacaggtgaggaaactgaagcacagcaggccaaagtaatttgctcagggccctgcatttgaagggtctgtgaaggaggggccaggcttggggtcctggtggggggcatagcagagaagcgccctgtggcctgtagttcccacactgattcagtcgctggaactggctcattgccttcagtttgccccccaaggagcttgggaaaagggggctgagatcacccatcacaccccatacctccctctgcttcccaggcacttgagagcttgggggtcccaggtacctacccaagtgctcatccatccatccacccggcaaaccctccaagtacctcctctgggcctgccccagggctgggcctcagctggcagcaaggtttggtgcccaccccaaccccaagaggaactctcccagtcagatggtggaggcagttgcgtcatcaggaaaccatggccggttcgataagctcagtgctgagggagaggcacaggaattgcactaatcatgactcagtggtcagagaaggctccctggaggagaggaggttttctctgctgggacatgcagtttgggtcaggcagggcatcacaaatgcaggggctgggtggcaggggaaggtgtgggcgggaaggcggctggagggagaccaggtgttgggggtgctggggctgggggtgggcagatgaggattggagccctggctcaacttcgctattccccatggctggggcactgtgtgattttgcctcccagagtctgtagcatgggggctcctgatggtgcccttgcggggaggtcagggggctgacacacctgagcctgcctttcagcctgccctcttccctggccagctggaggggccttgggaggcccaccccagccctgagagcactggcttgtagcatccctatcactcatggtcttcactggggtgggggatggcagtaggggcaatcatcccctatgccccccgttacccagcacaaaggatgcttagccagcaaaaggcttatgatgaatgttgagcacccaccacctagcaggcactggctcgcggccaaggacaccacgtgagcaaagccaagtcacggcagagacctgcatcaaggaatgcgcaagaccagctcataggacaacaggcagggaaggaagtgaaggggctttgcggctcaggatttagatactgtggtcagggagggcctccctgaggagatgacactttgaaaagcagtcgtatttgtgaagctgtggggggagctgcctctctgagggcacaggccccgagtgcacctggcacactgaagaagagtggaggccagtgtggctggatcagagcgagggagggaggcccaagaggctgaggaggtaacaagggtctctcagatgaggaccacaggggagtttttgtttttgtttgtttgtttgtttgagacagtcttgctctgttgcccaggctgcagtgcagtgcagtggcgcaatcttggcttactgcagcctctgcctcccgggttcaagtgattctcctgcgtcagcctcccaagtagctgggactacaggtacctgccaccatgcccgactaatttttgtatttttgtatttttttgtgtgagatggagtttcgcttttgttgcccaggctggagtgcagtggcacgatcttggctcaccacaacctctgcctcctgggttcaagcgattctcctgcctcagcctcccgagcagctgggattataggcatgtgtcatcacacctggctaattttgtatttttagtagagacagagtttctccatgttggtcaggctggtctctaactcctgacctcaggtgatctgccttgcctcggcctcccaacgtgctgggattacaggtgtgagccaccgcacctggcctaatttttgtatttttaatagagacagggtttcaccatattggccaggctggtcttgaactcctgaccttgtgatctgcccgcctcggcctcccaaagtgctgggattacaggcgtgagccactgcgcccagccgggagtttcttttgagatgagattttgctctgttgtcgaggctggagtgcagtggcaccatcatagttcacggcagcctcaacctccctgcttcagcctcctgtagctgcaggggagttttgagcagaggagggtaggctggagcagcatcgtgggggtggaaatagctaattctggacagacttgggcgtagtctgatgggacagatggcagtttttgatgctgcccaactcccagagggcccaggtgtcacactgttttccagcctggctcctctctcctcactgggggctccttgtgaatacccctttcccccagcagttgtctgggactggaatcctggctgctcagctcccagcatccaccactttctgcctttgagggatgggccgtgcctcccctcctgcacatcttctgtggctccctggcatctggggggaagatgggggacagaggcctccctgcccagctctcttgacctccctcagaccccagccagctcagacgccggtgggtttcagatccacccaggtcccatgttaaaatgcagattccaaactcccttccagatgtcctgtgccagaaggtcatagaagcaccctgtgctgtgttccctcccccttggaggtctcttgagccttctcatctgtgaagtaggtgaaggcacaggagggccacgtgaggctcacacacactgctccttgcacggagctggcccggggcagggtggtgaggcttctccttcataaatctcactgtccatgatgcccaggattgtcctttgctctggaaccatgacgtcctacttggtttcgtcgtgtccttgatggtgtgacgcccatttctgtgacttcctcttggaaaactttttgaaaaatgttgccggcctgtgaattccacaatctggaaactgctggtgggccacccaggctccaatgcctggcacacagcagatgctcactaaagggtggtgtggggtctgtgagcgtcatttccagccacagtcaagcccctgttgtcttctagcctggggctgtgccttctgccctctgggtgttggctcttgctattcccttaacctccagtgcctttttctccaccatccccacttcggagaatattcagcaaacgctactgctcctttctctgtgctgggccaagaccgaaagatggaaaaggaagagggaggccttcttgagcctctggtgcatgggagcaggggagtgacaactcaggagggctgcccagggaggggccttcttgctcccaagtctctcttaaggctgagctcctaaggccctgtgctcctccctgccttaccattcccctgagatccttccataccctctgggagctctgttgcacacactatgctcatattctcagggaagggtagtggcattattatcccaccttagaaaatgcagactcttgcttgagcccaggaggtcaaggctgcagtgagctagtttatactctatcctgggcaacagagagggaccctgcctcaaaaacaaaatacacacatacacacacgtggagactcattttgggaggccgaggcagaaggatcacttgagccaggagtttgagaccagcctggacaacatagcgagatcctatctctatctctacaaaaaaataatcagccacatgtggtggcatgtgtctgtaatcccagctacctgggaggccaaggcaggaggctcacttgagcccccaggagtttgaggctgcagtgagccagcctgggccacagagcaagaccctatctcttaaaaaaaaaaaaaaaaaattggaaactgaggctaggagaggtgagtcacttacctatggaagagaaggcagagttgggactcaagcacaggactaagtgtcccaaacctcagggtggtggagttgctgcatggttctgtagccctgagggatttctgggcaggatactggatggcttttagcaactaggctcagtcttgatgctgcccaccccagagaatggctgagacgcaccacgtttaaggagagtttgcgaggtgaggaccttcctcacctcaatcccatattaccttgggatggtaataaggtctatgaaataggtcaaagtctgggtaatgcatgggtttaataggtttctctgctgcaggacttctcagagtctttaatggagctaagcagcagcattctctttccacaaatgactgtcctctctcggagaatcctttgcattggctgccaggaagctgagacaaatctgtggcaagagggactcttgtctgtgttgtagcagctgtctcccagctctttctgggtgtctctaacctgactaaaatcatttttggaagaaggcaaggaatttttttttttttaagacagggtctcactctgtcgaccagtctagagtacagtggtgtgatctcagctcactgcaacctctgtctcccaggttcaagtgattctcctgcctcagcttcccaagtaggttaactttttgatactagacagtaagcttggattaagtattttccataataatgctcattcatccatcccggcagcatccacttcaggttctgggctggggtgagggatcagccatccaggacaggatctggaatttgctctgcgccttttcagaccccctccctctcctcctccagtaagaaggtcaacaggacctgcttacgggccccctattactgaaagcaaactgaacctccagttagtgtcctgcccaaggtttcaaaggtaagtaagtggtagagctagggctcttctaaccacctgcagagctaggcccaggctgccagatgcctccttgagggcataggtgtggcagaggcgtggctggtgctggagggtcgactgaggcctgtcccactgctgctgtacaccgatgaatgtgggctcaaaggctctggggaaggtaagaccaccagggagctagtgtggcctgggggttcccgggggtgggcggtctctccccaaggctggtctgggccaagcccttgctgctggggtgtgtcagatgctgccctgtgtcctgccctccagcgtcccaggaggagggggacagccagcaggcctgctcctgttaagagcttccccaccttagaaaaagctcaagctgattcccacagccttgaagccccatggtggcttctgggggctgctgtggcaggctcacctgtgcctcttcctgctctctcaccaggggaggccatgccatcagccttgctctccacgtaggtgtggtcacgccaccagagctctggcctttgactggtgtgtccagccctgccctgccccgacttgcctgtctctgctggatgcctgagggcaaagccagtaacagaccccactcaagctggttatgaggacctggcagggtggggtgtggcccagtacctcggaagactctagaaggaccatcctggccctataaatgtttgtgccaagacaggtcccctgtccctcagcacacagaaggggcagtaggtagcaagacagtttccaggtaacagcatgagggcaagtgaggcctagagaggaagggtctgttgcctccagcccgtcacattccctccaggcgggctgaacagccaggtgggataaagagggatcctcaggtaggcgggagtcagggagagctgcgtgaccccacgaggctggtgtttcatcttcacttctcagatgacgggactgtggctcagagacctttgcagggggactgatcacagcacagggccatttgaagggagcctggaactgcatttccatgtggaccctgggtggatctggaaccaggctggctttcctagctcccccgccctttggctcccttatgttcttagccttcttttcacaacaaactcagaagcagccaagtagttggttgtgttgtctacagttgcactgaagcacgttttatttcggctaagtgacagtcctttgttgtccctgtcttgtaattagttagggtagtatgttggttatattacgtggaatttattgcaggatggtaagggagcatgtgacaaaatggggcaatagttctgtaaggctgagagaagctgggggtgtacccagtggctaggctactcagaggggactgtcatgctgtcagtagtgtagtgggagccaagcaggctttactcaccggcctgttaacagctgtgcgagtcatgcctttcgcttgtgttagctcaccttgtgaaaaaatgagctgaattacagatgacaactaaggcatggagagccgaaccctttgtccagggttgtataggaagtggcagggtcagggctgaatcttaaaacctagagggtagggcccggcgtggtggctcatgcctaaaatcccagcactttgggaggccaaggcaggcggatcacctgatgtcagaagttcgagaccaacctggccaaccaacatggtgaaaccccagctctactaaaaatacaaaaattagctgggtgtggtggcaggtgcctgtaatcccagctactgcggaagctgaggcaggagaatcgcttgaactcaggaggtggaggttgcagtgagccgagattgcgccactgcactccagcatgggcaacagagtgagaatctgtctcaaaaaacaaaaacaaaaacaaaaaaccctagaggataaaagaactataacatctgggataaagttagctgttgaaataaatacaagtcctaccgttggggtagtgtcagagctggcctacgtctttgactttgagattcctagcagccagagcaaagaaagaaatagattattcccactggagccacagtggccataacaaacagaagccatctgtttagatgctgggaatggagaagacttgctccccagaaatagacgctgcaggatgtggtgggtgacagtctactgttcaaaccacaaatacctgaaatgatctggccactttgatcacccaaccacagtagagcctaagcaggtccagggagcagctgttgctggcctggcttgacttttgagggaggtggaatagcgggcatgtgagaggagggaacctaaagcccccacagctgctgacacagcccccaggtttgagcttgtctcccctctcacccatccccccatatagcttaatctgatgggcatctggtggtccttccctgcagtggccagagcctgagctgtccaggctgaggtttcgactgaagcaggggttgtcctgcgcccatgtgcccacacgctgcaacctggctggagcctctggcataggacacccataccaccaggtagctgtggcggaccccggctctgatacttggcaggcttgggttgagattgtggctctaggcctgggcggctctcaagggctgctgtggggagttggggaagaacccctgggttgtgctcagccagcaggcaggtggcagccaggctggctgtgggtgaggaggggaatcctcttttcaccactgcctgcctgctcagcagttcttcagctgctgggggtggagctggcttgcaggggccagagtcagagtgaaaccggcagctctgctggttaatctcagcactgacactggggactaggcctggagcggaactgaaagggagactaggcccgttcccctccaggcctggcctatatcctcccagtgatccttaaggcctgcagctagggggaagggtgggggccaggcagggccaactggaaaagtagcagaaggaagtggccactcgcaccttacccatcttgcagacaggaaatgaaggctctgcagggctggctggctgtaaaaatgggcaagagcgcagaggccccactccctgcacactgcgctgtgtccagtgcccgtgtggatgccatgtgaggcctcactctgcctgcctcatcctggctgctggacctctgggagtaggaggtgaaaatgccctggctggtgctggtcacttcaggctggaattttctagtcatgcagctttctagtgagaggccgcagtgagctgtggccagtgttggtcattcctgcagtcattactctcccccagcctgttgtgtccgccaaccagagcaggcccgggagctcccaggagacctgctggaagggcccaggtggccatcctgctcctgccaggctgccctcttacctcactgttcattgactctcctgcaggtggggaagggggataaaggaggtggccaggccactgggtcatgatccttccgacagaggtacctggcagctctgtgtgtaaagcaaggttaagcatctggttttgggggtcaattcaacagcactagcagctccagtccaaggtatgcccttttgggctgaggtggaggtcagatcacctgaagccacagttgctagaacatcctttgggctgcctctgctttccatccccctgctcccagtttgttaggggttgtagtattttccaggaacacctgaatggagggggcccagtggggccacttctgtccattccttatctcatctctttctccccttttcttctttcggccatcttttcagtcttatcacaagaggaaggggaggggcaaaccccctcctgagcagattcccaaccggaagcagctggctccttggctgcagagtgccccagcacaggaagcatctgcagggtcagttgagacctgggagcaggtttcctgctggcaaaggaacagtggctaactcctatccaccctgcagccctatgtgccgggtgtcctgggaaggtccagggccaagattttgtggttttacagtggctataacttaggctagccatgctaggctctgcccctttgggcttggtgtgatgagaccgtcagcagctgctatcacctggctgggcagggagctgtttgctcaccagtgggaagagaaacggatgtcagacacatggcagagtgggaatgtctccaagtccaggtccaatgggctgggagggctggccttctgccagcacatgcttcttgggatctcagtgtgaatggtgttcaggaggctaggggaaggcaccctggacctcactacaggctcagagcctgcccagcaacaccatggatactctctctaaaagggggactcctggggagactatagacaaactcaggcctggctggaagaaagagcatcaggaacaagccttgagtaccccaacttggtctcgtagagttcaaggcccaagctacaagcagcttgctccagcatccaggaggtccggtggtgcacacggcttgagatgcctgacaacctttacacctttgtgctgaaggtgagtgacaaggcttttcacaccctggggcaatacaaatacatacacatacagcagacccaaccctgttcccttcctccctgccaggtgaaggaccggacagacatcatctttgaggtgggagacgagcagcagctgaattcatggatggctgagctctcggagtgcacaggccgagggtgaggtcctgggccctcgtccctggcaccacctttgctgctaccacccctgacctgcccagatccttaacctcagcctcttctccagcaggctggagagcacagaagcagagatgcatattccctcagccctagagcctagcacgtccagctccccaaggggcagcacagattcccttaaccaaggtgggtaaaccaatagctaggccattgtcttctgggtacgctggaacccagactcagcccaggacataaggtagccccctgcgaccaccatcacccatcttatctaacaggtgcttctcctggggggctgctggacccggcctgccagaagacggaccatttcctgtcctgctacccctggttccacggccccatctccagagtgaaagcagctcagctggttcagctgcagggccctgatgctcatggagtgttcctggtgcggcagagcgagacgcggcgtggggaatacgtgctcactttcaactttcaggggatagccaaggtatggggtggggtggggtggggtggggcaggcaggaccgtgccacccctctccactggagttcagggtcctagagggacagcccgagcccaccatcctctcctcccacagcacctgcgcctgtcgctgacagagcggggccagtgccgtgtgcagcacctccactttccctcggtcgtggacatgctccaccacttccagcgctcgcccatcccactcgagtgcggcgccgcctgtgatgtccggctctccagctacgtggtagtcgtctcccaaccaccaggtctgaccctactgccctttgctgaagggggtggctgacactgggtagagggtagaggcttgctgcagacccaggggtacaggtatcttgttctgtgtcctgtcagcacttgcctcaagactgatggtgtggtctctcttggtcacttgtcctaggttcctgcaacacggtcctcttccctttctcccttcctcactgggattcagagtcccttcctcactggggttcagagttgggccttccccaccttagttcttctggctgtccccgggggctcagcccagagggtctcccagggcgatcctcaccccccgagcagatcttccacctggtgccttcgcccgaagaactggccaacagcctgcagcacctggagcatgagcctgtgaatcgagcccgggactcggactacgaaatggactcatcctcccggagccacctgcgggccatagacaatcagtacacacctctctgaccagtgaggaattccaggcctcaacagctgcccttgaggagcacaggcagaagtgtgaacttgtgaatgtaattgatctttccttccttccagagaaagatttaagggacactgttaactgctcgtgccagtttggaagtgacccttctattaggcctgttgaagggccctcctgtaggtttcatctatccacctggctttctccttattgtttacagatgtagttcttgttagaggatgccgctagctcctgcccggggtccctatgcccagtccccgttactcttagagaaaggagttggggtgagggccagagctggcagtggaaacttgttctctttttcactgacactgtcacagcggatgacagactttctacggggaggagggggggatcatcaggaagcccagaacactaacaagcggttctcccatctaccgtcagtccacatggcaggtctgctgtgtccacaccacagatgaccacatctaatcctgcttctactctcagctttaggacaaaagctctgtcagaggcacaagctgaaggtcaaaaatgatttaaaacattttacctcagactaatttctttaaaggattcaggttcaaaacttaaccactgcttatttcagtgcactgtttcaactaacacccatgctatttttgtagtcagaaacagctatgcaaaccctacctaatttacagtctgagccagcatgctggcttgtctactgcatcctcgggacagtcacctgccactgagtggccactgtccttcctaaatgtcaagaagtgaagtatgtcaccctttcagggaaattcaggcaattactgaaataggagggtggcaagaacagttctatcctggtgccttacgaataaaaaactggattctggtttacagcagctttacagtgatagttaaattaactggggctaggggaagagcaagcaaaaagggaagaaggactcctaggccctttctagtaaatccttcagcaacaaggctggcttggtgccctccaagcatctaatggcttattaaattatcccacaagtgggttttaggctccttttttgagccaaaatggaagctgggaatctggtgccataactaatgagaaactcctttaatagcccacaatcagtgttctgttctagctggctactgcttcactggattgagaatctatctatctccttgcacacatgggcacacacaatctccaccatccagggaggtcctgaagtcaaatctctatctatacaagtgatacaattcatagggggctggctcctcccagaacctgtctggaggctcagaaacgggggcagtgacagtggagtcagctgctcttgggtgccagcagagccattcagtacaacccccaggctcacagcagtggcttctaggaaactgggagtttagatcagctttacagatacatcgatcagaggctaaaatgaaacctcagcctaaaactcataggactgactgcctgggaggagggttaggtctgcttcttccacttatacttagtctctgtgctccaagaggtcaaatttttgcttctagaatttccttggggtctttcagagggtgggggaacaaacccctatgcacttttcttttttttttttttgagatggagtttctcttgtcaaccgggctggagtgcagtggtgcaatcttggctcactgcaacctccaccttcctggttcaagcgattctgcctcgacctctcaagtagctgggattacaagcaccagccaccatgcctggctaattttgtatttttagtagagacagggtttcaccatgttggccaggctggtctcgaatgtctgacctcaggtgatccacccgccttggcctcccaaagtgctgggattacaggcgcgagccaccgcgcccagcctacaccacttttagtaccaacactcttgggtgatttcatggaccctaaagcagacctgacactgatccagatttgcagtccatttttaaggacacctgtctttatttcctcaaagtcaagcagctttctctggaaaatgaatgctaattagtgtgaaccaaaagagtaagtaagagtctgaagtttttttaaaggagaaagcttattatggaaagtcactggtcctcccctccgcacaggaaaggtacccagtagataatgaaccaaattaagttccctccctccagccagaagttaaacatctgggatatgacgtcttcatgccaggggcactcatttcttagcagcctctctacatacatctctcaggtggtgccaagaggcacaccaggtagagcaaacttagcagctctgactaacaggctgcaaagtgcaagttcagattctgtggcagagatttggaaggcacccacctccagactgcttcccgtccaagttaccaggacagctcaaaaacatgctgacagaaaactcccatggctctaggaagaagtgacactaagccaacacctttctttatgtgggagcagaatcagctgatgaaggggtgggcagcagtgtggggcaggcaccccactggctgcagctagcccaccataggcacagcacatcccaccactctccttccagtcctgaccaggccccagccggcaacttctaccgagagccatggctcaacaccaaactggacagtagacatcatgatccctccagttagctctaattacagaccccaccagtacagcttgacagctcccggcaccatcccttccttcatctgacttattgaacttttacaaactaacagtcaccagcaccaaagaattaagtcaactaacctgccttgaattttagaccagcaatccatatggctttatctggtataaatcttctgcctttgatcatttctggaccgtaggaaaaaggaatagcaatcattaaaatcttgggccagagaacactatttttacataacagtttcttaacctaaagtcaaggccttggactcttccctgagggttgcctgagattccttcatgctttctattcaggactaagtcccttactgcaaatgtgttagctctaacatctcccacaagctagaggaacttgcgagtatattaacaaggacacatctgacatcctgtgtttggttagaatatacagcacattgtgataacataaagtggattcatcttgtatcattataggcagaaggtatttggcaaatttttatgtattgttttatgtactgtacaagtaacttattcttgaataatgcaaattttgctataatgtacaaattgctatatgtgaattaaaaagttttcagaatcttgatttgctgtcataatatttaaaggctctattaagaccatggtgtctctacaaaatccttgccctgcccaaatactcgctcttccctttgtcctccccgttgcaatctgggaatactaacaaatgcttatgagtccatccatgtcaataagcagctttgtacatctttgtatcttttcagccttcatgccctctggatttctttattgcaatttttttctgagtgtctcctgccccctactggtaaagtagaaaaatgcccgaattgggaacttccagctaatgacactcattttggttcaggagatattaaaaaggaagcttacagaatcggtgtcagcccgaggatgtggaatttcagtgctgcccaactctggccaaccttcctcctcctgaagcagatctctaatccaccaaagagaatagctcagtcttgtctttttctagagataccttgaaccagaactaagggtgaagaagaaaaatcatttcacagctaccttccgggatattcaaaatgcacccttagcacacctgctttgatattaagtatcctacaaagaagtagcttatacagacacacactaacttgatcagtttttaaaactttttttattttttaaattttttttaagtttttattttatattatctacaaagtaaaagtttttcccttaacttaaaagttgaaccactgtagacagtgatcacctcatcaaacttgatttataaataataatccgtcagtttgacggtaagaatttactgaaactttgtcaagtttagtaaaagggcgttccaagtcttgatttttttttttttttttttttagcagtaatagcagcaagaatcactcttgttacttcttttgctagctgatgtgttcatgactttcaagggttattaaaaaataaataacttccagtttcggcaagcagagctggggtacctgcgggactctgaaacagcatatggaattatggaatagcccccaagttcctaaatgcctctactcggtccaagtatcttccactgcaagtgaactgttagcattcctattggatgttacaagaaatcaacatatatattttaaaaacaaaataaatgaaattctagttttctgtgcttccagttggtagaagcagtagaagggaggagggaatttggcctttcggttcctccagggcagccttacaactgctgttggtggtgggcttgtactgtaaaaagaaaagcgaacattgaaacagaaaactggcaacaccacacatcagcctagtgtctctgcagcacatgattgtaaactatcctcgtgctagctgaacaaaactcaaaattgaattcgcttttccccctcccatctgcaccaaagtggggagggttgggtgggtgggtagaaacaaaccagtcagacgtaaaaccacttcagataaaactcccagaagacttgttcatggggtagaaaaaaaggccttaacaaaccccctccccaaatattagccaagcaccagtattgctttcagaataacaggtcagactgtgaagtatcgccatggcagccatcaagtagtagagcacaatcacagggcgctctcccctgttcaggggctggggctaacgctacactcaaagccagtccatccacagcgctttctcagcagtatcttctccagagctacaatcaaactctgccatggtaataaccccccacatgtcagacttttgggactcaggaaggaaaacactgccctgtccagcctgtcataacaaggaaggccaactgagtcctaggcatgcatcaggctgctgttgctgctgctgctgcttctcatcaagccaaatcctgtataccatcagaacacacacagactcggctcccggaagcctcaggccctgatgctgaactgatcgtcacagtccctcctgtgcacactcctggacgggtcttgctagttctcaaatgcggggcttgaagcactggccctgcctgccattccacctgtgcgagcagaatgctttggggtgccccggcggcccctgcacacacacgcctcacctgaagggtgcgtcatataggggaaatgcgctgttgtcgagactggaatgggctgtagtgcactttgagcgagggcggcctggggaccgccgggtggctgtgtcgtcattagcatcattggcgcatgggcagttggatgagaaggaaccattcctgactgtacatgagcctgaaacagagagctcttttacgcatacaggcaacatctccggcttcaacaacatgtcaactgtgttcctttcactgggctgggactctcaggaaagggcaacggtgggcctcagggcccagttctgttctctggggacaatctctagtagattatctattgacctgaagacgcgcttcacctttgggcagatcctgcaagggtcagggagcaggcaacaagtgagcctgggtagaagtcagggctgtgctgtcctaacccttgacatttctgatcattgtattctatgtatggggtaagatcttcacaaagattagacactggatccaagggcagctttctcaacttaatatcatacaagattcaatgatgcttcagaatcaggctgccatgtggggcctgaggtagttttgcagataacatccctttcaaataggaaaacagattacattaataagcagagactgtcacagtcaagtatgtgaattacttggacctctgttcatttgcctctctccctctgcttctggtctgctcaccaggcagtgaaaagagactcttaggcccccgtgactctctcagagatatgctgatggagcaggaggaggaggaggagttggagtttttaatggctccagtgagatggaaaggagtaacctgaagtcatctgggccagcccagcgtctctgtaccaagttcaacctggtctcactcactgtcaagttggaaaggtgattttagtcagcccaaacagctggattccagctctgcagggggttggcagggccaggaagagcccttgtttcctttttcccacactgtgcactgttctagactacgataagccttggatgaaatgccgtttttactctcacatattcaaacgggcacatggcaaatttgagcttccctgtgttaacctttttgccctttcagcacaaaaacagagtgaggttttagggatccctgacttacatgtaagttcacatgcctacttagccaccagcctctggtagacacctacaggaccccagctcttatgaagctgactccaccaaaccacgctggcccacacggaccaaaccggcttccctccccactatcaaaaagcaaatcaactgcagtgcgctacaccacagaacctaaactttgcagggtgaggacgcccaaacttcccagagctgtggaactctacttacaaggtagccttctgagagatagatccaactgagtcgcatctctagcccacaccttgccagagcctcactggcgcactatttaacaggaaatggaattcattgtggcaggtctcacttagacccgcctcagagagttctgttatgaaagtagcagagacatctaatacagccaattcacccgtaacagccccagggagggcctcaaggccagcgttagagcccaacttcagtgcagctccttctcctcattaagacaatcccctgggccctggagtgcagggacctttgtcagcagctgatgcagacagcaaccactgagatggcaagcacacctttcacctgtagcagcttacactggaggtgagctccaaagtgcttccagggctgctcttaaagaaaaatgggaccacctgggtgcttccagcttctagttacactgcaccaatgtccaaggccaagccctctcaagagtacaacttatggtcaaagcagatatatggataaccagggaaaacaattggagagatgtgtctggaactcatgtgagtaacaatcaagttgacaggccccggtagtcacttcggagagctgagactctgtgaaggccatcatccctgcctggcttccaaggtaagtgtgtaggggaatatatatgtacacatatatatagtagtgaggctatatagacatagcaaagcagacacagaaaggaaagaaggactgggttgcattccagagtcaaagatatttttaaggtctcagttggaaaactaaaggactgaccaatcagcaccttcactgatcccatgacaaaaccacacaaacattcccttagggccagatcacgtgtatttgagagggaaagggagacaggcaaatggcatgacacacagggtttcctagctgggagagcctctagctgcttactgataaccttcacattctacttggccttcacagaaagttggctaaagctggtattacctgaggtacgtgggccatgtggggtgggttggtatacgccggctgaacgtgagaaggatggatcgtaaagacagtctgttgtgctgctgggaaactattctgtggcgactgcgtgttggaggcaggtgtcatggagggtggagttggcgcaagccccgcgtggtaaatggctgactgctgctgtggactggccagatggagagcctgggcggcctggtgctgatggtgctgcaaagcgacaggaaagaattgagaggaaaacttctttaatgaaaagcagccaagggatacccacaaagctaagctttgcacacttgggcctatgatgagggtcactggaaagtacaggagaatgtacagggtggtaagagcaaggctggaggtgcctcccatctggacaactcctttctagggtacagaagcctgattctcagtctggcagttagaaacttctgagcatacatactaaagtcaaaaaagactactgccccagggaactgatagatatcaaagacatctttaactgcctccattagcaaacataattcaagaagctcataggaaaataacctcatcacataaaccttagaaattaaaaagtcccaagcaaataggaatttgccttatgaactttatgttaaatttgatttttcattactgcaagtttccagagcttatccaatcaccttattatcaacatgtatcttaaatgtgattttttttaattttttatttttttgagacagagtctcgctgttgtccaagctggagtgcagtggcgcgatctctgctcactgcaagctccgcctcccgggttcacgccattctccttcctcagcctcccgagaagctgggactacaggcgcccaccaccacgcccggctaatttttttgtatttttattagagacggagtttcacagtgttcgccaggatggtctcaatctcctgacctcgtgatccacccgcctcggcctcccaaagtggtgggattacaggcgtgagccactgcgcccagcctttaaatgtgattcttaaaaccaccaccccaggggcacagctgtatccatcttcacgagggtggacatgccatgtgttctgacgatgcgatacctggcacctgaagaaagcactcagatactaggataaagaagccactccatgcagacctctgagttgcccttacctgaacaggactgggtgcaggatgacttccaccatgttggctttgctgctgtccagtgggggtagctgaaggctgagggtgtggagtatgtgggtgcagggtagcgttagggtgcgcatactgctgagcaagggagcccgtggaaactaaagtgaaagaaaaaggagcatgtacacaaccgatgtctgacaacctccatcgctcctctacacttcatcaactgaactttcttgatggttacaatgcataactcacgccactaccaatttctatagatgactccatttaaaccatccattgtcttgaaaaaataagtgtagctattgcttaacagactagcatttggttcatataatacagctctacatatgatattaaaatcaaattagtttgcatttactcttaacggtcactaggttttcccaaaaaggcaacttgaaggcataggcagaaactactcaaacaagtgcattttaggtgcacactctttagctcaaggccatcatcaggctaacctcaccatgctactgccctggagcaatgtcctgagggcacagactatattgggtgtggtgggggatgggggtgcgggcactgtgtatggtatgtggcaaggccagggatctatcatcagggccgaaggaccacagtctctctcagctaatcacaggagcccttctgccactcagtttactttcccaagccctaatggaggatctcccatctttgctttatgaaataaatatagaaaagtaaactcccttctgagtgccccagccctttggaaagaaatttactagactaacttcaaaggacaacatgatgggccagtttaaatcaaaataaagataagaactgaaagccagttctttgtgaatctcagcgtgggccaaaccttggtacaaaaaccatttcttcatgtctttcagttttttgttttttgtttttttttgagatataagtctcactcactctgttgcccaggctcactgcaacctctgcctcccaggttcaagcaattctcctgcctcagcctcccgagtagctgagattacaggcatgtgccaccacgcccagctaatttttgtatttttagtagagatggggtttcgccatgctggccaggctgatctcaaactcctgacctcaaatgatccgcccacttcagcctcccaaagtgctgggattacagacgtgagccaccgtgcctggcctgttcatgtgcttcaaaaacagtaagttgagaatcagaagcagagtaggatgtgttcactgcttccagtgactatggacagcacaccgatgataaaaaactaacctccacgaggcaatgagctgagaatagagcgttctcaagacaactctagcaaggtatagttcccagccctctcttgagaaacaaatcctaaaatccctcaagataataagcccatacacagaaatgattccaaaatagttccccacattcttcatataacgtgttagcaaacacagacatatgcaggactgattggtgagagaagcaagcacagctttgggaagaggcaccctagttccagcagtctggtaggcaaggctgccgagtcaccagcatagacggctctgggtatattccacgtaaatggtgtgcagagggttaggctaggcacatggagcagttctataatcctaggtgttgtagggctaagggccaccaactctccagccctaacagttacgtctccagctgcaaagctatctcttagcaggggaaagggcaaggcaaagagccagttctaggatcacctgtgcatccactgccaatgccacagctggcattaatattccttcatatccagtttagactggatacagcagctttgtttatacactgggaaaattttccagactgtaggaattaacatatgccagaatattttaacaagaaaactgtggcaacatagtctctgaatgtttttaagagtagtgaacgtcttctgggagctagaacaaatgatgtacaaacgatgaagccttcctgagcttcacagtcccataagtctataagacagtcctttttttctaacttggtggcttattaacaggccctccatcatcatcatactcattaagtttacttccagctcctccaagttgtataggcactgacttggtctaaaagatttgatgtaaatttcgaacctgagtttgttgtacttgtaaaaatcttacgttcattttaaaaatgtatttatttgtttaatttttgacagagtctcgctctgttgcccaggctggagtgcaggggcaccatctcggctcactgcaacctccgcctcccgggttcaagcgattctcctgcctcagcctgccgagtagctggaactataggcaagcatcaccatgcctggctgatttttgtatttttagtagagacgggtttcaccatgttggccaggctggtctcgaactactggcctcaagtgatccatccgcctcggcctcccaaagtgctgggattacaggcatgagccactgcgcccggccatgtttgtttatttttgagacccagtcttgctgtcacccaggctggagtgcagtggagcgatctcggctcactgcagcctccgcctcctgggttaaagtgatactcctgcttcagcctctgagtagctgggattacctggctaatttttgtatttttagtagagacggggtttcaccatgttggccaggctggtctcaaactcctggcctcaagtgatccgtccatctcggcctcccaaagtgttgggattacaggtgtgagcaactgcacccggcctaaaaatttatttttgaataataaaaaagccacatgtagctaagtagctaatacggtggacagtgcagttttgttgttgttttgagacggagtctcgctctgttgcccagggtggagtgcagtggcgtgatatcagctcaccgcaacctctgcctcccgggttcaagcgattctcctgtgtcagcctcctgagtagctaggactacaggcgcgcctggctaacttttttgtatttttagtagagacagggtttcaccatgttggtctggctggtcttgaactcctgacctcaggtgatccacttgtcttggcctcccaaagtgctgggactacaggcgtgagccaccgcgcccagccacaaaatgttctactggatagtgatgtctacagttgtccatggtcccctactgttaaaccattagcactaacccctaccgccaccccagcctcttaaaaatgtcatttgtaacaatctaaatctgtctaaggaaaagcaattcccaaatcccaaattctgttcatggaggttcataaagatacagtacggaatctcagaggtttttgttttttttttgtaactttatttattcaagaaattttgtactaaaaagtttgaaatttcacttttaaataccttctaagcaaagtattaagaatattaaaaagtaacaataaatatagaaaataattatgcccatgaaatctcataatttaagttattcatcaactggaaaaatgtaaaaatcttaaaatcatttgaagagaaaagtaaagatgaaatatttttactatgcatttttaaaaggcatctctgcaatttaagtttaccagtatttaaagactataatacggttttctaatctatagctaatttgcatgcatagcacaaatacccaagctgagtgaatgtacataggctttgtttaaaaaaacaaaaacaaaatcctttccctacctaaataccggtaaacttgcaaggcattgattaaaaacaagacgaacaaaaaccacaaaggatgtgtaaaatatgtatcatacgttgtaaacaaaatttaaaaagagttaattagaaatatttccctttgtttttttgttctagctcaaaagatctgaaagaagtaccttaatcaggaattcttttcctccttgaatttgaaattgggagaaatggagccgggcacggtggctcacgcttgtaatcccagcattttgggaggccgaggcgggcggatcacctgaggttaggagttcgagaccagcttggccaacacggcgaaaccctgtctctactaaaaatacaaaaattagctgggcgtggtggcaggcacctgtaatcacagctactagggagagtggggaaggagaatagcttgaacccgggaggtggaggttgcagtgaaccgacatcacaccattgcactccagcttgggcaacaagagcgaaactccgtctcaaaaaataaaataaacaaataaataaataaataataataataaattgggagaaatgtgaaacttatactttaaatcaatactagtaacaaaaatacagttcggttccttgataggccagttaagtgacagtgacacaaagcagggtaggaagaaaatttaaaagccaaggaaaaaaatagcttggaagacaagagagacaaaaaaggaaccaggggccgaggtaggtgatcacgaggtcaggagttcaagaccagcctggccaagatggtgaaaccctgtctctactaaaaatacaaaaaaaattagctgggtgtggcagcaggcgcctgtaatcccagctactctggaagctgaggcagagaattgcttgaacctaggaggcggaggttgcagtgagccgagatcgcaccactgcactccagcctggacgacagagtgagactccatctcaaaagaaaaaaaaaaaaaaaggaaccaagataaggtaaagaaggaaaaaacacaggagaatcagggaaaaggagagtggagtgggaagggcagtgggttctgacccacacatattatttcactgcttttgttatatatgctcattctggctaaagatcccagagaggttaaaaataaagttaattttatttgtaatactgatttattcatcagttaaacttctatttataaaactttagtcttcataaaatcttttagattaaagataatcaaagacatatgcttctttggtccagacctagtccagaagtttcccactcagtgttccttgacataaatatttaagattctaaacatatgatcagtcaaaaatccttaataacactaaccacattccagaactagtttcctcagctgtgatctcactgaagcaaattaagtacagaaagctgtgtgtttaatttgtaactaggttttgtcattttgactttggatgcacaagtcataagagatcaccagcattgcaaaacttataaaacaaaacaaaatcttccaacttgtaaatctgatgttaaattcagaaaaagggaagtgaaggaaagttgaaaactctaaaaggggaataaaaggcaacttgaccaaaccatcataaaatggcttagaacagggggaaatgaagcagcagattaaattagcagcccaactgttagtttcttttaaaaagtactgatactcccttttaggggaagttgtgctaaggcaattaaggcttaggtgttaatgattaaggaccttagctacttaccaggaaaacaacaccaaactactaacagagacagtaagatggtgaggataactacatttgagacctcaaattgagtacataataaaatcacctactatcttttacacactacaatcacagacatagtttcccctttaatagtatatacatacagcaagactcctttttaaagagcatctattaaaggattaaatttaacatttcctagcaccaaataaattatatatacacacatacatatatatatatatacacacacacacacacacacacacatatatgtatgtatgtatgtatcagcttatttttggataccaagtcatggcataattaacaaagatttaaggtcaaatgcattttaaatgctaatatggcatttagtagagtcagacattgagtcaccccaaaataactcaaaatgtgcctaacataaaatttgaatccttaatatcctctagaacacaacatttcatacaaggtgacaatattaatggcacaaatttctaaaggatttctacaaatattagtactccttcctatttaaataccaaagtccaagactagccttatttttattttttattttgagacagagtctctctctgttgcccaggcctgagtgcagtggtacaatctcagctcactgcaacctccacctccagggttcatggaactcttgtgcctccgcctcccaagtagctgggactacaggtgcgtgccaccatgctttggtagagatagggtttcaccatgttggccaggctgttctcgaactcctggcctcaagcaatccacccacctcggcctcccaaagtactgggattacaggcgtgagccaccacgtccggcccttatttttacaaattgccctacaaataggaaaaatgtaccttaaaagttcatttccagaagaaagctctgcccagactttctccatgaaggagcaactatttctgtactttttgccaggtggggagaggggacctgtgctgtccaagataatgacctgagaggtcatgatctcttgcttaagctcaagatatcctgaggggtctgcttcctgaatattttattttttgagacagaatttcgctctgccacccaggctggagtggagtggcacgacttcggctcactgcaacctctgcctcccaagttcaagcaattctcctgtctcagcctccctagtagctgagattataggcgcatgccagcatgcatggctgatttttgtattttttagtagagatggagttttaccatgttggctaggctggtcttgaactgctgacctcagatgatccacccgcctcagcctcccaaagcactgggattacaggtgtgagccaccgtgcctggcccttcctgagtattttaaacctttagccatgcacaggactgaaaagtttttcccttagtatttcatcaatcctattcaattaaaaatcctggtaggcataaatttcatcttatcagaatataaataaacattttaagtttataccaagcttgtggcttggggtgtgtgtgtgtgtgtgtgtgtgtgtgtgtgtgtgtgtataaataaacattttaaatttataccaagcttgtggcttgggtgtgtgtgtttgtgtgtgtgtgtgtgtgtgtgtgtgtgtgtgtgtataaagctgtttaggaagtttctctaacaaggaaaatattaggcatttcccagtcacatttgcttggtatgcaaaaattgatttctgaaacaactccatttttcattaactccagccttcttaaattgggtatttccattttaaaaactgaattatttatatatataagtactttcaataatttgactggcacaaggaaaatattgttcaacaagtctactcccttaacatgtatcctttaaaaagtgttttactgtacaattaaaaattagtataaaaaacccaactcactggcaaagtagaaagaagggcttgtctccttgttgtatggtaatttgggacatgctgaatttgggaaatagaaaggtaaattagccttttgaggtgtgcattttccaaattttctggaaaggttgacatattagtaatttctttttgtattcatgcataattcattttcataagagatgacaagcactttaaacactgctacagaattttaaaagaaaggactaaaccggaagacactgttcttctgtacttaggtgtcaagttgtcatgctgacttgcttaaaagtaaaaggaataaaatcattatctaataaaaacaccaacatggcattctactgaacaaccttgatataaatcatgtaccaaaataaaactattttacaagtttaattcaatagacacacaattttgcaaaaacattactaatggaaatgtcattatcctgaaagattatctagtaatggatccaaaaatttaggatcatagcaagaatataaacatgaatattatttcttattaaaacatgtctacataaaggggtagggtatttgagtgtatttaaatacacctggaaggatacacatcaaaatgttaaaaggcagttgtcaggtggagggattatggatgcttttcattttttttttttttaacttaactatattttcttacttatctgcattaaactaccaaaaacaaatcaaaaaaggattctggatctaattcttcctaatggctctagttagtcggaaaagttgtattattactgtttctgaaaggtaaaagcatcaccataaaacaaaattagatggattagaagagtagatgtgaggctgggcgtggtggctcacatctgtaatcccagcactttgggaggcctaggcagacaaatcacaaggtcagaagttcgagatcagcctggccaagacggtgaaaccccgtctctactaaaaatacaaaaattggccggtcgtggtggcgcacacctgtagtcccacctactcgggaggctgaggcagaaaaaccgcttgaacctgggaggcagatgttgcagtgagctgagatcgcaccgctgcacttcagaatgggtgacagagtgagactacctcaaaaaaaaaaaaaaaaaaaaaaaaagagtagatgtgagaggaaaaaaaattaaagtaacttcttagaagggatggggtagaggcaatgatggaagttagattaagagacatcaaagaggccggggcagtggctcacgcctgtaatcccagcactttgggaggctgaggtgggtggatcacctgaggtcgggaattcaagaccagcctgaccaacatggtgaaaccctgtctctactaaaaacacaaaaattagccaggtgtggtggcgggcacctgtagtcccagctactcaggaggctgaggcaggagaactgcttgaacccaggaggcggagtttgcagggagctgagatcgcgccactgcactccagcctgggtggcagagggagactccttctcaaaaattaaaaaaaaaataaaaaataaataaaaaataaaaaaaaaaaaagaggctgggcacagtggctcacgcctgtaatcccagcactttgggaggctgaggcaggcggatcacgaggtcaggagatcaagaccatcctggctaacacagtgaaaccccatctctactaaacaaaatacaaaaaattagccgggcatggtggcgggcgcctgtagtcctagctactcgggaggctgaggtaggagaatggcgtgaacgcaggaggcggagcgtgcagtgagctgagatcacgccactgcactccagcctgggcgacagggagagactccatctcaaaaaaagagacatcaaagagataaggtttttgacaaaagccctttctaagatagctagaaagaggtcaaggtcaatacttttttagaataaaataattatcctattttatcatttaactgttcagtaatgttagcatatgtgtattaaacatactaaaaatttaaaaacaataatcaggatttcattttgcagtcattagtggtcctatgttttcaatgcctttggctatggctataacaattaatgaatgagaaaaggtgacataaaattgtcaccaacatctgggtgcatgttcttctgtttgcattaaatgttttaaaaacctagatatgatgtagcttaaaaagaaaagcacaattcatactcaaagtatttggttcctttgagaaaatttatgacaatatatttaatatatttataaaatataaattgttcagggaagatgagtataaaattaacacttctatgtaagtttgttgtagtttataagaatgtacttcaaattttgtttatatttgatataataaggctttgaaagtctaataattcaaataaatcactgcagatttaatgaagaacatgcttaagcagattaaattatggcttatgatggcatagaacaaaacaattctttcttatgttttcttttttttaaatagagacagggtcttgctctgtcacccaggctggattacagtggtgccatgatagctcactgtagcctcaaagtcctggactcaagtgatcctcccatctcagcttcctgtgtaggtgggactacaggcatgtgccaccatgactgggctttttttttttttttttttttttttttttggtagagatgggatctcgccatcttgcctagactggtcttgaacacctgggctaagcgatcctccacttcagcctccccaagttcttggattacaggtgtcagccaccatgcccagctcctagtgtcctttttagggtcttaagcaccacaaagggaatcttgattaactagtgacaatcacaacaagtccacagccttgctcctagcctgcctccatacagacagcaattaaataccacctgtgtaaactgcaggagagtagttcagatttggctgagtaactttttcctggcatgaaagaaccggctctaatgactagttcattccagatttcactggacattagatctagtgctttgttttgtttgcaacatttcctatttgcccacacataaatggactttggggtctaaggccccactgctcttcaaatggacatgttctaggaagtagttatgaaaatcatctgtacctcaaacacagtatttaccctataggctgtttcaaaaccaatgaacattcatccaaaagatgaagccagatgttggcagtgaatgaacacaatgaggagaaagattcggctcaacattacagtattattgctacaatgtctcaaaagcatgcatacacaaataactactctccaaatgcaatggaaattttagcttaaaagtttcagatctgattccaaggggagtatgccagaaaatggaaggaaagagatgttctttccacttgttaaatcatgatgtattcaccagaaatgtataaacaatcataatgaacttttaacctaagcctttagcaaacaggaaaattgttaaaatatatacaagttgcataaaagccagcatgataaatcaatcgtgcctttgcacgcatattcagtccccgttaagacaactaaagacaagtcaaatgacggggtcataaccaaaataataaaccaagttagtttgtcagtatcttttacaattaaattacggatgggcctcttgaaaaaaatgttttccaaaatgtagcaatcacacaattttttatttaaaatgcgtaatccacaatacaaaattgaaagtgataatgtggaaaattaagactggacttaactgttttataaaactaaacacctttgatcatatacaaattcctatcagcagtgagcctttgtggcagacaagaacctccaggaagaaagcataagctgtgggttacaggtgacaggaaggatgattgctgctgcccaagtcctattctcattaacctacggaatgttaaaacttttattcttcaaaaaggacagaggtggtatgaaaagtagtaatgtctcaagaagaaggtttgccagaaatctgtaaattctttttttttttttttttttttggagatggagtctcactctgtcgctcaggctagagtgtagtggcgcgatctcggctcactgcaacctctgcctcccgggttcaagcaattctgttgcctcagcctccgaagtagccgggactacaggcacatgccaccacacccggccaattttttggatttttagtagagatggggtttcaccatgttggccaggctggtctcgatctcctgacctcatgatccgccagccttggcctcccaaagtgctgggattacaggcgtgagccactgcgcccagcctataaattcttaaataactcaattttgcctaaacatactcgttcaggacatctaaacttaaaaaataaaaattttatattcttagtatttcaaaaagttcaaagaggctttaaaaatgaaatgcccatgtagttacatgtaaccataatctcattctcatagcagtacacttttcaactgtatgaataaaccaaaattatcccctactccaaacaaccaaaaacgcaaataggaaaactaaacgacactacggtagttctcagaaatattcagaacaaaacatcttaatgaaatcagtactatttaaaaacatattctgaaaaacatttgaagcaatccattaattctgtatcataagatatacaaatggacattttattttaaattatcaacagtgaaaaatctattattttggtactttagacagctgctaagttgatctacacaaatttctctgtttagtcacaaaacgaagatgggtttttttgcttattattctcacatataaatactgcttagttttacataaaatacttctcattttcatttcagcattctgttcacattggttatatttaaagtgtgactcatgtctaaaatatatctaatatgacataatattcaaccattaaaatacagcatgatgtagaaacatagtattatcattataacaaacagcaaaaaaaatatgtaatgccagtgaccctcagatcaagtagtgaagcaaaatgttttcatgctggagaacacctttatgcttttattattataaaattctcttgcatgtcgtaggcaggatataccaaagcataatattgatgaggaagaggagaaaggtacctttctccacaaagatgctttgccattatatacatcattacattttagttaaagcaggaaagagatctgaagaccaggtacagaagtagaaactatttgcc

SEQ ID NO: 209 - DNA, 5462 bp, Homo sapiens
cccgggccaccgcctccgcccggctgcccgcccggactgtcgcggcccgcggtggcgacggcggccgctgcaaagtttccccggcggcggcggcccgggggcgcatcctcccgcaactgtcaagcgctggcggcggaaatgatgaggcgctggccattttccgagcccgggtttcctgcctgagccccgctcgagcgagccgcgagcgaggagccggcgggcgggagaggacgcgcccagggcgggggcccgcccgccccctcgggatttcgagggcccgggggcgcgcgacgccatgggccggccgggcccagagctcctgtctctcagcgagttctgtgagttgcacgccgtagcggcggcccgggagctggcccgccagtactggctgttcgcccgggagcatccgcagcacgcgccgctgcgcgccgagctggtgtcgctgcagttcaccgacctcttccagcgctacttctgccgcgaggtgcgcgacggacgggcgccgggccgcgactaccgggacacaggccgtgggcccccagccaaggccgaggcgtccccggagccaggccccggccccgccgcccctggcctgcccaaggcccgcagctctgaggagctggccccgccgcggccgcccgggccctgctccttccagcactttcgccgcagcctccgccacatcttccgccgccgctcggccggggagctgccagcggcccacaccgctgccgcccccgggacccccggagaggctgctgagacccccgcccggcctggcctggccaagaagttcctgccctggagcctggcccgggagccgccacccgaggcgctgaaggaggcggtgctgcgctacagcctggccgacgaggcctccatggacagcggggcacgctggcagcgcgggaggctggcgctgcgccgggccccgggccccgatggccccgaccgcgtgctggagctcttcgacccacccaagagttcaaggcccaagctacaagcagcttgctccagcatccaggaggtccggtggtgcacacggcttgagatgcctgacaacctttacacctttgtgctgaaggtgaaggaccggacagacatcatctttgaggtgggagacgagcagcagctgaattcatggatggctgagctctcggagtgcacaggccgagggctggagagcacagaagcagagatgcatattccctcagccctagagcctagcacgtccagctccccaaggggcagcacagattcccttaaccaaggtgcttctcctggggggctgctggacccggcctgccagaagacggaccatttcctgtcctgctacccctggttccacggccccatctccagagtgaaagcagctcagctggttcagctgcagggccctgatgctcatggagtgttcctggtgcggcagagcgagacgcggcgtggggaatacgtgctcactttcaactttcaggggatagccaagcacctgcgcctgtcgctgacagagcggggccagtgccgtgtgcagcacctccactttccctcggtcgtggacatgctccaccacttccagcgctcgcccatcccactcgagtgcggcgccgcctgtgatgtccggctctccagctacgtggtagtcgtctcccaaccaccaggttcctgcaacacggtcctcttccctttctcccttcctcactgggattcagagtcccttcctcactggggttcagagttgggccttccccaccttagttcttctggctgtccccgggggctcagcccagagggtctcccagggcgatcctcaccccccgagcagatcttccacctggtgccttcgcccgaagaactggccaacagcctgcagcacctggagcatgagcctgtgaatcgagcccgggactcggactacgaaatggactcatcctcccggagccacctgcgggccatagacaatcagtacacacctctctgaccagtgaggaattccaggcctcaacagctgcccttgaggagcacaggcagaagtgtgaacttgtgaatgtaattgatctttccttccttccagagaaagatttaagggacactgttaactgctcgtgccagtttggaagtgacccttctattaggcctgttgaagggccctcctgtaggtttcatctatccacctggctttctccttattgtttacagatgtagttcttgttagaggatgccgctagctcctgcccggggtccctatgcccagtccccgttactcttagagaaaggagttggggtgagggccagagctggcagtggaaacttgttctctttttcactgacactgtcacagcggatgacagactttctacggggaggagggggggatcatcaggaagcccagaacactaacaagcggttctcccatctaccgtcagtccacatggcaggtctgctgtgtccacaccacagatgaccacatctaatcctgcttctactctcagctttaggacaaaagctctgtcagaggcacaagctgaaggtcaaaaatgatttaaaacattttacctcagactaatttctttaaaggattcaggttcaaaacttaaccactgcttatttcagtgcactgtttcaactaacacccatgctatttttgtagtcagaaacagctatgcaaaccctacctaatttacagtctgagccagcatgctggcttgtctactgcatcctcgggacagtcacctgccactgagtggccactgtccttcctaaatgtcaagaagtgaagtatgtcaccctttcagggaaattcaggcaattactgaaataggagggtggcaagaacagttctatcctggtgccttacgaataaaaaactggattctggtttacagcagctttacagtgatagttaaattaactggggctaggggaagagcaagcaaaaagggaagaaggactcctaggccctttctagtaaatccttcagcaacaaggctggcttggtgccctccaagcatctaatggcttattaaattatcccacaagtgggttttaggctccttttttgagccaaaatggaagctgggaatctggtgccataactaatgagaaactcctttaatagcccacaatcagtgttctgttctagctggctactgcttcactggattgagaatctatctatctccttgcacacatgggcacacacaatctccaccatccagggaggtcctgaagtcaaatctctatctatacaagtgatacaattcatagggggctggctcctcccagaacctgtctggaggctcagaaacgggggcagtgacagtggagtcagctgctcttgggtgccagcagagccattcagtacaacccccaggctcacagcagtggcttctaggaaactgggagtttagatcagctttacagatacatcgatcagaggctaaaatgaaacctcagcctaaaactcataggactgactgcctgggaggagggttaggtctgcttcttccacttatacttagtctctgtgctccaagaggtcaaatttttgcttctagaatttccttggggtctttcagagggtgggggaacaaacccctatgcacttttcttttttttttttttgagatggagtttctcttgtcaaccgggctggagtgcagtggtgcaatcttggctcactgcaacctccaccttcctggttcaagcgattctgcctcgacctctcaagtagctgggattacaagcaccagccaccatgcctggctaattttgtatttttagtagagacagggtttcaccatgttggccaggctggtctcgaatgtctgacctcaggtgatccacccgccttggcctcccaaagtgctgggattacaggcgcgagccaccgcgcccagcctacaccacttttagtaccaacactcttgggtgatttcatggaccctaaagcagacctgacactgatccagatttgcagtccatttttaaggacacctgtctttatttcctcaaagtcaagcagctttctctggaaaatgaatgctaattagtgtgaaccaaaagagtaagtaagagtctgaagtttttttaaaggagaaagcttattatggaaagtcactggtcctcccctccgcacaggaaaggtacccagtagataatgaaccaaattaagttccctccctccagccagaagttaaacatctgggatatgacgtcttcatgccaggggcactcatttcttagcagcctctctacatacatctctcaggtggtgccaagaggcacaccaggtagagcaaacttagcagctctgactaacaggctgcaaagtgcaagttcagattctgtggcagagatttggaaggcacccacctccagactgcttcccgtccaagttaccaggacagctcaaaaacatgctgacagaaaactcccatggctctaggaagaagtgacactaagccaacacctttctttatgtgggagcagaatcagctgatgaaggggtgggcagcagtgtggggcaggcaccccactggctgcagctagcccaccataggcacagcacatcccaccactctccttccagtcctgaccaggccccagccggcaacttctaccgagagccatggctcaacaccaaactggacagtagacatcatgatccctccagttagctctaattacagaccccaccagtacagcttgacagctcccggcaccatcccttccttcatctgacttattgaacttttacaaactaacagtcaccagcaccaaagaattaagtcaactaacctgccttgaattttagaccagcaatccatatggctttatctggtataaatcttctgcctttgatcatttctggaccgtaggaaaaaggaatagcaatcattaaaatcttgggccagagaacactatttttacataacagtttcttaacctaaagtcaaggccttggactcttccctgagggttgcctgagattccttcatgctttctattcaggactaagtcccttactgcaaatgtgttagctctaacatctcccacaagctagaggaacttgcgagtatattaacaaggacacatctgacatcctgtgtttggttagaatatacagcacattgtgataacataaagtggattcatcttgtatcattataggcagaaggtatttggcaaatttttatgtattgttttatgtactgtacaagtaacttattcttgaataatgcaaattttgctataatgtacaaattgctatatgtgaattaaaaagttttcagaatcttgacatctcggctcactgcaacctccgcctcccgggttcaagcgattctcctgcctcagcctgccgagtagctggaactataggcaagcatcaccatgcctggctaatttttgtatttttagtagagacggggtttcaccatgttggccaggctggtctcaaactc

SEQ ID NO: 210 - protein, 560 aa, Homo sapiens
MGRPGPELLSLSEFCELHAVAAARELARQYWLFAREHPQHAPLRAELVSLQFTDLFQRYFCREVRDGRAPGRDYRDTGRGPPAKAEASPEPGPGPAAPGLPKARSSEELAPPRPPGPCSFQHFRRSLRHIFRRRSAGELPAAHTAAAPGTPGEAAETPARPGLAKKFLPWSLAREPPPEALKEAVLRYSLADEASMDSGARWQRGRLALRRAPGPDGPDRVLELFDPPKSSRPKLQAACSSIQEVRWCTRLEMPDNLYTFVLKVKDRTDIIFEVGDEQQLNSWMAELSECTGRGLESTEAEMHIPSALEPSTSSSPRGSTDSLNQGASPGGLLDPACQKTDHFLSCYPWFHGPISRVKAAQLVQLQGPDAHGVFLVRQSETRRGEYVLTFNFQGIAKHLRLSLTERGQCRVQHLHFPSVVDMLHHFQRSPIPLECGAACDVRLSSYVVVVSQPPGSCNTVLFPFSLPHWDSESLPHWGSELGLPHLSSSGCPRGLSPEGLPGRSSPPEQIFHLVPSPEELANSLQHLEHEPVNRARDSDYEMDSSSRSHLRAIDNQYTPL

SEQ ID NO: 211 - DNA, 28562 bp, Mus musculus
  misc_feature (1)...(28562): n = A,T,C or G
gttgggtggagacactgctctttccttaagcaacaggaagcattccctctagtcatttttgtcatgtgaatcagaaggctagaccttctgactggtgggacactcagccacaccctagattatggccacggtcatatagtgacctcactacattccatcctgttctctgagtttatttttcaaaccttttctctctcagctactacagtaccaggagcacataaatatctcttggccctcagttctcaccctggtcctcagctcctcgacatcttctcctgacccaggcagaactatctgtcccctaatttcataggcagcttttgatataggtcagtatttccaggccagaaacaatgataggctagatgtatgggttgatttttttgttttgtatgacacagagtttctctgtgtagccctggctgtcctggaactcattctgtggaccaggctggccttgaactcagagatccacctgcctctgccttccaagtacctggattaaaggtgcgtgctgatggcttggtattctatcataggtttctttgcctgggcctccgtggtcacatgacttaacaactaagatctgcttatacgtcagctgtcattctcatgtatgaattctgatgtagctgaacccctcctatggccaccccttctcccttgagagcttcctcaagagtcaagtgcccactggtggggtaactacatctttctgccccttaggctgtgatcgtccaggcaccacactgctgcccacacttaggtgccctgtgtttacacactttaggttatacattggccagtatgcctgaacttgaatctgtggctgtggaccttgagccccttgctctctggacctgaggaaggtcgagccagccaagactccctttctcccacttttctctgactcatagacagcaaacctgctagcaaattaggttagggggagctaggtgaaggttgctgagttgaggcctctaggctgtttcatgtcgtaattacaggttactcagtgcagttgctaaatgttaaattacaagcgttggctctctgtgcatcatttgaccacaattattataattatgtccttgccagaaggtcaacagagtaactcagaggaggatactggggtgacagatgacttgggggttggggttgagtagggcagtgttctcagattagcaccaagggccaaagcagggcatggccgctaccttcaaaaccttcacatgctgaaagaaggcagatttttttctcagatgattctttaatgatagtcattttgtgcaacagaatcatcattgataaacactggaaatctcaagatttggcaaaagctatcactactggcagtttgttaagttgtgtctgtggcacaaagtcccattactatggggaaacagaattcccactaatgtgccttccattaaaggagagagctgaatcttgtctctgagagtctccaattaccagctcccatcgaagaatgaggtacatgttgacactgggaaccctgtctcactctgggagttaaagccatcctactttggaagtaactgaggtttaaaactgggccctaacaccatagattgtggaaaccagaatatggtattagtatctatgctacatagcctatcactcacaaggacctatttacattttaaagtttaaaaggattgagagatgaatagctccacagagtctgcccccagcatcttctttctattgctgcgtcccatgaaatgtagtagctcacactgtgtggcagaaaatctctggggccagacatacatagctgatcttgtacttgttatcctggtcctcagatctgtgaggccatatgccttctcagcctcacatctgactagctacacatgctccaccctggggctgtacttggaatttatcacagatatttgtatcaaactctgtaccagtgatgcaaggaccacggaggggccaatcctccccactgtaggtcaggagggagatgctggagcccttcttgggtttagcctataaaatgttacctgagaagtggccccttcccacttatcatggaacaacacatatcagactctttccttacagaacttcccaaagggcctctgggaaacctctgagagactgtccaggcccccatgagtccatggttaacctactaggatctaagagtactggacagtggttcgtaggcaacctaacagccttggcctacatcattctcctgcccccaggagtcctgcctgttgggggatatcttttctgcagatgttgcaggacaggggtcagcacaggtatcaggagtctatgaggatctctacagcacaaaacttcacaagccagcagaatgtagttaacccagcgacagctctgaaaaccaggtctgctgccctgtccccaacctacgctaggtaatggatcagggggatgagaacaaggagataactgcttcagtgatcctacaggaggatctgggtcctggaaggcagagacaacctcctcgatgtcatatgggattcttgcaagaaccctgacagacaaatattcacccttaccttgttgtaaatttttttattggatttttaaaggtttacaaaaactgaaaagaaaatagagacatctccgatatctactccttcctcccactgtcattagcatcttgtcttaatatatgtgcagtaataatgagctagtatttgtatgtcataaactaaagggcaaagtatagattccagttcaatcttgtgttccattgtttttttgacaaatgcacatgagcctctaccattccctgggacagaaccagctttagtcaacctgagccctctgttagtgactgtaggtcattagctcttaacatctgcaccggatagcactcctacttgctttcatgctacgatctgaactgtgatgagccatataggccttccaagatggatgagacatgattggctacatgcaaattgtgtattcatctctacagagtccctagtaaaagggattactatatagaaagtagccagagtttacagtgtgcaattggcaggttcctttcctcacctgcttggggttatcacctggctcatataatgtctgtgcactggaaccctgcagtgatagggacaaggtgtatactctaagggccttggcgttggtggagtagaccttcaagctctcaatgcacaggtatgtccctggagcatcaaacagggccttgaatttcaaggtgacatcactttatattcgaggcagggttccagttctgggttttagttgagtagaaagacctgctcagctgtacgactgttttacactgattcttaaacttcagatgtcttttccagatccccagaccttctcctttcctcagctgtttagtggcctcaaagccacaggtggtgctggctcttcctcttgaagacataaatttgtccctcttactctcagtatggttgccacctaataaataaactgcatttctaggcctttcctcatgcatagagggtactctggaatcccttgtttcctcctgacctatccaggccagtttcgtccatcatttgatactgtttggggctttgaagtgaagaaagattgcctcatcaccttctccctgttttgtttgtttgtttgtttgttttttaaatcaagctccaggccagagaatgtgtccctccacctccctatttctgccctgctcctgtgtagctcccccactagatgttaggatcaccatgatctccatgcgacgccccttcatggccagactgggctctcagatggttatttttttgtttctgttggaaggatatttggagacaattggatctgtcaaactcgggatgggagatactattgaagtatagaatgggtcccaagatgaaatgacgataaagctccacactgcccaaggtaggtttcactgtaaagaagcatccagcctaaaacctcagcttcaagatgacaaagtgaatattaaacaagagaccacaggacacttgaaagtgtggcctggggactgattgcacacctgaggcctttctatgggatggatgttccagagtctcgaataacctcgtagaagctgccagtgcttactaatggcagagtctcagtctctctctgatattctctctctctctctctctctcctccctcccaaggcaaattttgagctggggaacagaaagagagggtgccaggaaccccaagaagccaccgctcttgagttgtgagcatcacaatagtccttgtgcactggaggccactcaggctgtctaaaagatggtgtctagctgctggaaggagctcagatttcttcacttcgtgcataatagtgcagttcccccaggcccaaactcttccatccccatccctacagcttcttcgtcccagccccagccctcctccctgaccttgttcccgttctttgcaaagtcgtttgtcccactccgagctgcactttcccttgtcctgtgcggcgagatgctgcccactgagtatctgcggcgtgacaccagggcgttccaggctagagctggcaggacacagatctgtgagctggcgcacggggcggaactgctggcccgggccgaaggccaggcgggggcggagctcggccgagggcggggtggcttcacggttccgccccccagctgagccagaccacggtccgggaacttgccagctcagaggttctaggggcagccggcgcgcttctctagttgcagcttgggcggctcctgtggtgggcggctaggggcgagccgggatgggctatagacgcgcgacgtgatcagttcgcacgcggacccacgcctcccatcgctctgcctcaagagcctattctgtgggtgcaggcacgcaccggacgcagacccggccggagcatgcggggtgcggtgtgggcggcccggaggcgcgcggggcagcagtggcctcggtccccgggccctgggccgggtccgcccccgccgccaccgctgctgttgctgctactactgctgctgggcggcgcgagcgctcagtactccagcgacctgtgcagctggaaggggaggtgagtcttgcgggtgattccagcgtggactccctggacctggaccggagccctcggcagcgagtggcagagcttgcggggtagggacagctatgctggccaagtccggtgacccccgccctagctctggtttcagaacaaaagagttggtggcatctgggtcccagctcggaagacgcccactctccgcgcgcgtaatactgccctagtgggtttcctgggctccataggctgcatgtttggtcctcccaacggttgggatttctgattcttgggaaagggttgggattgtgctcatctagagggacagctgtggcgtggagagcgtggggtccaaacgagacccgtatcggctgcagaccgtatctttggggcaaagagatggggtcgacacctgtctgcggccaaatgcagtagggtagagccctgagcccgcttggtgaaggtcaagccgcccttggcagcagggcacagggttcctgtgacacttctctctcgtccccatcagcagtgacagcggaggactttttgctgttgttttaactgaagtgtgacgtatggaaagaagcacaagtcacaagtgtgcgcgggcggggtgcctgaggagtcgtagctactttggacactgagaacgcgccaggcacagcggccggccccctctctttgcagagccagttttttacagctgcaagttgccaattcagcggtttgcatagcgcgctgcgctgatgcgggtctcctgaaaacgtgggctgggacggcggtgggggtctgatgtagctcatcccaggggcagggcgcttgcgcaggcctggggaggtacacgatctcgtctgaagcacagactccagtgaagggggctcatggggcaatgcgtgcggtgggtgattttggtcaagagggttttctgagaaaggtggatgttgggcagtgcccggatctgcgtaagcagggcatcaatgattatcttgtacacttacagtgcctgactttctgagaaaaccacagagaccaaaatcaaccctcatcaagactcctgctggagtgcttggactgaaagattgagagcagcttcttgagctctgcagtaccggtctttaagggagttggagctttctctcccgcagaaatcccttctgcctggcaagagcagggagttagagggcttggggcagacaagagcagattggatctgagggaggactggcctcgggaatgctggcgccatcatagagctggccatgagcctgtgatgctaagctcttaccgggcggccctttccccgtggtaattaattctctgctcacaaccagcactgctgagttagtgtactctaacctcagatcttggtgtgccctgttccggcagaccaaaaccagaaacggaacgcctgcctttaaatgaggtttccagacacttgcttttcttccaggttcttagaaggcgatgtgcctggaagactacctttccctgagcccggggatctatggtgaggggtggctttccccaaggtagtgagggattgagtacagacaaactaaaagacaccttatttctgtgggtccattctcatttaagtggaaccagatgactacctcgtgatgcatgtgactgctggggtggcagcccccaaattcaagtctgggcagtgtgagctggctacctgtccccttggattccccctctccccttgctgtccttctccagagccaggccaaggcctccaaaagtgtgtgagcagtgggaactgtccagtagctggtcatccttatgcctacctggcccttctcccccaactcattcctattctgggattcccttgagggcttctttcccagggcacagctctgcagaggacagctgaaggtgtctggtagttgtaggtaggtagataggattgggagaacacataatattcccttttgttataggcatggtccccacttataaatgcacttcacaggtcagttgactactgcccagcatgctggcaagcttgctactctacagtgtttatgagtgttttcttttcaagcagtctagaacaaatcaatgggtgaagcaagactcaaaatgttggattctggcctctggtaggaagggagttgctctccacagccctggccacttcacttaactcatatagacgctaggtgtttgcaaggaatcaagttggaaattttgtgttgattagtcagtgccataaaggtggaccatgaactttctcactgtgatcagtgggaagtcggcaggcgtagtcacacctgggctgtcttgtgaggtgggaaatgaaaggcaagacttagcagcagaaccttttggtttctcttggatccaaaacccttgtagagacccttgtcttgttctagtagcttgtctgtgggtattagcagtgtacctgagcaagtcctgctcacatcctcgggtcctcacacaaatctggaatttatgatttgtcttacaaggccattaaaatttgtgttcatctgggtagtgagccttgctgattggaaaaaaaaaaaagaaagctttgggctggtgaaatggcttagtcatatagtgcttgtccagcatgtgcaaggcattgtgctgctcctgggacagacactcacatgcgcgcgcgcacacacacacacacacacacacacacgcacatacacacacgtacacatacatgcacgcacatacacacacacacacacaagcgcggacgccatttattcagtttaccttatgatcagatcattcctgtcagttttatgtagaccaggaccagttttgtctatatttgtaacttcatcatagctgtggagcatgatgtatcatctgtatctcaccacgacggtaaagtcctgtggatcagtggtcatttaagatgatatgatgctgggcatttaagatggagatttggggtagtaggtactgcagtgggaacctgccctgacttcgttagaggtctgtctggctgagggaccccttactttagttcctgcttgtctaaccatgggctgtgcatatgcactagctttgatgtgaaagctcctgtatccggctactagttgttttcttagtggtctgaatattttaggagagtgtgagggaaacactcttgcttgtcctgggatgcacggttaatcctttccttagctagtgaagccagagtagaggtgggccgacaggtatctcattctgtgggccctctctgccctcatgttgttctttccaattaagtgggtgtagtgggcaccgcatagtgcaggtggctgctgggatggcagccccgagtctggacattgtgggctggccttgtgtccccttgagtatcctgtggaggatagtgtttctctttatccacctctgctgcactgaggctccatgctctgaggcccccagagtctctgtagtgaggcctccatgctcttgattctcaggaagcaaaacctcatattgggtgctttatattaaatataatttatatttgtaagttgaggtttgtgactgttctagtgtaagtgtcagttgtcccttgatgttggagacaggagaaagagaaacacaatcattaggttttagccatgtgcccatttagtctaattttcatataatgctataattatgcccattcctgcataggtgtcaaatgaacttgtgtgagttttattggctgtaatttgtaagtttattctacatgtgtgacttgggtagtgcctgctagctggctgttcctggcccagagccttgtgggggtgggaagcaggtcaggaggggttcacccacaatgcttctctctgatgtggtcgtggggtgacttacagtcttagactactgtagcccttgtatacaaaatgaggttttgggggccggaagcatgagtcactcacagtaaaggtgccatgtgttatgcattttctcgcctgcagaaaagcttgctggtaactcactcagtcgacgttctggatagagccttttttattttgcataaaaatcctaagaatgtgggtgaacctgtctgggatcagatcagaaccaaacgcctgtaatagaactctttgctgaagccgctgctttctttccaagaccactgtggttatgatgtaaccttagcaacaagctgacttttgctttatagtttgagcaggagaaacttctgcattttcaggagcttcagatttttttttttaaacaatactgcctcacaagggtgtagcatactacatgcatcctttcatttagcatgcatgagatcaaattattactttaggaaacttattactttaggaatctcatctaaaggtccttttgttctttagactcctccccaagggatgtttcctttaccctcataatgaattctgctttaatggtactcgtttttttttttttttttttaaatatgattggtgaaataaacttcaggtctgagaatgaacgacaaatggtcagatcattgccttaaggaaaattgagatctcttatttcctgtggctaactcctccagctggtttggcacccatggcatctctacacacaagctttatccttgttttccatttctttgagtgtctggaaacctttggtgggtgcagtggccctgctggtctgctttgctagatgtcttggaatgcccagatcattcttggctgtagcttcctggtgccatttccatggctaaggaagctactaagactctggtgccctgggttgtagcatggggtgtatctagggtctagggagccagcgtggtctgtaccatcagagctttgggtcttgctcagctttcctcttggagcaagtccactggaagctgagagaggtgggttgcctttgcatgttccgggtgagtgtgagtggctcatgcgtgaggctgtgcctagggtgatgtacgtgggacctcagctctgagaccctggctgaccctgtttcctcctcctacagtgggctcacccgagaggcacgcagcaaggaggtggagcaggtgtacctgcgctgctccgcaggctctgtggagtggatgtacccaactggggcgctcattgttaacctacggcccaacaccttctcacctgcccagaacttgactgtgtgcatcaagcctttcagggactcctctggagccaatatttatttggaaaaaactggagaactaagactgttggtgcgggacatcagaggtgagcctggccaagtgcagtgcttcagcctggagcagggaggcttatttgtggaggcgacaccccaacaggacatcagcagaaggaccacaggcttccagtatgagctgatgagtgggcagaggggactggacctgcacgtgctgtctggtgagtaccctgtgtggggacagtatgggctagctaacctgtcctgctgcttcctcttaggtaacattggaggctcactagtcacattgattgtttcccctactacctcctgaattcacctctgtgaaacattcctatgtctatgggtccagtgaggcacacttgtcccatgaatccttggtcctactgaaggactgcaaagtgagagagtgttggaccttaaaactgaacacatccttttcatccaagcccccttttaagaagacttctctttgttgtgtacccttaggaccctggagcttctgactcgagggaagtgaggtgataggaggctgtgatccctgagaatggcttgtagttctggtccctagaggactgtttgcagctcctttgagatggagctcctacccttccagctgtcctacacactggttccggtttttggtgtctgccgtagacttgaaatagttttgggtggggaacagaacagcataaagctgtgacatcccagaggcttttgaggatggatattagggttgaggaagacacataaggtctccagggagagcacagctgacccagctccatctccacaagatagagccagaagcctcatggagaagccggcaagtacatggtagggcctgagattgagaaagggagctgtgtagctaggtgcctgctgggaattggggtaggtaaacctgggaggagctcctcactaggagagagtagtcaggaactcctatcacagtgacaactatggatgctgattgattgaggttcgggcacacatttctcttaaaccaggccactccaaatgaggtggcaagtgtgcctaatagctgaagctgtggagttggttttgtttctttctcttttttttcttttgtttggacacagcagatgtttttctgtgtgacagactgtagtgataagaaagtgttttcacgttaatccccggttcggggatatggggccgctttgcagcagctgactgatttgcctcgtgctctcgcagaggcatgttttggccagccacagatagtttctgtgattgtgtaacattcgaagttctgtgaacttctcagagaatatataaatgcaaggaccccagaggcggggtgggtggtgggtggtcattccagggggttggatgtggtttgttagttgtgctcaaaggagaaacaagattagattcagatctctctctctctctctctctctctctctctctctctctctctctctctgtcctctttatcctttctctcctatctagtgatagggactgaaacctggaggataaagggtgagaaaaagaagaacccacgaagtagcaaagaccagctgccacagacagattacatcaacgatgtgtcttggtggcggggagtagagagatgtcagcctacaggagggcaagtcaagtctcacctcctgtgctctgatctgccagggtcttatttctttgtttataagtggggatgattgctagatccccaaaattgccctctctcttcccctttaccgtcagctacctccatgtccacacctccaggctacgggagggagacctggaggggtcagttgagtggcctcaggttttcctggggtttcaggaaggcagttgtcctggcatagatatttagctgtagtcctatattcagtcttctatgtacctttcaggccacagggtcccaggaaaaaaatgttatcctatctccgtgcctaggactttgctgtgtttgagcctcagggttcccttgtcctaaaacaagcacttgcttggccctggatgtctgtggactcaaacctgcagtgatttttcacactttgtcaatgtcagtcactatatagtgactatcggaactcagggcaggaactcagactgaggtggttatgagctctggtccaactctagcactgcctgaaaacgggcatagaaaccagtattacctagagctaggtgccacccatcctggagagcaccacctgagttccagggttgagatggtctcagccggaacagttggctttcttggagaatggggtctcctgagctgttagtgcttaagaaaagcgtggttatatagtgtgaaatggtagtcggccattgtccagctcagattgggacagtttccaagggttctatggccagtagcaggcttccccctcttctttttcctgctttggccttggtgcagcttcagaaataagacagagctaaggtggtgtcatcagagaaggaagagcgtacctgacctggatgttatgccagaggcagacaagctcttagatgaatcagttctcatttatgctgactcaggagaactgtggtaccatgggctggaacccagacaagagtgcatgagagaaactgcccatgcgcaggtgagccttgatccccacccagaaaggagagaacctgccgctgctccaggataggtccacacgagtgtccatagcattagctgcatgtttacttggattgtataattgtcttgtgacctgcatcggatgttaaagaccagagcagtggggtatagtgctgttccaggggcatatatagggcatatgagaggtcatctcagcatcttggaccccagcatgctggatgtggctgcttgccctgcatctgctgcccctctgtccttgctcaggatatctgggcagtggcactacctctgatgcttagggaaatctggcagcatagtgaaggccctacctctgactacagatgacctctctttgccctgctgtgtaggagaacttgttgtggggtgaccagcaagggtgagattctgtttggttcaggagacaggtacagctcgggtgtgtcctggttccattccatcctggtgggctcatgatcttggtcattgctgtggaactctgggagggggtgtcaagtgagggggttggtggccacagtggcgtttcagacacacactgaagaggagggcatcaggatactttttgttgctattgctgtcagtggctcattggactcagggtggagcctgctgcttctgagcgtctctacttatcctctctaaatcctgctctgcttgttgctaataggcttgagacgctgcttggggccccaccgctcaggtccatttgctagactcagggtttgggcatgcccctgatggtgtgagggtggaaggtcatgtcttgtttgtttgtttgtttgttctgttgagaacagggtctctctattatgtagctttggccgtcctagaacttgctatatagaccagactgtcctcagactcacagaggtccacctgcctctacctctagagtgctgggattaaaaatgtgcaccaccatgcccagtggtggtcatgtcttgaagctgaaggaagcattgtgccctggaggctgaagaacaaaggtcgtggtctttggagctctggccagtttctgccttggtggtttctcaggccactgtgattttcttaggattattttttataatcctctctcaaccttgggtaaagaacagtgtggtcttcactgacttccttgcaaggatgaatggttcagagaaccctttggtcacattgtcctttgggtggcacctggtagtggtgatcattgaagaagcccaggccttagctcctaggccactctgcccaagtgtgtcgtgcatctctggtcctgttaaaccactgtacttaccgcctatcataaggtattctagagatttttttttgttttggaactatatgtgtcattttggctgtttttattagacagtgctgcccacacaccagttggtctggcttacagggtctgcagaccttcttagcatccagctattcttgcctgtgtttgctctccctgctttctggcgactgtgcctaggatgagccctcaccagaatctgtccccaggaggcttagatcttgttttctttatcctcatttagttccttttaggaattttcctgcctgatttccaaagtggctcccaggaaatgcgatgtcagcacctgcaatcttcacattctatgtgtcagttgctatgaacttgaatctgattaataattcttttgagatggaggtccttagtatccacatttagtttctgcaaaaatgaagctcagaattaggacacggatggcttcaggtgggccactagctcagttgccactcatggtgccaactccttgaggcttgcacatatttgcaggatgcctagcctgacaaagggccatctcctgcaggtagttgtgagccaggccaagcacaactgaaggaggtagtctctgcagctagcagctgaggtccctgtacctataactcacagagagagcaaaacttagggacttgtctcaggttacacgtccaggcctcgggtcactgcccttcacctcctctccactagaaggagcagccctggttcaacttaggtaactcttcactctggggtgctttagggtagcttctggggaccctcgcctccaactctaaacactatgtgacctgaatacttaaccttttccctggtgtctgctgcctttcctcctgaagggggaccctcaggtagactgtggtcaccaggatagcctgtgggcacaggtcagccaactaaggttaactctccagagtactgtgctctgaatctaatgttgtccaaaatgttagtccctgaggtctcctgtatggccaggccctgtctgtgctccagaccagaccaacccatgtctgcccgtatagtacaagcactggttcctagtcagtgtgaagatgagcagcgtgctacagaagccacacaccacagccactcagtgttgaggttcaggtgacatcagtggtggggactgtggtgacccaagcaaatatcacaggaaggaaaggggctgcagggcaaccagagttgagggtcgacatccaagggaccagcaaaccaggttccaggagtctttctctccaggtggagctggcatgggggtgggagtgtttcattttctgatgggcgggcggtgccgatgccaacaggttgtacttgtctggcggcttctccttttctgataactaaatagaagccagaagtgcttgcaagtgggtggnnnnnnnnnnnnnnnnnnnnctcaggctggaggcaccccaccccctttctggggtgggtccaaaggattgggccccagacacacccagctcaagggtccaagagagctgtgcttgattaggatgctgtaaaccccaagactttgtctcaggtttactccttcaggacccgataaggcttctctcaacttctgttggcctggagacacttggctcacttgccttccacccacatgagttcagtcttggttcccttggggccaagtcaccagcacttggggtcagggtatgtggcctctaggcatgtagatagcattgacctcttcaggaccaagatgccctaagaagaggccttcctcaaagcctttgcaggagaatagctacagggaaatttgtctgtgatgtcgtaccacagggtttctgtttattggagaacttgggcccaaagtaggaaactgaggacaaagtcttgagacataattcacagtagataacaagcttccatcttcttgaatctactctagtttgtagagaagctgccgagccacagtttctgtttcacaccaggggaagtggggcaaagggcaggaggcagctattactgaaggaatgagttatataagtagttgaccagtgagagtatatgtacctctgggttctctgtaggatgctaggccccaggttctgggtgtctcaagcctaagtcctgtgaataagatcaatttgatgggctcttacagtatataacttgtcccaaggcttaatgaggcccagagtaggggctcaactgatggccccagccgaagagcccacatcctcagcagaaagatttccccaaacatgcccactctcccacactccagtcaacactccctttgcagatgcttagccttggtttttgtaagaaaagcccagggcagatggggggagtgagattctcctttggggctgtgatctggggagtagacatcaggctgcagtagggggtctgctttgcattgagatacccccaccattgtaggctgtgagtgtggaagctgcaggagggtaccttggttgggtagtatccgcttgtggtttctgttcatcttggggttagttttgtgttgtcacgggcttgtaagaacaactttgtttttagaattgtttatttggaaccacactaacacagtgaacggtgtggcgctcctactctttgtctggatgcatgctattgcagctacagtatgagctacacgggccaaatgaccccttggaattagtggctggcttgtcagaagtaggtctttggcctccttctttgctgatcactagcatggtagagttggagttggcaagaggtctcaccatgattttatctcatttaaccatgaaccctcacacggaggccagggaggcaggccttttgtattctgcagtgtcaggattggggagggtctgaaactaagcggtgttgtctgggatatatttttaccctgttatcctgtctttcctcctcagccccctgtcggccttgcagtgacactgaggtcctccttgccatctgtaccagtgactttggtaagtctgttcctatggttgtcttcccagggctttcccaagtcagcattgatttcttgtatgtgtgtgtgtatgggagggtgggttgctgaagctgctgaagctgacttcaccctgaaatcacagggagtagtgcattgtgtatacactaaggtgagtctgcacaccatgcattcaggcagaggtggtgtttgcattctaggtgtgtcagtgtgttctcactatgcatagcagctcacaacctcctggggactctggaagtccttcagttcccagtacattttcagaaatgctttgggaacatagttcagagggcaacctggtgtgtccctttgtcagtcccagcccagagcttggctcattcttcatctaggtggttggggttttgaaagcccctttggagtcagggatgttttctgagggttggaggctcctagccagaatatttgcacagtgttcttagaccaggggtagtccttgctgaactgctgccataatagtggctacattaagctggggtccagctggctgtgctcaaacgctcatccaaaagccaagagctgtcacttagtggaatcttgactccttactgctccactctccaggccctatccagctacctaatacaagttgctccctgtcacctcccctctcatcattcttgtcctttgagctgcactgtggcacctgatggtacctagaactacaaagcattttcgttactttcttgttcttacttggagagcatgtgctgtgtagccgatgcccagtggcatatctttgtctgacagtatcaatatcgcagacttgtgctcatcattgaactttcaaaaggctgccatgtgactagagcagattcacgtccagctctaatgcctttgacagccaggcacatgcccattgtgacatgtgctgtgtgcctgccactgctgacatagcccattagatttgctgaccactgttgtcttcttcttctacagttgtccgaggcttcattgaggacgtcacacatgtaccagaacagcaagtgtcagtcatctacctgcgggtgaacaggcttcacaggcagaagagcagggtcttccagccagctcctgaggacagtggccactggctgggccatgtcacaacactgctgcagtgtggagtacgaccagggcatggggaattcctcttcactggacatgtgcactttggggaggcacaacttggatgtgccccacgctttagtgactttcaaaggatgtacaggaaagcagaagaaatgggcataaacccctgtgaaatcaatatggagtgacttgcagggtgacacagtactgttgtccttcagatgagccatgttttgtgggctcagtcgctctatcatatcctgatagagattgcagactggtggcatgggcccagcctggtgctagaactgggaaggtacatgctgctctgaccccttaggtcccagccaaggatgccctgacccattggaactgctgtaaaatgcaaactaagttattatattttttttgtaaaagatgccttggtgtgccatttaatagtgtttttacaaagttattttcaggcattggatttggcctggtatattggtgggagctaggttatggtgtgcagtgatggctatggctcagccttgttattcctgtgatggaaatgtatggagcaaatactttctaatttccccttcattttattttctattttaaaagaccatctttgccgttgagaacctttccagactgtatggaggctgctcccattccagggagtaaagaccaggatctgagactagtattacatccatcttaacccatcagatgggtacctgcattgaaccttctctgctcagctatggcctgctgtcccaaagaccttttgctctctggacagttccagatggtgctgcctggcttaagggacttgttcctcccttgctcctaccaggccactgttgctttctgcatctgtcccactgaaccagtcttgtcctttgaccctgagtttccccaaatgcacacatcaaatccctgaataccaagggactaacctacttaatggcccatttcttcagagggtgtgggttttccctatagtaagaaaatctccacaagttgaagcttaaacagtaggctttcgttcatacagtcctggaagccagaatgggtgtgagcagaatcacatttcctccggagactccaggagggactttatagcttctggtgactccaggaatccttggcttgtaacaatttcactctggcattgctttccctgccatgtgacttctgccttgtatgtgagggcctgtatcaaatctctgtcttgggaggatacagatcattgacttagggcccactccggtgacctcaccttcacctgaaatttactcgatttccatttaggtcagaggcaaaggctacaaaaaatatcaaatccggagaaagattcaatggttaggcacttgctactcttacaaaggacctgtgttcgattcccatgttgggaactcatgttaggtggcttaaaattgcctataactacaattccaggggatctagcaacctcttctcgccacacacaagcacacacacacacacacacacacacacacacacacacacacacacacaattaaaaacaaaacaaaacaaaaaaaaacccaaagaatatttattccaatatagggagctgggggtgggctgcatttcatctgtgtatcctagctcatgggccctgtcctgttaagagtcctggctaggatctcattggttcttggagttgctgcctcctgttcaaattctgacaactctgtggcccttaccagttcctaaggcatgttggggtatcccctccccctccagctatgggcctcagaggtaaacagacccaacaattgtgtttatttattcatcaggtgcttgttcccattcagcgtctaaggcaagacctagatccagcccgtgagcagcaagctgatgtgctagcttaggtgtgtacactccagtgtttgccagctcagtttgcactggtacaggtctacaggtcacaacaagagacaggtgcccacgggtgaggatgcgaacgaagtagtagtctgtgaagggccgggccccaccgtggctgctgattaagataccttatgctagcaggactaggtcacacagatgccatgcccagtcgagcccctcccagtccctcccctcagcctgcagggaagctgcagaactggattggtgggctggccaccacctgtctctacaggagattggggtcagacttgcttgggtttggctttggatgcacctgggagtgaggctgcttgttcaagatgagagagagcagggcttcccaggtgtgaaagtggcctctttgaaagaacctttgctggagctggcagggcccaaggggctggggctgagaggtactgacatcacttgtagacaacttatatttaacagatatgtgtaggtggacacctggttccttgtaggagtttctctttccatggctgaggctggttgttactggaacagaaccagcgttggggtagagccatcacactgggtgaaagctgcctccccagagaacatacaccatgaagtagtgggagctgctctgtgactccagccaggggagcaatgtagaagctcaagtcctggaccacctgtgccccaaatttcaccaatttttaccaaaatttaccatacttctctgtctccatactgtccccttctccatgactcttaacaggacagggcccatgagctaggatacacagatgaaaggggacagtgctgttccctgcactctcctctctgtccatatccttctaccctctactgccccctcccttgttccagccccatatacagcccccactgtttcctctctctcctttgtccctttcttttgtttcctccatctgctttgtgtcctacccctgtactgtccccatctccctcaccatcccatttctctgctttgtccattttactctcttactctcctatctctgcaccgttccctcctcctgtacctctctgctgccttttccttcatcccactgacccgatctcttgccctaccctgtactgtctctgccccttgctagcactgtcccctctactgtccacaccccccaacactgtctactctccttgcactgtctcctgtccctttcctacctacccttgcgccctttcctgttgccttatatgatgtcctgggctgtaggcaccaagcccagacactgattcttctacttcattttctcttttaagcccgtggaccagaccctcactgttggttacatctcctgtgtgtgtcccagctcacgggccctgttcttagagttgctacattctggtcaagttctgagaactgtgaggccattcccagtacctcaagcatactgggagagcccagcttcattgggaggctatgacttgccaaattcaggatatgaggacagcctcctgtacatgggcaaccctttccattcccaataccaacttgggcttcatgttacagataggaagtggaaacatctgtgagtgcttgttaggcctcctcctaatggctgtatgtcccaaggatttgagtggcgacttgctacttcttggcaaacaggcaaacccacaccctgtactgtccctaacctttgtactgtctcctccaccccactcccacttccatccagtccctgatgtgtcctggacctcatttcctgccttgtggtacctgtttaggagactgaatgtgacatgccacaggagtacagcaggatccacctaccctgtgggacactgggatgaggggactatcaagctggtttatgtgggtgtccctatcttgctctggtaggtgagctaacctcatataggccctatcagccataggatccctcttctgcctgcctgggacctaaaattgatcgcaagctttggttgccacatttttcttaggaaaagtggcctaatgtggggcctctctggtagagacaaggaatgccttacttgccctaagaacttagagccacagactaacagatttgcctgcaagtcacctgctgtgacatccccttgctgccttcatgagccaggctgacctggcctctgccattggggctcttccttatctccagggtcaccggtactccaccttctagaagtttccatagtctaccagagaggcaaagccatggctctggtctccagctttcttctgccagtcttgccacccaggtttaaactctgactcctgcagttatgttgtactgggagcatctaatagcttgagtagtttttgacccacagcccatgtatcctacttctggaaggttctgagtattctaggttagagcagagactctgcgtgggtctcttgaatgtgtggtgagcatgtcccaccctgagtctcttaatggggccatgatttcttaaagtagttaaaacctttccccataccagtttttaaaaggatttcccccatgactataaaattaacgctattgagacaattttttaaaaaaaatattgaaaagcatagaaaatgtgagacaaacactttcatgtagcattttcatcaaggttatgccagtgtctttttaatcatgacactcaactccctgcagctagtctacggctaactcatggtcactggctttgacatcctctaaccctgggcttatgggtttcctcaggagcatagacatgagatggtcagggagagcacacaggccttctttagttttcaataatccctctgcttcctcttctgagaccaaccagtacttgaacctcaggacagcaaaagtttctaaatagcaatttctgtttctctgattcataacagttgtgtttctacctcattctgaatcctgtctttcatttacatggccctgaagtcctgtcctgattctggggcctggtatgcaaaggaaatggtttattcttgattctccaatgatcccactgcaggcacagggccctgtaaagtataaacctgaagatttaagtgcttcagaaaccagaacaggtaaagaaccaggcaggatccagaaaccaagcctgtaatatcctgattcacgatactgtgactttgttcaaacttttgacttcaagagacccatgacttcctgtctgtgttgtaggtctctggtaataaattagtcatgatctgagtccttgcccatgaaatgaggctctcaagtacttcttcagctgggaggacttctgtggaattcctgtggctgggaaagaaggaagactgggttccgggagagcctggcaccgaggccaagtgtccagcaaggcctgatgggtcaggctgccacagctcctgaaccacattctctagaaggacctgtttagggcttagagatgctctggtcccacaggtagaggtgggaaatcctcattagtgctatagctacaatccaggctgccactgagttgtggtgggaactgatcccagacagcctgtgcatgtctttctccagagtaaatttggggacagcatctcctagagtgttattagtaggagttagtggtatctagatccagcctgggtgtgcccacctccttgtccacctcagaccacaataagcctatcattatcatgggtggagtatggcttacttcagatacggatacacgggtctgttggactgccattctgtgtttgtaggatgagaatataaagacagtctgggagctttccagagagagacttgacatatctctgggaccttttcaataaaggaccaggcagccattattggccttttccagtctttttgtcccaagtagttttcacttttctgggaaaagcccaagagccctccttccagcctttccaccatagcatctggaacagaggtctcccaaagaggtttttagtcctgagaggaatgcagatcctttgtttccacggtgaggtatggacctggtacacagtgaatgcataggtcccatcccttctgaggagctgccagctggcagcacaattgaggctttataggtgagccagacaagtgataatgggaggttgtcaagtaaccacagcagggatttggggatgcaaatctgtggggaggatgtagtcctcaaagactgtggccctgtggtgaggatgtgggcttagggaagatctggctctgaggaccacagtgctttggagggatggtccatgagaggaggtgattctgaggttgggctttccagggaacacaaggctgctggaagcaaggggtcagggtaggggtggctctgtccttctgtgtgggagcagagtgaaggatgctggagaacgtgaggaatccagcatcaacagtaggcctttgtgcactgccacccgggaaggcaatgatttataaaaacagctaagggtaggcattgggtggtaaggtcaccatggtcggggctttggaatctcaatttcagaattctgcttacaagtcacatactctgctgttgtcagtttgatcagaggcaatatggggaaaaaatggctaaagtccaaaattaacaacaaaaataaaagcatcctgaggctccatgtgaggggaccattggggctgtagaatgggagagaaaaagaaatgagatgtctgtgccagacaatggtgggtaccaaaaggccctaagcatgtcagcatttgggtgtgactgagtgtgtgtacatatgtgtatttttgtgtgttgatttctatatgcatatctgtgtgtatgtctaagtggcgagcatatagtgacatttactgaggccacaggagctctgtcccagctcactctcccctcattaaatggatagagtgtgtgaggtagcacagccattgtagccataccactcagcagtttctccctctccacttggcttcacattccctcacctctggggacttcctgtgtggtagagctcattctgacataatcctttatgtacttcttgttatccatctgaggttctgttttctacgggcacagtgtgactaatcagttaatcttccaaagtaattctctaggttctcccccttgcctaaatgaaggagtcacttctttcccatgtccacccctgtgtggaggtgtgaagtgggtagataagtctaacgagtgaagagaattgaggatgctattagggctatagcttagaggaggcccaagagcaaattcaagggacccccaagaggactctggcaagtgaaactggggtgggggggtggagactagatagtaataggccaggcttcgggaacaagaactctcttcctggactagaccttggagagagaaaggtaacaggagggatttttgatgtgctgaggtgatattagagatttggggagagtagtcctcaggatgttcttggggaggagacgcagatatgttgagagaatctctgaagtgcactggttctactcattccagaggtcagaaagacaaaatgtaaggggctggctagacatttggtgtctatgaacacttgtaagcaatgtctagataagaatggacattcaacactattagacatgctgtgtgccttttggacaatcaacccaggtgattattcttaatgtgttaaatattagacatgtgttttccctatggctcctccttttatctttatttccctgttctcgaacattgcttctctagataccaagagctaggttggtgttgggtgggtgagaaggaaggggaactcacatgagagaggggccctatttgtttagggtagggcactactctctagtcagggccttcccctctgagagctaagacagccagaggcctctttcttttggaccttcccaactgaattaaaaagtacccaaagcaactttactaaaacccaaagggaaacaaagaaactatagatgacatgaaagcagtcaagggcacaccccctttttgtaggcggctagtgtcaggccactggaagcctgctaaatggtgctgcctgagcctgatatcagggtcacacacaactatgcttctctggccctgccacccaccaaagtagctacagtgttgactgacagtctgtggagggttaagagtggtgggccccctaataagatgttcacagcaagtattcagttgagcacactaagttctcagcagggagaaaaatcagttttgaagtgtcaggtccctcatctggttcaaccttagcatgtttagatgtggcctaagctatagacagatgcttctcttcctggccatactaagccttaggcaataaggtaagcaatggctgcctaggaaacctctcaggggcccaattcccagcctggcttctcctccaaaaaggttcaggcacagattggtcagagagaccttggattctgctctggcagggctctatgtaggcctcagagtctattgtctgaccttgcacggggtccagtagtgtctgggtctcagctaccatgtgacctcagctatatacctgagactgctgttccaaggattgtatcaagacctctaagctctcagtcttgctctcaaagctttgtgttagacagtggtccagaagttataggcattacccaggcatgcctctgagagtctcaggctgcaggcagatgaacactgtggtcttacacgcgttctcgcgaccggccaggaagaacacagcaaaccagaatcttctgcggcaaaactttattgcttacatcttcaggagcaggagcgcaagccccaagccccaaaaacgaaaaagcccccccccccccgcttacatctttaggagccagagcgccagcgcgccagagcgcagagcaagagctctattgtttacatctttaggagcaagcgagcaagagccagagccagagagcaaaagcgcaagagcgcaagcaagaaaaagaacaagaacaagaaagcaagagaaagaacaagaaagcaagagagagaaaaagaatggcaaaaccccgtcccttttaaggagaattatcctccgcctaggacgtattactccctgattggctgcagcccatcggctcagttgtcatcacaagaaaggcagaacacatggcgggaaaactgcccctgcacgtgtgcagattatgtttaccacttagaacacagctgtcagcgccatcttataatggcaaatgtgagggcggcttcctacactatggcagcttggtcagagggatgggaggccagaatgattgctattactaaggtgcagaactctgtactagagggagaaggtcaatggctcattggatgcttgctggggcgaagagtatcctaaatggccagtgatccagggtatgattagggcctcatttctctcagagctctagtggtactttatgaaacctggctctgctgactgtctcctgccttgatacctgtgatctattaacttctactacctcatctttgacttgggataagggcggtgaatagaggacaacctttgctgaggaagaccagaaaaagacttccttctttctctttccagctgctcatagacatggtgatcctctgtgttcacaaaagaaccacatagttaatgtacctatgaattcctgttccttatgatccttgaccacaagatggtgggaggggacaactattttccattagttcttggccactgccactgacttcccaaccaaaccagacagtcaggattcagctgaccacacatcttgtgattgagcctgtagaagccaatctgatgtgggagtgttgtgccttaccattatgctcacatggggagcagggctgggagactgagggatggaaagtagagagaagggagaggtagagaggagaagtaggaagcaatgggaggaggagagggaagttagtggttgaggtaaggaggggagtgtgagaggtaattgagtcgggagggaggaggtgggccatagggaaggtgggcatttagggcaagtttatcagacctcaggaacaagcttttttcttttgcctccagggagctcttcccacttggttagggccaagaacaagagtcccttaaggtttcctaagacaggcattctggatgtggagcagtgagatatcagatggtacacttcctgttctatgaacatgctagtcccaagggagctgtaaggtcgaaaactaggatgtgagcctcctcttcattgagtctggtagctaacactgtccaaccacatctctgccctctgtgatggaggtgctctttatgtgcttgctacagccctaagaggtagcatgtgcactgatacaagaagggcacacccccaaaataccccaaaatgcaggctctaaagacccgggctaggcagactcagaaggtccaggtaaatctacaaggctgtatgaaaggaggggctgttccttaggctgcctcaggcccagtggtcagtgggaaagcaaggagctccaatacttatgctctaatctgatgggtgaaggcctaatacaaggatcactaggaccctctgcatgaaagaactgggccacacagtcctgggaaagatgatgactgaggagggaggagttcctcagcctt

SEQ ID NO: 212 - DNA, 1001 bp, Mus musculus
cagtgggctcacccgagaggcacgcagcaaggaggtggagcaggtgtacctgcgctgctccgcaggctctgtggagtggatgtacccaactggggcgctcattgttaacctacggcccaacaccttctcacctgcccagaacttgactgtgtgcatcaagcctttcagggactcctctggagccaatatttatttggaaaaaactggagaactaagactgttggtgcgggacatcagaggtgagcctggccaagtgcagtgcttcagcctggagcagggaggcttatttgtggaggcgacaccccaacaggacatcagcagaaggaccacaggcttccagtatgagctgatgagtgggcagaggggactggacctgcacgtgctgtctgccccctgtcggccttgcagtgacactgaggtcctccttgccatctgtaccagtgactttgttgtccgaggcttcattgaggacgtcacacatgtaccagaacagcaagtgtcagtcatctacctgcgggtgaacaggcttcacaggcagaagagcagggtcttccagccagctcctgaggacagtggccactggctgggccatgtcacaacactgctgcagtgtggagtacgaccagggcatggggaattcctcttcactggacatgtgcactttggggaggcacaacttggatgtgccccacgctttagtgactttcaaaggatgtacaggaaagcagaagaaatgggcataaacccctgtgaaatcaatatggagtgacttgcagggtgacacagtactgttgtccttcagatgagccatgttttgtgggctcagtcgctctatcatatcctgatagagattgcagactggtggcatgggcccagcctggtgctagaactgggaaggtacatgctgctctgaccccttaggtcccagccaaggatgccctgacccattggaactgctgtaaaatgcaaactaagttattatattttttttgtaaaagatg

SEQ ID NO: 213 - protein, 255 aa, Mus musculus
SGLTREARSKEVEQVYLRCSAGSVEWMYPTGALIVNLRPNTFSPAQNLTVCIKPFRDSSGANIYLEKTGELRLLVRDIRGEPGQVQCFSLEQGGLFVEATPQQDISRRTTGFQYELMSGQRGLDLHVLSAPCRPCSDTEVLLAICTSDFVVRGFIEDVTHVPEQQVSVIYLRVNRLHRQKSRVFQPAPEDSGHWLGHVTTLLQCGVRPGHGEFLFTGHVHFGEAQLGCAPRFSDFQRMYRKAEEMGINPCEINME

SEQ ID NO: 214 - DNA, 16513 bp, Homo sapiens
  misc_feature (1)...(16513): n = A,T,C or G
tgcccaggagacgctgcaggggctgtgctccccgcccggctactcttgagtggtccccaggctcctcctcctcccggttccacctggagccgtggggctgtgccggggatgcctcgctgcagctgcagctcagggagaactcactgctggagcttctgcctctcccgtgccgtggggccgagccgagctccaccagggtctggacttctgcacgggcagctgtgcttcccagggtcgtggagaggggtccttggtcccagccactgtgtgacctcgaccaggacacttgactttcctgcccccagagggtcttgtctggacctccagagcccccagccttgctcacttggctctgcttctgggcagggtgccctggcattgctgttgctggcacctgccgtgccttggaggggtctccagtgggacctctgagcacggctcttcctgtacttctcagaggtgagcagagggcatttgtgggagaactggaacctggggaggaaaaaccccaaggctggcaaagactccctgcagtctgtccagtgatccactgaggctgagtggtggaggacatggaggccggcccgggaccaggacatggaggccggccagggacctggggaagagagggcctcagtctggtgagaccagcctggtgggtgcctggggaagagagggcctcagtcctgtgagaccagcctggtgggtgcctggggaagagaggccctcagtccggtgaggagaccagcctggtgggtgcaggccacccttgcctgctgtcagggcctgcccttctctccggcctccagctgctttgccccagcgatcaggcgcctgagcttcctcccccgagcctgagtccagctgagctccgtgtggctttcccggtggagcagactctgtctgatttcccaacggctggcgcctcccagggcgtgctccttgccacggaacagccccttggggccaggtgtgtactccaggcagtggcccggcagtgctgggaagtgccggtcatggctgctgcacgtgggttgctgtctgggagagtcctgtggtgtttgctgagggcggaggacaccgaggacagagaatgggcaacttccagggagggcccagatgcagccacgactggggtgcatctgggatacctcgtccagggacactccccaccatggcctggtgcctgtccagcaggaagagcttcagggcagtaggaagggggagtggccccagctgcagagggaaggagcttggtggcagggcggcaggagggatgggaggtcaggctgacgtccactggcgagaacacttcagatgaagatagtgtggacccctgcccagtcccaacacaggccccagacgccctgaaaccccaggggctcagcccaaagcaagggcaggaagcattgctttactgagaaaccataaaaatgtagaattccacctcaaacgctgctgtggccgatactgaaggttagaaatgagccggtggggcccgacacggtggctcacgcctgtaattccaccactttgggaggccgaggcaggcagatcatgaggtcaggagatcgagaccatcctggctaacatggtgaaaccccgtctctactaaaaatacaaaaagaaattagacgggcctggtggcgggcacctgtagtcccagctgcttgggaggctgaggcaggagaatggtgtgaacccaggaggcggggcttgcagtgagctgagattgcaccaccgcactccagcctgggtgatagagcaagaaaaaaaaaaaaagaaagaaaagaaatgagcaggtgggtgcttcccaggggggccctgtggcctgtggccccatgcatgatggccctcaactcagccacagctcccagggcagctgtggctccttgggtggcccaagacagctgctgcgtggtgtgagcttcgctcatgaggctgggcagaggctgggatcccaggtgtgaagatgggcctgggtggtggctgctggaccttgttgtcacagatgtgccacctgcttcccaaaaccgagcaccaggggtctgagaggttgctatgggaaggtcgcttgctccagggggccctggaacagttgctaagtttaacgccctggcccaggatccacctgtcctgctgcagaccagccctgctcattcctccctctggctgtgaagatggaagcccatgggttggatgcctnnnnnnnnnnnnnnnnnnnncggcacctcctgcctcctgcctttgcaggaccgcctggcccagccccagctgccatggctgcccagccggagggtgctgctcagtgaggggaccctcgggtggactggggtcaccacgcttctgtcgttgaccagctctctctcagccgaggccacctccactcacatgaggcgccctgggctgggacctctggccctgtggtacggggcaggtgctggcgtgcagtctcacctgtggaggataaaagtgctgcctgaaatttgagatcccccagtgctccctccttgttgcttcccgacgtgagtggtggtctgtgctgctggcctctgtccagcacgtgcctgcatcaggcccagcatggtctgcagacccccagccggcgagtgggatgggggtccacataggtgaactaagtgtcaagggtgggccacaccccggggcccccataggagagcgcaccgggcggcttccagcttgggggtcaggaggcccccgtggtgggggctgcagtgtgagtctgtacacatcagcaggaaggggatttggccagaagctcccattctggagggttgctgggatggcagaggtgcccccccagtgccaggctggaccggcctcaaggtgctcagcagtgccaggctggaccggcctcgaggcgcccccagtgccaggctggaccgggcctcgaggcgctcagcaggctgtgcagtttctttttcctgataccttaatggaagcaaatgcaggaggaggtgggtgggccggtgagtcaggcactgagcccggctgggaggcgccctcacccctgcctggcggaaagtgctggccttgtctctgggtccctcctacctccaccctgcggggtccacaaagacctgcgcttgcccagtgcaccgtagactccagggtctccgttgaccacatgtgcaggccctgagggtccatgtaagttcctgaccccagaaggcctctgagcagctgtccccgccttggccaaggtgccagatatgtgtgctgccctgtcccccggggcccccagtcaccagcagctggctcgggcctgtactcatcaggcaggtgacagctcagctcacttcagcccagcaagggcagccggccaggggtgcagacggcgttagcttcttccagggccggcgaaccccaagtcaaggtcgtcccagctcttggccagggacgtttcagagccttcagaacgtgaaatggcaccggcgaaaccagtgccattgagatttcacgtctcaaagtttctattgcgttaggagacttggggccaaaacctagaggctcagaacaggtgaggccttgaaacctgcaataagagcaaataataaaaccatgttttccaagtccgtcccgagtgtaggaatgcggggcgtgcagaggtttctgtttcacagtggcccgcccatctaagaaactggggcgaagggcagggcgagggctgggccgaggggagaaggttgttgggaaagcctggtttggccggtacgggagctcattctgagaagcctccgtgctttccgcattctctgggggaggccaggccccgcagggttcaggggcttcagagggggttctgtgagcagggcttggcttgaaagccatttggggcatgcacctcatcccgcggccaggtggcatccggggaaggggccgggccgatggccctgactggaactcactgccctgctgggtgaggccccacgccggtggcaggtggacgcgtcgctgcctgcttagggatccccttcctggaatcttggcctcgctggcccttccagccacatggggggtcccgcgggatgggatcctccttttgggtgccgctgccgtcgcgacccagggaagtgggcagcagagctgtggggaagtgtctgcccttcgaggaagctgggaaatgagggtggtcccggcgccgtgggccgtggaggtgggttgggggcgactctgggaggtgggggtgctcctggcgccgtgggctgtggaggtgggttgggggcgactctgggaggtgggggtgctcccggcgccgtgggctgtggaggtgggttgggggtgactcttgtctggtgggttcggttcagccccagtgggctttgcatttgcaacaggcacgtgagcgatttctcagtgagtccggctcagccgcactgaggagataagtggggaaagagcacaaagacccctccccacgaaggccctgggacatggccggactgagggtcttgctctcggacatgtgcccatcatggccgaggtgcaggtgcctttggtccaggtggggccgaggggtcccctgggtgagaccccgtcgtggtcgaggttgtgttttctgtctcccgtgctgccggcccctccagcacgtgccgccaactcacatttgaagtggcgttggtcacaaaggtgccttgacgtggacaccctccctgacttggctttgctgagtgtgagatcctttgacggtggtgggcggcgttccagagcctgtcccgtccaggctgcttcctgactctgcctttcttctccagcgccgtgccgtccctgcagtgacaccgaggtgctcctagccgtctgcaccagcgacttcggtgagtgtctgctcggcagcttctacctcctgtgcgcctggtttctgccacatggagctgtttgggcccaggagtccctcttcagggcccaggacagccttccggtgctgcgtggaccctcctggaggggcacacgctgtggaagccctgggctcggccctccaccagccctggggacagggacgccaccgcccacacttggagggagctgggggttgttttggtgactgtcaaacattttcccattttgtaaatgagatcactgctcttcgaggggactcttgaagtccactgtctcccagcagctcttcttgctgaagtgctttgtaaacagcattttatcagcagcccagagcatccttggcgttggacactccttgccccccaccagagttcacgctgttccaggcctgaggcccccggcggctctgcggctctgcaggaggagctttggggtcccagggctccagcccctttgcttgtggcgtttgcacagacgccctgtgggaaaggtttggcctcccgtcgtgtggtgccgtggaagccatgtcctgcaggccccggctctgcaccccacctccaagctcaaggacaggccccttctcactgctttcccggcccctggcatggagttggggctgggcaggggtctccaagtgtggcgcgaaggctgtccccatgcccaccctctcctgtgagctgcaccgggtctgtctgatcaggacacagaactgcaggggcaccctgtgtatcagctggacttgtttgttctgttttcccatttaacaggtctggcccttggtagaaagggcacctgttctctgacgatgtctaagtatctgggacaccccttggcagctttctgctgttacattgtacttttctctgggaatttccacgctagatggcagagtcgggggtcagctgcccgttccagtgcccatcgatgcgggggcagggggaggtgcggtggtcttgctgtgtgcttgcctttgctcactccctgtccccatctccttccccgcacagccgttcgaggctccatccagcaagttacccacgagcctgagcggcaggactcagccatccacctgcgcgtgagcagactctatcggcagaaaagcagggtcttcgagccggtgcccgagggtgacggccactggcaggggcgcgtcaggacgctgctggagtgtggcgtgcggccggggcatggcgacttcctcttcactggccacatgcacttcggggaggcgcggctcggctgtgccccacgcttcaaggacttccagaggatgtacagggatgcccaggagagggggctgaacccttgtgaggttggcacggactgactccgtgggccgctgcccttcctctcctgatgagtcacaggctgcggtgggcgctgcggtcctggtggggccgtgcggtgagggccgcgcgctgggagccgcgtgccctgggcccaggcctgaccctggtaccgaagctgtggacgttctcgccacactcaaccccatgagcttccagccaaggatgccctggccgattggaaatgctgtaaaatgcaaactaagttattatatttttttttggtaaaaaagaaatgtccataggaaacaaattcccgtgtcttaaaacgccttggtgtgccgtctgatactgttctctaaagacgttaggagtcacggcatctggcctgcggttgggtgaagcactggccgttgggcacagtggatgtgtgaaaaggtgccattcagagttgttattctcatgacggaagttttggagccaaataatacgttttttattttcattttatttttaaaggatgagctttggtccttttcaggccgccggttgtttccgttcccgagaataaagacgaggatccgaccagccagaagccggagtctgtctttcgccaggtccggtgcccacggcccgtgttcagggcctcgctggacgtaccccagggcgccaccctgcctcggcagacacgcttgctccgcccggcgactgtccctcagcgcctgctgctgcatttccattaatgcaggtcctgccctgtggccccagcctgcccacagtgcaggggcccacagctagtctctagacgcccaggagctggtctgaacccaggttggtgaccccatgtccccaaaggatgcggctaccagaacaaatcaccaccgactgcggggctgaaacaacctcgttctctgagttcctgaggccacaatccaaagtcacggtgtgggcagagcctctccctccagggctccaggggagaacgcttcatcttctcctcagcctccaggggttccagggaggacccttcgtcttctcctcagccgggggcgacccttcgtcttctcctcagccgggggcgacccttcgtcttctcctcagctgggggggacccttcgtcttctcctcagccagggggggacccttcatcttctcctcagcctccgggggttccagggaggaccctttgtcttctcctcagcctccgggggttcctgggaggatcttcatcttctcctcagccaggggaggaaccttcatcttctcagccagggggaggacccttcatcttctcctctgccaggggaggactcttcatcttctccttggcctctgggggctccaggtgctccttgatggtggctgcatcactccagtctctgcctccgtggccacacggcttctccctgtgtctgtgtccagatctttctctaggacattggtcactggattggggcccacaccagtgacctcgtcttaaaccgattacgtccgcaaagaccccatttccaaataaggtcacactcagcggttcctggtggacatgaaatttggggtacaccatgccccagcacagggggtccctgggagtgtcagttaaccagaccccagcctgcatccccattgatgaatcaggcagttcctcccgtgcagccgctaagagcaaaggggacctgggagagggtgatgtggtcagtgggcaccatgccggccttgccaaatgctcaggcactctgggtaagcactgtgtaccggctcagatgttcactggctcaggtgtgcaccggctcagatgttcactggctcaggtgttcaccggctcaggtgttcactggctcaggtgtgcactggctcaggtgtgtaccgtgcactggctcaggtgtgcaccggctcaggtgtgtaccggctcaggtgtgcaccggctcagctgtgcactggctcaggtgttcactggctcaggtgtgtaccggctcaggtgtgcactggctcaggtgtgtaccgtgcactggctcaggcgttcactggctcaggtgtgtaccggctcaggtgtgcaccggctcagctgtgcaccggctcaggtgtgcaccggctcaggtgttcaccggctcaggtgtgcaccagctcaggtgtgtaccgtgcactggctcaggtgtgcaccagctcaggtgttcactggcttaggtgtgcaccggctcagatgtgtaccagctcaggtgtgcaccggctcaggtgtgtaccggctcagatgtgtgccggctcaggtgtgcactggctcaggtgtgcaccagctcagatctgagccagcacaggtctgcaggctcccacaggtcacaacaagaagcaggtgtttctgggcgaggacctgaagcagcaggctggggctgggccaggtcccactgtggctggtggtcagcacacctttgccagcaggcgccacagcacaggtgcccagcccacagcggggcggcagggaatctgctcctggaacctgggttttctgggctggctcccgggggtgttgactgacaggagaaggctgcagaacaagaaggtcgggtttcaggctggcagcctctcctcaattacagggatgctggggtaggccagaacccggtgtcaggtggagtagaagtcacgcttcacgggaggcttctgttttttaagaagtgcctgtgggctggggggtttttggtccagagtctaggggaaggcaaagcttaccaaacagaaagtgtccactccggggtgggggactggggcctcgtctcttcgctgggccaggacagggctgtgaggtccagctgcctgctcagctctgggacctgtcctcctgcaggagcccacggccgtgaacatgcacacgggcagatccacatgtcccccgaggaaaaagagagggtcaaggttgagtgtgtgggtgctagggggtgcagaactcacttctaactatgagggttgaggcgggcttcacaggggaggtgggttttgagccaggcctgcagcccggcatctggaagtggcttacaggctctccctgagctctctcctgcaggacacccctgcctgcagatctgcacccccagctccttcctggggacttgatatcatgaccctgcctggcaccccaggggtgaatgctgcacccagccctgagggtttccatctgctgggggcatctgacctgggcaggccagggtgggtgggagggagtccagcgggggcaggtgcagggtggccagggggagacactgccctggctggagcctggattcactaggtcatcaccaatgcagggggtcctggctcactggactttgctactagagaaggttggggagctccacatgaaggcaagaaggctggggctcagggtgtaactcatccccggagagcaaccagaaaggccgtcggattgcaacgcagcctgcattgtcctcgctgaacgcctggtcctgtcccacctgcaccggacagcaactgcttcccctccagggcggcccccatcgtcccccaggtgctgcaagagcagtgagacttacccaagacaagtcagaggctttggagctctcgggggcggtggcttctcccaggagccccgtatctgtcagtccccccataaggggaggggagttggcaaggctcctccttgctcccagcgtgaggattgcccctacttttccggcccccacttgccccctccacctgcccttttccctccgggaagccctggaggttttccaagaactctgcgggtcgagggggcagcctatgtggggtggcggggggcctcctgcttgttggatgcccagacgcctacacctttcaccctggggtccagtcggctgatggccatgagagagaagctgagagcaaccagagcccacagctccatgctggtcccccatctgcaaacgctgggccccatgggagctgtgactcggtttccagctcgtcacagggctggccgaggccccggcatgtcaagccatctcaggttgggcaggaatgtggtccgtgttcacatgtgtctctgtgtgtgtgagagagaggggtcagctgggacgctggggtggcagggacagtcctggctcacccctcatcctccctcgacctcgactccctccacatgaggagcccccccttcctggctatcctgtgagttgagcttcctctgctgggagggctttgtcagaggttccctgcggttccagaaggaaagctggctgcagggagggccgggcactggacaccgtgtggctgagcctgtggcgggggctgcacagctgggttcccagcccccctccttgtccccaccccaccgcactgggaggccctgctgaggggccagagtccggctgcaggtcccacgggtgggggtggggcccctcattagcactgcagctgacactgagggcttccacctcgctaattgattaaactgtttagaaaccaggccggcgtggtgggaattggccccggccgggctgtccgctccccttctgtgcaggcagcggcccccggagttcatcagtcaggccggttggtggggtcccggccctggctgccctcgggaacccttctttgctcctttgtgcggtcaaaatggtgagggtcctgagaggagctggtgagaccccggggtcctctcctccctgaccactcactgggcgagcatggagggaggcctactgtgcacgggcatgttcctgggaacctgcctgctgggattaaacccgcccttgtgaaggacggcaggtgggtcactcaataccaggaggggcacggggctgtgagcagaggcccgagagccttctgaggcggcaccgggtgctcctgggccctgctctcctgggatttgttgtgcctgtgacctcagcctcttccttcctctcctgtgggattcccccaacaccccctcccctcctgccattccttcccccaccaggccccatgcctcccctccccagtgccccctacccccaggtcttccctctaggacatcagcctgggctgtgggtcttggtctcccacagagactgagtcctgggagaagggcagagccttggttcccagtgcagcccctgtgccagcctgcagtgggcaccggttcagccggtgcacactgggtcctgcccccacctgaggagcggcctggggcctgatcagccctgctggtgtctggcctgcagccagcaccggctctgctattcacacttggttacaggtgggtgcccatcccagcagcctcggagcagagtgggtcgggctccggaggtgggggcggccactaacagcaggaggtcgtggcagtgcggctatggcaggggttctgaggggcggaaggcaggggcgggacgtggggacgcagacctgcagggaggacgccggctcacccagcagggaggggatggccgcccagggacccccagcctgcccgctctgcttccccgaccgccggggcaggggccccacgggggacgccagggaacgtgaggaatccggagtcaacactgggccactgtgtgctgccagccgggcgggccgtgatttataaaaacagcggaggcttggctggtgtcggggcggtgaggtcacggcggccgggggctctggaatttcttcagaagaattttgcttaccaagccacatacttttctagccatcagtttgatcagaggcaagatgaaaaatatgctaaaaaacaaagaaacaaaaatacaccccggggggctccggtgagggggaggggcgctgcgggaggggtggagggcccagggaagggtgaggggccgggagccactctgcccggcactctccgcccagaaacagcccaacgcccctttctttccccttttagcactgctgagctggactaaaatgcccaacaaggaactttactaaaaactgaggcaagaaagaaaacacacatgacataaaaatagtcaagggcacattcttgatggtagataactggtctctggccacagcggctgccaggttgggtgtcggccggcgggtctgccagtcccactcataggcactgcacttccctgggccggacagggggtgtggcgggtctgtgggcggggggacaaggttggcaggaccgtgaggggggtggtgggtctgtgggagggggacaaggttggcaggaccgtgaggggggtggcgggtctgtgggcggggggacaaggttggcaggaccgtgaggggggtggtgggtctgtgggagggggacaaggttggcaggaccgtgaggggggtggcgggtctgtgggagggggacaaggttggcaggaccgtgatgggggtggtgggtctgtgggagggggacaagggtggcacgaccgtgaggggggtgtggcgggtctgtgggagggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgtgctccccgcccggctactcttgagtggtccccaggctcctcctcctcccggttccacctgggagctgtggggctgtgccggggaatgcctcgctgcagctgcagctcagggagaactcactgctggagcttctgcctctcccgtgccgtggggccgagccgagctccaccagggtctggacttctgcacgggcagctgtgcttcccagggtcgtggagaggggtccttggtcccagccactgtgtgacctcgaccaggacacttgactttcctgcccccagagggtcttgtctggacctccagagcccccagccttgctcacttggctctgcttctgggcagggtgccctggcattgctgttgctggcacctgccgtgccttggaggggtctccagtgggacctctgagcacggctcttcctgtacttctcagaggtgagcagagggcatttgtgggagaactggaacctggggaggaaaaaccccaaggctggcaaagactccctgcagtctgtccagtgatccactgaggctgagtggtggaggacatggaggccggcccgggaccaggacatggaggccggccagggacctggggaagagagggcctcagtctggtgagaccagcctggtgggtgcctggggaagagagggcctcagtccggtgagaccagcctggtgggtgcctggggaagagagggcctcagtcctgtgagaccagcctggtgggtgcctggggaagagaggccctcagtccggtgaggagaccagcctggtgggtgcaggccacccttgcctgctgtcagggcctgcccttctctccggcctccagctgctttgccccagcgatcaggcgcctgagcttcctcccccgagcctgagtccagctgagctccgtgtggctttcccggtggagcagactctgtctgatttcccgacggctggcgcctccacctgcttcccaaaaccgagcaccaggggtctgagaggttgctatgggaaggtcgcttgctccagggggccctggaacagttgctaagtttaacgccctggcccaggatccacctgtcctgctgcagaccagccctgctcattcctccctctggctgtgaagatggaagcccatgggttggatgcctcgggccagggctgtcacgcaaggaagcctggggaggactgtggcactgaccccatgggccatggtatcgcctcagggccctgcccctctggattccgtctcctcggggccccgcccctctggatctcgtctcctcggcgccccgcccctctgatctcggtctcctcggcgccccgcccctctggatccccgtctcctcggcgccccgcccctctggatctccgtctcctcggggccccgcccctctggatctccgtctcctcggggctccgcccctctgatctcctgcacgcacccggcctcgcctgaaaagccccacgtacagcaaagcggccgtgtcttggtggcctctgcctggggcgctatgggtggcctgtctatgcctcagtttccccattcttgatgagagggagctggggtcgctactggtcactcgggccccaggcagaccaaggctcacttctgtccactccctggccccattcccaggaatcccaccggttcctggccggggtctggaatctgttctcccagtccaggacctaccctcccctccacttcctgcctgcaagctctgtggtccttccttgtcttgagtccagggttccctgtgctcccagtccagcctccctactcagggccgagggcaccaggaggatggtcgttgcaaaagaatatgggaggccgggtgcggcggctcacgcctgtaatcccagtacttctgggaggccaaggggggcggatgacttgaggccgtgcaacacctgccagcaccagcatttgacacggaatcgaagaaaacaggcaggacataccctgactacactagtacaagtcatcggcgtctcggggtcctgggttttagaaatcacactgtcagggagggctgatggggtcctgggttggaggctggaagtggaggaatcgaggcataggcagaaacttgaaggaagggtcagccgagctggccagaagggggctcctcgccacggtccccagggaagcactttgctcatgggccccggccctgagagaggagctcctgcctcttcccactcggagagggctgacaggagaggcttggcctggtgtttcctgatgagatagcgggcacgttccgggaagcggtgagcaggcccagcagacatcagatgtggtgcttcctgtctcctgtgaatgcgcctggcccttgaggggggtctgggatggagagtcgggggaggggaaccccactcgcccttctccttgttgttcttggcagctggacttgggcaattgtgcctccaccctctggaggggcctccccctgtgctggctgcag

SEQ ID NO: 215 - DNA, 854 bp, Homo sapiens
atggggggtcccgcgggatgggatcctccttttgggtgccgctgccgtcgcgacccagggaagtgggcagcagagctgtggggaagtgtctgcccttcgaggaagctgggaaatgagggtggtcccggcgccgtgggccgtggagcgccgtgccgtccctgcagtgacaccgaggtgctcctagccgtctgcaccagcgacttcgccgttcgaggctccatccagcaagttacccacgagcctgagcggcaggactcagccatccacctgcgcgtgagcagactctatcggcagaaaagcagggtcttcgagccggtgcccgagggtgacggccactggcaggggcgcgtcaggacgctgctggagtgtggcgtgcggccggggcatggcgacttcctcttcactggccacatgcacttcggggaggcgcggctcggctgtgccccacgcttcaaggacttccagaggatgtacagggatgcccaggagagggggctgaacccttgtgaggttggcacggactgactccgtgggccgctgcccttcctctcctgatgagtcacaggctgcggtgggcgctgcggtcctggtggggccgtgcggtgagggccgcgcgctgggagccgcgtgccctgggcccaggcctgaccctggtaccgaagctgtggacgttctcgccacactcaaccccatgagcttccagccaaggatgccctggccgattggaaatgctgtaaaatgcaaactaagttattatatttttttttggtaaaaaagaaatgtccataggaaacaaattcccgtgtcttaaaacgccttggtgtgccgtctgatactgttctctaaagacgtta

SEQ ID NO: 216 - protein, 174 aa, Homo sapiens
MGGPAGWDPPFGCRCRRDPGKWAAELWGSVCPSRKLGNEGGPGAVGRGAPCRPCSDTEVLLAVCTSDFAVRGSIQQVTHEPERQDSAIHLRVSRLYRQKSRVFEPVPEGDGHWQGRVRTLLECGVRPGHGDFLFTGHMHFGEARLGCAPRFKDFQRMYRDAQERGLNPCEVGTD

SEQ ID NO: 217 - DNA, 70215 bp, Mus musculus
  misc_feature (1)...(70215): n = A,T,C or G
ttgaggcacaaaagtggccaacagactacagcaacagagtccctgctctgccccaggcatctctgttggggctgatctggagtaactggctcagaaagcaggagggctaactagctagctagccacaggtgtgtttttaactgaaattgctcagggaggaatgtgctcttcaatcacagtttagggctggcctctgattcagcataagtcacttgccatgcaagcctgacaaccttcagtccccaaaacccacaaaaaggaagaagagaaccagcttaacagagctgtcctctgaactctctgcctgagcactgtggtgtgagcatgccccgcctatcgtagtaacaaaacagagattttgatgatgcacagtgtgtgtgtgtaacagagtgcattgtagtgttagtgtaagctctgaaacgcccctggagctgccacttccctctgtgctagtaactaggtcggtgtcttaattgggctgttttctcactcggcttggcttgcaataggtgtttcagagaaaaccaggagagcgatttgcttctgaagatgtctatgtttaagccctaacactaccccagggtattccaccttgtaaatgagaacaacattaacgtgggatggcctagaaaacagtttgctacctaggaattgtgttgtccggtggtcacaaacaaaatagaaaagccctcttatatggagatatataggtagagtgttgttttcacagttttctgtctagaccctggatgtacacacacacacctagttgcgcctttcagggaacttgagtatctatttctctgagaaatgtacttaggggaaaattgtcctagtaggtctattattctgtgatagaagtatataatatacttatctcatttctgtttttcaagagttccctgtgatcagcagctctatacctaaaagaataagccccgaacccttgtgattcagggagtaattacaatcatttgagctgaattatctcctaggagagaacatacccagttcacctctagaagcttgcgtttgtttgcttgtttttgagacagggtctctttgtagcctagactggctttgaactcagaattcaactgcctcagccccagtactgggattataaactaccacaccaggcccagaaattctctatataaaaatgctatgctgactttttagctagtccagatatcatggaaaagttatgcttgtttttataccagagaagtagtgtaaacatttcttatataaaatgctaatcatctttaatttgaaaacttctatagtgttaaatgtttttagatacatgtatgtatgtgtgtgtatgttatgtgtgtatctggatctggttgcacatgtacccttatgtgtgctagtctgccaatcagaatagttccgcctttaccacatgtggattccaggaataacactcaagttatcaggcttggcagtaagaacctttgtccgtgagccgacctgccagccctatagtgttagagttttttgttgttttaaattatttatttttatgcgtgtgggtgttttgccgcaccatgggtgtgtctggtgcctatggaggccagaagaggacatcggacctcctagaatggagttatagagagttgtgaacttccatataggtgccgggcttgaaccgggatcctcgaagaacatccttacagcgctcttaccactgagctatttgtagcccctggagtgttaggttttaagattctggcatttatgacaggctgtttggtagacaagtctcatgatagacttgctgaaaggttgtcctttttaggaacagtgcatttcgtggggaaagcatgaacagtaaataaagcagtgtagtagtaccttgacagatcacatgtgattgtaacagaaatgggttttgttgtagttgaggtcatccgaaggctggcctttgcttttctcttgtcttcagagttacggagctacattggaaacaaatttctgtccttgcttgtagttgattagcagtaacatttatactattagtccatgatgctttagtagtatgctgtaggttcacatgaattgtgttagtcctaccaaaaagagtcttccttgggagttctcttttaggaaggtacaactattttaaactcatagaaaacagggatagactattacaggaagttggtagtaggtgaacaaatccctcttaaattattaaatgcagaaggctcttttttgttttgttttgttttgttattttggttttttcgttttgttttttgttttttgttttttttttttttttggttttttcaagacagggtttctttgtatagccctggctgtcctggaactcactttgtagaccaggctggcctcgaactcagaaatcctcctgcctctgcctccctagtgctgggattaaaggcgtgcgccaccacgcccgacacagagggctctttttaaaaatatttttaatatactatttatttagctttatatgttttgccaggatgtatgtttgtatattacatatgggtctggtgtccaaggaggccaaaagagggtgtcaggtcccctgaagctgtaggcacagaggttgtgagtcaccatgtaggtgctgggacctcgaagagcatcaagtactctgcagtgacccatttctcttgccccttgaacacctagagatttaattattcctgtccttcattgtctcatgcctgttagacgcctatgaggaacagaaactcctgcaggccgtgatgtcactgccttgtatcctacttttgtgtagccccaatcctctctttgtctgctttgactgtattttattatggggcatgcataccttggaccgggcaacagtgtcagttcttccttctccctttacatgggctctgcacatcagacccaggtcgtcagcttgtgagcgagtgcctttactcaccaagccatctcttctagccaggcttccattttcatgcccttcatttctgttccactcccagctagtcccattgcttttatgggggagggggggctcctctgagcattacagctctgtgtatatctaatttgcctgttgttaatggggctctttatctcatgtttgacttgctaaatggaattatgactctcacgcagcagttgataaagacattctgatagtcacccatgtgagttatggtgactcaagtgttctcttaatgagagttattttggggatttcatggtgattcaggctggtcttggctcataatcttccttcctcagcatcctggggagctgggattgcagttatgtgccaccatgtcttggttgtgtgtctgtgttttcatgtacaacctataccagtaagcactaagttctttatggctgtcctctgcatttacagttctctttccagaggtgaacgtgttactaataagtacaaatctttcatctggatgaagtttgctcaagaagctttttctttagaactctttttggtggtgttgtccttgtatagtgtttggttgttttttggtggtattgtccttgtatagtgtttggttgtttaatgtgagggccatgaaccgtcattcagggtgggctcctcagtgaagcaggtagggcagaggagcctgagatgaagccatggcaacctatgtgggctaaaggatgtcactgacactcagcagcaccggaagtgtcctgaatgtaggtccagggagccaggtttagggagtgtgcaaagtctgcttttctctcaccccatcaccatgttctgtgtttcgtagctgctgtgcccatgcctttgtctctaaaaggtgaatgtggtgaatgtggagtggtgacagtctcatcaggacttcatgaacattaaatacagttttcaggacaaggtttctctgtgtagccctggctttcttggaacttgctctgcagtccggactggcctcagactcacagagattcttatgccttggcctcccaagtgctgggattaaatgtgtgggccaccacagcctggctaaataaattttaaaatagaaagcactttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgggtcctgcttacttgcttgctcctgtggcttgctcagccttcctttttatagaagccaggaccacttgcccagggatgggcaccaccccaatgggctgggccctccccatcagtcactaatgaagaaaatacttgcctacaacccagtcttatggaggcattttcttaatcgaggtaccttcctctcaaataactttggtttgtgtcaagttgacattaaactatccagcacaccatgttttaccagtacgaaaatatagcttggcatacagctctgaagttggaatttagcttagaatgttggttagtattgttatcccactgatacggttaataatagtgggtctccatgtggtggaaggagaggactgactctgggcagcacacttgcatgtgcagtaacaggaaataaactgtgggtccagagaggtaacggtggctccggctttctcccagtgaacctgggatggctcctatcacccacaaagtagctcagaactctactttggggagtccaatagaggattctgggctctgagggagccaagcatatatatacataatacatgcaagcaaaacactcaagcacataaaacagaaataaataaatcttaaataataaaaaaaaaaaaagcatggtgagtgaattttaaatgtgttgttctggaccagtgagctgtttggtcaggtgaggatgcttgccactaagcctgattgtctgagttcagtccccaagacccgaatgagaactacttcccacaagttgtcctctgatttccacatgcacaccatagcagtacatccatgcaaatagacacacacaaatagatagaacgtaattttaaaaattgactgttacattgcataaacatggtattaattaccatcaagctagtgttttcaagaaaagatagaaatgtagacttccatgtgaaattttttaattttctaaagctaatttaacgttatttcatgtacaagtcagataactttcaaatgctaagtatgcttttattccttaagttgagaaagaatatttttcttgcattcaaattttaaatattaagtaatcctaagagtgcatcttgtttggatccttctacattatagataatgaagtggacttagaactgtactttaggtacatcggttccttatcagtttccttatttgcaacttcactagaacatatttgcagcccccaaatcaatacctgctcacctggagagcagtaaagcagattcccagtttccatatccagctgaggtctaggaagaccacctaatcctgattctacttctcagtgtaagagagtctcagtattctgtagtactacatttttgcatgtttgtatttgttgtgacatttctctgttacaaacgacttctgaattgtgattttcctaggcacaggaaggatagacaaggtcttacagaaaactgaaagagttccacttagaatgaaggactgctggccttgagttcagtattcatgagtaaggatacttattaaatgagccatctttacagagaaatacacataaaacaaagggcttacttttggtttgagagattttagtttcgatttttctttcaaacgaggtctcaatatttagccctggctgaccttgaactcacagaggctcacctgcctctgcctcctgactgctggaattagagactcgtccctacacctgactgaaaacaaggttttctattgagtggcatgacaaaaatctgactatcagctcacaggaagctaaccctaattgtgtgtccatggtgacttatagaacataactgacacgcagggacaggtggccttgtaaagcagatgaacattcagccaagtgatcggtcttagagcagacagactaaaagaaaaagcaggacctgacagagatttctttgtttttgtttgtttgtttgttcctcttaggttattgaaacaaaaataaatcttagaataataaaaatcaatatatagtctacaatggacttatttcattttccatcaccaaaaattttttccctacctcaatatatatgtatatacaaagggatgttgtttcaaaactttgcttcttaaaatatgtaatagtgagcactgaagtttttttttttaaatcactagtgaaaatgatggtttgcccaaaacattttacaaaatatttgtttcaagacaacgttgtggggctagggagatggctcagtggttaagagcacagactgctcttccaaaggtcctgagttcaattcctagcaaccacatggtggctcacaaccatctataatgggattcaatgccatcttctggtgtgtctgaagacagcagtaatgtactcaaataaataagatttattttaaaaaagacaaggttgtatgtgtgtatgtgtgtgtacatttatgtgtgtatgtgtgtgtacttgcactaatgattgaatctacccgctaagaatgtgctttcccagagtttaggtttgtgttacctgtaaaatgaatttattatttgagggcattggttcagctgctgtcagaaaagctagtagatttaaaggagagagaagtttctttttgtcttgtaagagttcaagctggtaggcaacaggggactttacccctgagatccctgagtggtacttgccatcattgacagtattgtgctaaagaactagtgcagagtctttagttccatcaagttcccatcccaggctgagacaagttggaagaggagtgaggaacacaaagctccccttaagaatatgaccttggaattatagtctggtcagaatgtagtcacacttgatgccatgttttcagggagtctcagaaagtgttctgtgtggacagactcgcacagacttatcataactaaaaggaagtgcagctgacacaatgacacagcagggagaaacactgggagtgacagtctttaagatgacaagttctagatagaaattaagcaatttaatgctccagaaatgaaatatgtaggcctgtgtttgaacaaaaacaaacctttgtagggtttgggcataggcaatgtgtttcgtttcatttggttgtagttgtctgtagagagtagcagcgctacacttccttctaggaacatcacttctaggaacatcacttcaaggcacacagtcatcctgagtggagcaggagcccacaggctttccagcagcaaacacaggagttgcaaggctgtgtgtctcaaacacccgaatgctagtgttgtgaacatgtcttcctgtgttccttgtgaatatgtcttcctgtattccttgtgaacatgtcctcaaatttttctaaagctgttcctcttccggtatcagcagtaatagccgggggctccctacatgttcttatgtagctcaggctagccttgaactaattttgtagcctgaccttgaactcctgatgctgctgccagactcctctaagtgcgggggttacctggtatgctaccacagagggctgtgaggaaagtgtgcatttgctgcaatccaaccagaagtattattcagccactagaactaagtattcaaaaaagagaaaagttctttgtctagaatctcaatactggatgtcttgggctgagcaatggcaggaaaatactcaaataattctcaacataaccacagtcatccacctctacagaaacaaaaagagacttaaaacccacaaaagagatgaaagacaagggaggaggctgctgtgctactcgggaatactactttggcttaaattgtttaaacagaatcacaggcttcgtgttctcaagagataagtacattctttttctaacagtaaaaatttatagtaagtagaaaaaagaagtgaatcagctatttaacaaagagaaaattgtagtgtttcatttcgaagactcaataaaattatgatcattgtagttacattttaaggtagaaaatacacctgacttggagactacgcctatgtgcagttagagacatgccctgagtcctggctcctaggaaccctgcactcagcagcgcacatgactgcatggtccccacttgctaagaacagagaaagtctgagagcactgcagggaacaggaatagaatttagaggacactgtatttaaatgttgtttagatataaaaagtgtaagcctttgagtgatatactaaaaactcacttatagaattgtcaaagtaacttattaaagagcgcgtagtaagtttcgtttggatctcactgtagtcctgaccatccagaacattctgtgtagatcagctggcctcagactcacagacatctgcctgggtctgcttcccaaactctgggattaaaggcatgaaccaccacatgggccttattaccaatttttaataaaatactgagctagaaaggagtagttttaacactactactttttcagatgttttcaccaagtctagaccttaatcatttttattctctgaactgtgtcttaaatgacagaagtgataaatgttcttaatatccacctgaaaatccgtttattatttgatggttacagggcttgtctgttctgtagctctacaaagatttatttttttaggatttggggtttagatgggatatttgtcatattgaggatctaattcttcagtacaattttaaaaatacaaaattgtgggcaggcaggatggtttcattggtaaagacacttgctaccaggcctgaagacctgaattgaattcctcagacctacagggtagaaacaagtgtggttttctacagaatgtgtcccaccccccaatacacaccccatacctacctggacacatgtacacctacacacatgcacacgtacaaaataaaattattttacatacatgcttttgtttctgtgggctcatttacctactgcttatttctattgtgtgatgttctttttatgtcagtacagttaattcttttgagtaactactggggtccatcaaatatgtcacaatgtgtttgatttttcctcatttggtggacatttacccagctttattctgttgcatctagtattctgatgtttatttttaagttcaatttgaatttgaatttctgtcaattattttaaagtagaaatattctgtctttaaagattttgagacacttagaactttaaaattggaggctgcagagatggtttgggagttaagagcacttcttcccgaggatcaaggtttgattcccagcacccatatggtggctcacaactgtctaactcaagttccaggggacctgatgcccatttctgtctctgtggaccaggtcagcaagtggtactcagacacatgcagctgaaataccctctaagcactactgacctactagtgtcttctctagtttctcaactgctttgacttactgagttggcttctcatttgctccttcccacttctcaagtctttaatgaggtaaaaagatctctgtaattcaataatactacctaaataaatagaaaaaatcactttcttaaaaaaaagaaaagatttacttatttgctttatgtatgtgagtacaatgtcactgtctcagacacaccagaaaaggacatcaaatcccattacagatgattgtaagccaccatgtggttgctgggaattaaactcaggacctctggaagaacagttattgctcttaaccactgagccatctctccagcccccaaaaactcttcttcaatataccatttgctgatttttcttcaaaattaaatggtagaaatttgggagtgcacaacattgtttctttttttctctcttctactgctgttttgtttttcattgatagattcagaagctctgtgaccgcgtagcttcctctacgttactggatgaccgaagaaatgctgtacgtgcccttaaatcactctctaaggttcgtaatgctaaattactactactttgaaaaaattgattactttgcatgtgtgggtattttgtctgtatgtccgtctgtacctcttgcatgtgttgtgtttgcagaggccagaagagggcaatggagttttagatagctgcgaactgccttgtggttgctgggattcaaatccaggtcctctgaaagagcagccagtgcccttaaccactgagccatctctccagccaaattactgttttgttttgttttggtcatttttgattttgtttcttcagtcagccattagttttctgtaataacatattcttgtcttctgtgcagaaataccgcttagaagtgggaatccaagctatggaacatcttatccatgttttacaaacagatcggtaagtttcgtgtatcgaattttctttcctactttttggagttttaatttgtttttgagtagccatcatcatcccagaggatagtaacgttatgtctacatgatgttttttattcttagttgtcacttactggatacaaaccagtgggctaagccttagtttagacataaaagtagaataagagaaccagatgtggtagtgtccacatgtaaccaaagcacttgagaagtggggcaggactgtcagtatataaggtcctctgtgctgtttgtctgtttgtttttatggcagggtttctttatgttgctttggctatcctagaacttgctctgtaggcaaggctggcctcaaactcagagagatatgcctgcctctaccacctggctaaggtcgtctttgacttcctagcaagtttttggtcagtctgagctacatgtgatcctatcttggggggaaaaaaggtgatgatgtaacttaattaaaatggcttaagggctggtgagacggctcagcagttaagagtgccgactgctcttccaaaggtcctgagttcaaatcccagcaaccacatggtggctcataaccatccgtaacgaaatctgatgccctcttctggaatgtctgaagacagctacagtgtaattatatatagtaaataaataaatatttttaaaaaatggcttaagattttgatttgtattggataaatggacatactgatactcatttacataaagatatgttacagtgtgtaggtatatagacgtttccccttaggatactaaatgcacaaataagagtctgatgttaagtctggtatatctttagagagaggaactcagcttgttttaactcagtttctttttagattttatctgtactttctgttttaattacctgtgcatagaaaattctatgtcttgcctctgataaaatatgtcaagctttagttgcttgtcacacatttctactccactgagatctcatagagacctcaaattcagaatcggggttgtacagtgtttctgtacaagcataagggtctggctcagataaaagctcagtatgggagcttgctgcaggaggaaacaggtagagatcaggaactcagctgatctctagttctattcttgacccgtctttgcccacttcacctatcttttctgaacttatcccaatcaatagtatccttccattgaatcataaactagaagttgcttgctgaatttgtctgtctaggccaatgtaaaacagtagtcatgttttcagccttcattctggcactcagtatatccaacacctaaatcattttcctggtttttgcattataaagtatgaaaaagtgctttaaattttaatgatcaaagatgtagtttattgcttcacagtttcagtgctggggttgaggggtggcttaggtcaggaggcccaagagacgtgagttagctcaaagcagactagtgctggagggtctaactgagaccactgagtcacatgtgctagttagaggtctccactccacatcttgccgtctttaagcctgcttgagcaccctcatgattcatggcagttctaggagcactggagcctgtgatctgaaggagcaaggaccgagccagtacacttttacactgtagtcatcagaaatgagtgacaagttcctcaacttaaggggtggctcattaggatcccctctgagagctgtgtcagagagctttaggcattatctgaaacaccaccacctttaaactgtattgttttttggtctctgatttcttcgtaatttgcctagtttgtgtgtttcaccacttcagtgtagtataaaatccaaaatgagacttcttgtttgtttgtttgttgtatgttttctgagacaggatttctctgtgtagccctggctgtcctgggacttgctctatagaccaggctggccccaaactcagagatctgcctgcctctgcctcctgagtgctagacttataggcatatgccatgtgccaaattcagatttctcaaggcaaagaatataagctttttaaagatctgggcccgcctgtgcattgatttcatagccactcttgagtatggtccagcagctccttacttagtgatcatcctttctgcttcccacacaatggggccttgactacggtttcaaagccaacttctgtgcataatttagagtaggtagagtaacaccccaccagatgcctgcattccttatcagccaaatgtgggaagtcgtcttacatagcagaaggaactttgcagatgtaattgtgctaattgatgagaggaaattatacagattgtctaggtggactcaatgtgacctcctagtccttaaagacaggccagggaagtgagaaaggggccctggaattgtctcatgagacatacttgacccactattactgacttctggagggcctgaagagtgacaggctagtacgatagttatgcatgcctggcattattttgtattttctccctctttcttcttccttctttccttctttccttctttccttctttccttctttccttccttccttccttccttccttccttccttccttccctccctccctccctccctccctctctcccccctctctttctctttctttctccctctcccctatctttaaaaaaaaagaaagaaaaaaaaaaccaaagatttatttattttatgtatgtgagtacagtgtcgttgttgtcctggcacactccagaagaggacatcaatcccatttcagatggttgtgagccaccatgtggttgccgagaattaaactcaggacctcttggaagggcagtgttattaaccactgaaccatctctccagccctcccctcctctcccctcctctcccctcccctaccttttaatccccagggctcctggggactggagacatggcttggtggttaagagcactgactgctcttccaaaggtcctgagttcaaatcccagcaaccacatgggggctcacaaccannnnnnnnnnnnnnnnnnnntttttgtttttagtttgttggtttggtttggtttttttgttttggtttattttgatttttgagacagggtttctctctgtaacccttgaactcactctgtataccaggtcagcctcaagctcagagatccacctgcctctgcctccctagtgtgccaccaccacctggctgttttgaacttttcaagtataaatcttagaccttttaaggaaattctcttccaagtattttatttattctcatcattagaattgtttaaataaaattgttttcttattttttaattatttgattttgcaagttgaatttttattctgtgactgttcaatttgctcactagctctagtaattcttagtgaattctgtgtccaagatacactactgcccgctcaatatggtgtaacaagatgcagtaagactaggcccaaaccctcgtattaaggatggacacagtgagggggctagagagatggctcagcagttaagagcaccgactgctcttccagaggtcccaagttcaattcccagcaaccacatggtgcctcacaaccatctggtaacgggatccaatgccctcttctgatgtgtctgaagacagcaatagagtactcacatacattaaataaataaatcttaaaaaaacaaacaaaaaggatgggcacagcgacccggtaggaggaaaggggccccaactgcaggcaaaaatgaccgtgattccccactccccactcttaggagtcccacaagaacaccaagctacacacctttaaggaatatgcccaggacctacctcagacctatacagggtccatgtttgcttcattcttgattctgtgggccatgttctctctggttcctactgtatggactcgatgaaatgaaaccataagctgtttgacgtgggtgctggggattcagagtcaagtccttgtgctacaggggaagtgttccttcccaccgggccgtctcctcagcaccagttggcttgtatttttgtaactgtagcttctatttccgtgttggctgaaggtacaagggtcctgctgttgtcttcttacttgagaggggaacattctcccttcactggtagtgcagttacaggacctttgtgtcttgttggagccctgaggatttttttttttttaatttattgttataagtaagtagctgtcttcacacaccccagaagagggcatcagatcttattacagatggttgtgagccaccatgtggttgctgggatttgaactcaggacctttggaagagcagtcagtgctcttaaccaccaagccatgtctccagtccccaggagccctggggattaacagctgagtctcacacatgccatcaggatgccccaccactgagctgggatttcttgtgggtatcttggttaaagaaggtctctggtgtttgtgtttctcaatcatttttttaagacctgtttcaaaatttccaaaagcaaagctgtgagtaattggtgtaaaagcccacttgcctcagtctccccatgctctgacagcccttaggcgtgttacctcacccttgctttctctgtccttctcatgtgtgctgactctcttgtgacagtctcatttgtctggatgctctcctctatgagcaggaaaatcatacatatttatgaatgtacatgaacataaaattactggcatttttgtttgctagttttaaagttagacttatttttataaatatgatattttaacaaacatacatatacacatacatgtaaatatacatacatatgttttgctacacagaattattgtcttatttctaaactttattatttgtgaacatgggtgtcgtgcctgcatgtgtctgtgcaccatgggcacacctggtgctcatggaggtcatctcagtcgtggggagactgagactggaattacagtcaagagctaccacatggcaactgggaattaagaaacggccagtgacattaactgctaaactatctcctcagccccgtgtctgtccatttttaaacttagttttttctacttgatattttattaatatttaactataatgctattgtattttcttttaagatacattttcattgctgtcttatgtatgctattttttaattagacagtcaagtggagtctcaatttgtgtaatctaaacaaatcttactatagtctcttattttaatttaatttcttattgttactgttaggatgatgatgatgaggttgatgggggggggggaaggggaagaggaggaggaagaaggaagaagaggaaagtctcactctgtaacccggtctgggactgagcgcgtagtccaggctagtctaggacttgctgccaccccctgtggctcccaaaactgagattacaagcatgagccacttccgggctttgctaatactttcttagattaaggttctagggaaaaaggaatactttattggtcttatgaaagaactgccgaaaaatgtccataatagtttgaactccagccagcagtgtgtaaatataataatttctttttttctagttcggattctgaaataatagcatatgctttggacacactttataatataatatctaatgacgaagaggaagaactaggtaagtttccagtcattttactgtatttctctttgtaaattaactaggttatataaatgttgctttgaaattgagtttattttataaacttgttcattgtgtggtgttttcctaagttgctctctgaatcaacacagtaaagctctaactttagtcctgaatgctgtctccaggacgattgctcactgtgctctggaccattgtgacgagatggagtgaggttttctgtccttaaatcagggactcactatgtagcctggactatctaagctcagtttcctccctcagcacacatcaacaagcctcacctatattattcttacttttacatttttgtttcttagtgaacttacaaggtattagatatcctgacattttcaaatgaaatatgtttcagtagattctccttcaccctccttcatccaccccagatcctctgtctttgtctctctccgtccctctcttttttttttttgttttttgttttttgttttttgttttttgttaggtagctctggctgtcctagaactcgctatgtagactaggctggcctcttagagatcagcttgtctttgtcttctgtgtgctgtggttgaagcagcgccctgccacacccaggagagagagccccctttcttaagtttctccctctttgggctgtgttaggcaggataggtaccagccagtgctgagttaaataatcccctctggttgttggtctttgtatgtgctattgccattatgttagagcagcagttaggggatgtttctcctaatacttaagcctggggcagtggggctaagaccttgttaatatataaagagtaacaatttgtaaaatttagggagttttttatttagttttattctgttctcaatatgaagatattcatatttgatatgaaataaatgtttgaaatccactctttccttggtatgacctcctttccctttctatttcaacatactggatacttagagtacgacagcttgccctttgctttgttacttggcgactgtctgtgcctgtgttgtatgtcctgtcaaaagatgctcactgagtaacactgcacagtgccgtggaggctgtccacacagccactgctacttacagaagacgttagtggggcgtccattactttacagaaaagagcagactcattcgtgtgttttataattctaattaataccaaaatacaacagaacagattttaaataagtattgaccttgcacctactttattaacagttaagcagaaaagcatgttatgttagccccacagagtaggtaggtagtgtgagtgaaatgaagtgttgaatagtcacgctcccatggaattaaatatacttttctaaacattttatgtctctgtgacatctcacttagaagcttattaatttctaaggggtacatatatttagaaaacaatttattactcatggaaaaagaagttgaacacggagccacttaaatacacgcacaagaatgtgctttgaagagacagaagtatatttacttctccctagttggttttcagataagaaaattagaagcaacacacctttctgctgttgtctgagcaggggtctctctgtgtcgtcctagctgtcctggaatttgctctatagaccaggttggtttcaaactcggatcttcatgcctctgcctcccaagtgctgggaataaaggcccagccacacaacatacttatttaaaaaaaatggttttaaaacattagtttcttatatcttaggcagtcaagggagggcagtcttgtgtgtatttgggatttttatgtttttttgtttgtttgtttgttttttgtttttttgagacagggtttctctgtgtagccctggctgtcctggaactcactttgtagaccaggctggcctcgaactcagaaatccgcctgcctctgcctcccaagtgctgggattaaaggcgtgcgctaccacgcccggctgggatttttatgttttgtttacttgcatttttgagacagggcttcactgtgtagctcaggcatgaactcagcacagagcccaagctggccttgcagccaggctttacctttggcttcctaggattataggccggagccgtggagcctgcttctctgctctttatttttaattcatcattcaaaaggctattttttaatgatttatttattttacgtatatgagtataccattgctgtcttcagacacaccagaagagggcatcagactccattgcagaaggttgtgagctaccatgtggctgctgggatttgaactcaggacttctggaagagcagtcagtgctcttaaccactgagccatctctccagccccaaaagtcttttgataatataggaaaacagcttttgaataagaataaatagtagcataataatttttagggcctttttcttctgaagtgtcagttaatctgagtaaattttttaaaacgatatttaaaaatgtgttcttggactacagtgtactcatatacataaaataaaataaatctttattgtattattagtatcttctaattgatgcttcattgtgaggcaattctccagtgacccaaaaactatttagagttctctcccttgagaatgtgtgtttgtttttgtttggttggttgnnnnnnnnnnnnnnnnnnnntcactttgtagtccaggctggcctcgaactcagaaatctgcctcccaagtgctaggattaaaggcgtgctataacccttcagtgatgaatctgtgtgaatcttcagtgtttagcctatatatttaatgtatagctctgtgctggacgagcctcacctgtgtaagtcaagtgagggaatctcattttctgagtcctgctgcttacttgccagctccttcgttcacacagatacagtttgctctgtcacctactttctatttattcatttttgtctacctttcagaagatgttgaaggtaaaaagttttcattttcatatgcgtgatgctttagacataagacctggtagtataaacggacactgtcaaatgctgtttcttctagctgctaaaaagtctgaagttggtttcattgtattggaatctctaatttaaaagccatacttattaatctgttatccacactatgaggccattctagtgtttcttttaataaaatcaaatttcctctggcagttccatttattcaaatttgtatataattcctggaaaacaaattgtttatttacaagtaatacttgaatatgtatacacatgtgtgcatacatatttacttatgagtgagctggaaattactcagttcagagaatatgtattctcttgtatagaccagcctggcctagaacttgtagttagtctcccatctctgccttttgtgtgctaaaattgcaggcatatgcctccatgttctgctttttatacagcaatcctttagattgtgaacttgatagggaattctttcaaaggtcccatagtgttttataacatagtgttttttatacctctagaaaacatacatctacaaatatactttaagaacaaatatatttgtatgaatttagttagaagacagttctataaatagatctggaaagtggtagggtatgtatgtatgttttattgtatatatgaagtatgtgtatgtatttaaatataaatttatgtacacacacacacacacaccacaaaaatccttaaagattagtctttgctataacaatagatcattttccccacttacattaggaaatacttatttttacaggttagagaaatttgcccataatactttaagctaagattacagagagaagctcagctatgatataagtataccagatcaacaagatggttcgtctcatgcttttgcctatatgtatactagattttgttctgttttggtgaggcagcgtctttctatatagctctggctgtcctggaacttactatgtagacctggctggcctagcactcatatatctgcctgcctctgcctctgcctctcaagagcaccaccacgtccagctagataaaaatttcttatgagtgtagttttcttgataactttaaatatgaataattgaatagttttaacagttttaccttactgtaccactgaaaacgttgtgtgctattacttagttagtttgaaagcactgcattaaagcatagaagtgctggcgctggagagatggctcagtgcttcagaacactggctgctcttccagaggacgtcaggctcattctcagcccccaaatggtggcttacggccttctgtaactctagtcccaggggatcttatactctcttttggcctctgcaggcactgtatgcatgtggtgctcacacatacatgcagagaaaatacctatgcacataaaataaaaacaaatagaccgttaaagtttggaagtactgccttaggactgtgactttttaaaattgatggttgccttggttgtttttgtcaagttgatgcaatcctagacctagctaggaagagtgaacttaattgagaaaatggctccataacttggcctaagggcaagagtgtgagtgattggtataattcctgcttggtgattggtgtgggagagcccagccattgtaggtcccattcccgggcaggcgatcctggttgtataagaaagcacgttgaggccgggagtggtggcacacgcctttaatcccagcactcgggaggcagaggcaggccgatttctgagttcaaggccagcctggtctacaaagtgagttccaggacagctagggctacacagacacagagaaaccctgtctcaaaaaaccaaaaaagaaagcaggttgagcaagccagtaaacagtggtctgtcatggactctgcttcagttcctgcttccaggttcttgccttgaattcctgccttgacttacattcatgctggacgacaatttaaagctaaaatgacccctttctcctcagttactgtggtcatagtgatttttcatggcggcagcaacccgagcgaggacagaagtcttagatcaagttgtgtcccactagctcagctcaaaatagccaaaatagtcataagctacagtattttatatactataggtaacaataaatcataatgtcataaaaatgtttcttgataggttattctcttatttttggtgcaagtattgaattaacctcccccctttttatatatctatctatctctacatatagatagatatttatgtatgcatataagtctaaagtagataaataaagaggcctgcaaattcccacgaggaaggtaagtggtgaggagctgctaaccctttgtcagacacaccttgcttcaccagatgcatatcaccatgctccactgaacactattttgaaaaacttaccaaggctaaaactatacattagttatttgtaattaactacataaaaatatttcaacattaaaaaaatatagggggtgctgatgagatggctcagcagttaagagcactgactgctcttcctaaggtcctgagttcaaatccaagcaaccacatggtggctcacaagcatctgtaatgagatctgatgccctcttctggtgtgtctgaagacagctacagtgtacttacatataacaaaaaataaatcttaaaaaaaaaaaatgtaggggctagagcaggggttaagagcatttgttacttttgtggaggacccagatttggttcccagtgctcacatgactgttcacagccatccattactctagtttcaaggcacacatatgcatgcatacatgcaggcagagcacttacttacactgtaacttaacaaaaacattatacagtgactttatcaaattagtacttttttcctgttttctttaactagtttacttagttgtttgtttctttgtttttaaatgtgtatgcgttttttgcctgcatgtatgtctatatatcacttacgcctggtgtttacagaggccagaaaagggcataggatgccttggagctggagttgagacatttctgagcccacatgtgcatgcttggaattgaattcatgagctagtgctcttaaccaatgaaccgtctctgcagccctaatatgcaactctttaagtcctttctcttagtgggtggatattgagttgcttctaattcaggactactgaaatttgattaggtccatttctacgaacttttaaataatttagcatttgtgtatgttttattctactataacaaacaccatgatcagaagcaactttggggattaaagggtttatttggccttcacttccatctcacagtctattgttgaaggaagtcagggtaggaagttgaagcggaaatcatggaggaatatgccttactggctactcgcaggcttgtacttggccagctttctgatacaccccaggactgcctgctcagggattagtgccaagcatgggggctgagctctcctgtcactgaggctacaccttcaccagggactctcttgacctctcctcacagtgccaggtttcagctgctctctaagacactcctccaaccccactcccatctttcacctatcgagccttcaaaaccagtaccacaaaggcactcttagaccttgctgagttcaagtgtcagcttgagatacaggcttggcccccttggaccacaggttctgtgtataaccctagggaaagactttgctgttgtcccagtgaagcacagagatttctccttagtgaagcagatctcttaccaattgcagctgacttttcagccgtagccagttagcatcccattgccccagtgaacctatctgtagctaatcatagctaattcttcagtcccaacagaccagtaagtatacacaggttcttttttcttggggggagtatatgtattatatctgaatgaatgttttgcctgcatgcttgcatgcctaccatgtgttcccctgatgtccatgcaggtgagaagagtacatcgggtccctcaaacttgggctctggagttatggatagtttaggccaccgtctgggtgctaggaactgaacccaggagtctttgctcctctttgaaaccccataagccaggcctccattgtctgtgtttctttcaagcttcctcaagaatgaatgccttgttgagtgttggatgacttttctaactcagagttccagaacctccacagtcctccaacaaaaggcacaaaagccacacggttagctttattccagcaccccactcctagtattaatttttgttctagtttcattcagttgctgtgacaaactcaaggccatcatcttgccttagccccatgagtgccgggagtacaggcaccactgccacttaggcctgtgcaattttaatcattttatacctaacattgtaaagaaattcagtgtttaattctgcttctatggccaaatacttgtctaggttctatataaaaacaatactggttgatctgaaggtgattgacttaattttataatcaaactgtactgataggtacaaatcagcagagactgccattttgaggtgtactgacttggagtataattaacgtaaaatacagtttgctcatagacgttgtatagtcttacaagtttcaacaaaagagttcagtagtggttgatgggatgtggcactgtggttaagcgctttcctgccataaagcaagccctgagtccaaacccctgcactgaaaaacaaaatcatataacctctaccacaatcaagacaatatttctgttgccctaaacaaacgtcttatcctaataaaagtttagccttacgtttttacggaaatgtgatgcccaactgaccttgaaagtgagtttacaaatacagtttcaatcttaattgcattactgatcccagccgtactgttgaattgtttatattccaggaaaattaccatttctgtttaactcgtcagtgaaaggacactttaacatagcatcatgttgaagtactttgttctttgaatattacagaagaaaattctacaagacagagtgaggatttgggaagccagtttacagaaattttcattaagcagccagaaaatgtcactctcctgttatctttgttggaggtaaatagggctccttgccatcctgtcacgctaatcggctgctttccttgcctttgtgggtggtacttcctgcacacttgaccagggagtgagggaagtttgctctatagcatgcttttgaatgcatgggaaggattcacatactcgatagagaaaataagtgatctattaaaataatagcatcctatttctagttttacaaagtatttatcattaacattttagtgagtttactcaattaacattaacttttcatttcttaaaattcatttttaaagttcactgaaattctgtttttctcttgtagtttcttattgcactattagttgaaaacaatgttttccttgaaaatagcaattctagttgctaaacagctgaaattcttccattgcaggagtttgatttccacgtccgttggcctggcgtgagactcctgacttctcttttaaagcagctagggcctcccgtgcagcagatcatcctagtcagccccatgggtaagcggctcccctgaggagctctgaggccaaagtaagggtcgctgccaggactgaagcagtgacctggtaaattgtaacttaaatcaccattcgtgtgtttggtttgcctgtaatgatgtttctgttcttatggttgtatgttctaggtgtttcaagattaatggacttactagcagattccagagaaattatacgcaacgatgtaagttgatttggaaaggagagagcttgatgcttattttccctttttgcgaatataccttcatgagttacggaaagtgcctttgggaaaggtggatgttggccaacttttaaactcacgtgtgaggcgtattacttcttcgtcttgtgcttagcaagtatttagttagacaaaccactttgttattcaaatttactacttctgtatgtttaggctttcttccatggtcttctgaaatgttgacatagaattctacctcagaaattgtctttcttcctacagtaaacattctgagacatgaaacggtataagtttacaatacggtgcacgtggcttcctcttccttatttcattgaatatgtgtgcagaggattttcattgataatctctttatgcagactgtcactcttctgtagtcattctctattctgatactttcttggatccttgcttatgattttgaactttgtaacaggttaatgcaaagcagaaacagaaccaaaccaaaccctcgacctgtgatccatgtaatacatgttctaacttcacatttaaaacttggtttttgtgaggctagagagatggcggctctgaagctaggagtgcttgctgctcagttcccagtaccacctggcagctcacaactctctgtaagtccagttctaggacatccaacccctcttctgctctcagcaggcaccagccacgtacatagtgcacatacatagaatcaaagaagcgctcgtgcacctaagataaaaataaagctgggcgtggtggtgcacgcctttaatcccagcactcgggaggcagaggcaggtagatttctgagttgaggccagcctggtctacagagtgagttccaggacagccaggactacacagagaaaccctgtctcgaaaaacaaaaaaacagaacaaaaatctgaaagttttaaatgttgtagtatctatggcaaagcaatattatagatagtaaaatgctataacaatataacttacagaaacaaatctttattttatatttaaattattttacatttgtttttacaaatgcctacctcggttctttcatttctttcctagagcatatatactctttgtacaaattaaaatgattacattttcatgcaagcttatcaggtactttgatctgtcccacccagcaccccctgctgtcccaccccaccatgtgttcagtctattttctttagctcttggctctttcttctaactttttgcctcggtttttatttgaagcagatgaaatgattgtccatgttttcttttattaattttattaatggagcttaagttttatttttgttgtaacctctgatatcttagttttatatgttttataggtttttttttttttttagtttcagctaacctatcagcaaagtaagaggaaaataaactactaataaatgttgatattgaaaacaggtaaaccctgtaggtgctgttttcccgccttctaaatggcatgacatctaggtgtggtagaacatgcctttagcccccagcactctggggacagaagcaggggatctgcgggagtttgaggccagtctagtgtgtatagagtgttccatgggaatagtgtggcagagggatccgagatactgttattctactttgcagataagtattctgagacatggaatttgtgcactttgcttaaagtcatacaactagtaagtagggcatttagcttctgtccactttatgagactcagagtttgtatgacttgtgtaaacctttctttttccttttaggcagttaaaattcaagttggcaccattatgttggcagatttgacatttaaattttattttacctttctttcatgttagtattaaaatttgaaaatccggggaaggggtgagatgaggccagcgagttgacagccttcttaaccttgtacagacgcttagctgccacctgccaccgtggcactcccatccctgtgtggcaagcctctgaaagcggcggctgtgcttttccccttcatgtatttattgtctcttttatctgtggtcactgagcggctcagaaggactggctgagtgatagatgctgaagtaggaagtgaggagtagggctggagcggtggctgagcagggcagagcatggctgctctcccagaggagctggattcatccccagcacccgcgtgttagctctcagctgtctgtaaccccagttccagggatcctgtgccctctcatggcctccacaggcactaggcttgcaagtggtgtacaggcatacacacaggcaaaacactatacacagagagacgagtaataaggagtaatgtaagctttttaagtgataagtgccaaagctatataaacagctcaatacactgaaaaaaactgaaagccagggcacagacttagttaacctttgtttgtttgtttgtttgtttatctgttctgtaggtttatctgacattcagagcttaggtttcatccacactgactagattttgaaatgtgtaaacagggtcataggttatcatgacacactatgggatatttcttattcctttggcccagacagcttagttgttatctgtgcacagtccccatgtgcatctggaggctccctacacacacctggagccccatctcctccatgacacatccagatttcgggtgcctgtggcatgcttcttgaggcctactctgtgactgcctgggaatgtcagtggtgcactcctggatcacacctttttggtggcaggacatccagtcttcttgccacccttctttgtgggagccatttttgccagccacaggccggaaaagactgtgggagaaaaaccatgctacacgaaccttctgcaaactttcttacagggtgtgaatttccatttcttgtttttgctgatttaaaatcaaattgtaggaatttgggagcctgattttcaaggtatcctgaactctgtagaaattctgttaaaatgtggtggtggtatttcatgatttatatcatcattttgagaagagtaaatatgagaactttataatccttctcggcttgtggaaattacatggtgacagataagagtgagaattgtgttcttactgtatgtagctaagaagaaacttgttagatgtaactcttgccaaggtcctgttcctatgtgacctatgaccgtcaggggagctgaaccgtctctgccgtctatgtccttctgtatatagagagcaaagcaggtggatttgtaaagccctgtttactgtaggattctatgattttaaagtaatttttgggagtccaataaatttcatactcaactgaatgccacctttcttttctataagggcgtcttactactgcaggcattaacaaggagcaatggagcaatccagaaaattgttgcttttgaaaatgcttttgagcgactgctggacattattacagaggaggggaacagtgacggaggtaagagtgagaccgtgcagactgctgtgtagtcactcaccatgtcttacagcagcacacacgcccctcttcccagccgaatcgattcccgggatcaaatgtccgtgtgaaactcagattttcacagattccagtcttttccagggaggggacctggaaatgtcagtgcgacaggagtccttagcaaattatctccccagtagaggaaatgaagagctgtgaacagctaggtagagaagaaaggcaggagtctgttcgccttgtgagtgcactgtgtcagagacagatgagcacattcacgtcttcagagtcagaatgtattgatgacaactgccagggcattgtcatttcagaggcagcaacttccagatgctcccactctgccaaggaggttcttttattgaagttctaattactaatattaactcacagatcatacagaacataaatgtatagactcagtaaatgtgtagactacaagagctaagggacgacagcagagttagaggtctcggaggccagggaaagggagagagcacagagtctgtatgcacatgaaaatcagccaagctgagcttctcagagagctgcagaagtcacagctgctccagggactagtctgtgcctcgtggtagacttacaaagctgatgctgttcacctgtctcttgggggcagcgtccccttccagcctcaaaactgagtccaacgctgctttaaaatgaagtctcttgggacaaggcacagctgttctttacagcatggaggaacttaaggcaggagcaaacttgatctcaaacatttcaacgctatcaatatgttatcggtggctctagttggcatcaatttgtgatcattttgccttggcctccagctgctgggattacaggtgttcgtcctgaagacaggttagaagagaaagcgctaaagagagaggaagttgtttggttgacagcttaaaagtctcaggaggaataaagcagaaaagttgaccattctggagccaagcttgctttcctttgaggttaaagattttagttgaaccaggtgtggtggtataccagcactctgggcagaggtaagtagatctctgtgagtgaggacagcctggtctacagagcaagttccagctacacgttagagaccctgcctcaaagcaaacaaaaaaatagttttcataaaattcttatgttttcaaacctttattatgtcaatttatatacttagtaaataaccattggaaatagcatggttaagtttgcaaacaaagcagcaggttcttagataatggttccaaaatcatgggccttaggaggaaaagctgatgaatgggactttattaacattggaaagttgtattctacaaaagatactgttaggagaatgtggtagtggcatggactgcgagaaaaatattctaaaacttatatctgaaaaaagacttaaaaatttaatagtaaaaaagaaaaagcaaattaaaaaataggcaaaaggtctgaacacactcttcagtaaagcagataccatagtttgcagtagcattcaaataaatgctcaacattacatgattaggcagttgtaataggagcagtgagacgccactacatagcaatgcaacagggaaatccacaccaccaactctactagatgctgctgaggggatggacagacaggaatgcgttgggcgcagccgtgtggaaggcactgcaatgtcttacaaagctaaacatcctacggcgaggtctaatagtattaccgtttcatatttatccagattacattaaaacctatatccacacaaaaaatgatgcttgaatgttcatagctgctttattcacattgctaaaacgtggaagcaaccaggatgtcctgaggaggtgaatgggtacacgctaatgggttcctaagatgagacactgctcagcggtgagaggaatggccaagctacagaggggcgacgggaagcctgagcacgtgctgctgagtgatgccctgacgcagctttctaagaagagactgcagaggcaggacaaagtgtttgcagctattgggggtttggatagggacgggataggtaggggggtttggagtgatgagactattctgtttggtactatactggtaaatacacagattctatatttgtcagaactcagtgctttgcagggtgagagtgaactgtgatcttccgtgttagatcatcctttgtaacaaacgcaccacactagagcaggatgacaatgaggggatttaggggagggtagaaggtaggagcgatagtatcctgttttctgtaactataagcagttatttagattgcttttcacattttttaatttagtgtgtagggaccagaagacagtttgcagttgtcgctctccttccaccatgagagtcttggggattgaactcaggtcatcagggttgtcagcgagtgattcaccccactgaacataaatcttgtaagactaaaagtgtgcgtacttggacctagagctatgagtgctttgagcactgtactcagaggaagtgggagctggtggttggtctagacttagaggtcaatgggaaggatttcattgtgatgataacagaaggtgtagtgtgggtgaaactgcccaggacagtgatgtttgtaattaaagacatagaagaagaatgaagcgggaggacagggacatgaaggagaggactttcagagaagaggcagacactgtcagatgggtaaggactgatagatggtcaggcagtaaatgtttagtgctttgctactttgtatatagctgaagtctctgttcttgtgtctgccaggactgcagagttaagtaggacattgacaaactcatgtgcttgtgcattacagtctagtggagaggacaagcttctagaagcagtctaacctaatcacggggtcttgatcatcaccactgaaaacctgctatctcagtttgcatgtgaatatgaaaggtggctactgtagtgactgagaaagagtgcagactcaggcacaaggtggcagctcagaacaggctgggccatgctgactgactgtggaaatggacacttgaggacactggttgagttttgtcagatgttgccagcctcaatgcctcctttttatgttctttccccaggtatagtagtggaagattgtttgattttacttcaaaacttgttaaaaaccaacaattccaatcaaaacttttttaaagaaggctcttatattcaacgcatgaaaccttggtttgaagttggagaggaaaactctggttggtcagcacagaaagtgaccaatctacatttaatgctccaggtatgcgctcctcagacatcatgctgaaagcatcttgtcagggattcttcccacaaaagttaaattgcttcagttttcaacccagggttttcagttgtttttagaggcagtaaaaagccccagtatagactcagtgagtctactgtggtatataagggcattcgttacatttattatatgttagtgtctgtgcttgagcatgtatgtcacacacgtcatgtgtgtggcgggccaccatgtagggtaattttatttcattttcatcaaactcaggttattaggtgctctttcccactggctgccataaggacatttggaaaaagtatatattaaatatcaatcacatgcgtgccctatactgccccactctcccttcttcacctctcccctcagttctcctgtttctatgtcatccatacttacacatgcctcaggatttatgtaaaaatctaaaaaccacagatggcaaaaagtgatgacatttgttttttctgtgactggcctgttcatttagtaggattctctctagttgcatttgctttcctgcaaacgaccttttgttttaaatatttattttattttcatttatatctatatgtatctgggtgaatgtatgccacgtatgcgtggtacccacgaaggccagagtagagtgttggagatcctggacctggagtcaacatgtagtcacgactaccataaactcttgttggagcccgtgttggttctgtaacttagctgttgtgaatgcagtagacactgatgtggacatgtatgtgtcttaggtcggcttggagtcctttggacctggagcagtgcatctatggtatgacttagagtaccatgtaaacaagattttgaggggctggagagatgactcagtggttaaaaacacttgctgctcttccagaagagccaggcttggctccattatttgtatttggaggctccatctgtttgtaattccagtttcaagggatcagacgtccttttctgacctcttcacacaccaacacacacatggcccatcattcagactcctccctcctccccctccctctttccccatagaataaaatagggcttggggattaactcagaggtagagaacttgcctaggaagcacaaagctctgggttgggtcctcagaaccaagaaaacatttgaaaaataaataaagtttgaaggataatttatcttaacatcatccctctctgacataggtcctattattctcagtttacataacactgagagagagagaaagagagagagagagagagagagagagagagagagagtgttagttagtttttgaagaaagtgtcagtttaaaaagtatatcactgtccaaaaaattaatgtagtatatcatgtaaacagaaatgcaatattatagttctatgtattatgcatacactacatatgtgtatattctaaactatgtgttatatactataggtatatgtaggctcattgcagggttttgtttttttaaatacttatttattttatatatatgagtacactgtagctgtcttcagacacaccagaagaggacattggatcccattatagatggttgtgagccaccatannnnnnnnnnnnnnnnnnnnnnnnnnnnnnnnnnntttgataataaataaatctttgggctgagcaagcagagcagaagttcaattcccaataaccacatgatggctcacaaccatctgtacagctacagtgtactcatatacataaaataaataaataaatcttttaaaaaatggctaaacctgttttgcctcccttactgaaaatatccctttcttatgcttagtgaagactatgaagtctgcagaaaaggaaatgagatccattcatcttatgattttctctacgtcagagatggagaggttgacttctgactttgtagccacagttgatgttgttagagtggctgcagactctctctgcagttgtagttaggtttgcttatctctcagattctccgttagctctgaatggaagtgtgttgttgcttctatttggatacatgaatcctgtagtattcctcaaccattgaaaactgaaattatcctcgggagaaggaggtcagagatcttcctctaagttaggcctcattttttagtctttgtttggaggtacggtcgctgtgaggccctggcctgactttgcatcctgagtgctgggaaggtgtgctataccacacctaaggaaacatcacttttcaaagctgctttactctgccctctccaaagtcctctctgtcaggaaacagaatctctgccatggcccggctccagtgatacagttgttttagtcggttatttctgtactataaagtcatggatgacactggtccagcactttcattacctaagtattatcatcagtactgtattatgtatacactatttttggatataaaacatggctagtttgtataatataagccatatcttaggatattttgaagatttaactgggcctaattagttgtttctgaaatttcgtgttcagcttcagagtaatcatggaatcatagggatttggttaatgagaccagcgcccacccagtgcatgagtcttctgtcaggcctccagctgttagctgtagcctctctttatttgcagtgttagtggaattcatcataattcaggctaggctgcttttagactcattctgctattagatcatactaatacttctcagagaagcttgccatcctgtatcttaattcagttttgtattgaataagccttattttgtaaatactgtgtttattatttgagtacagaaacgactaaggcagatgctactgtaagagttcagatcacctgagtgggctaacgttaagcaggcagcagaatgtcttgtgtactctcactggtgccgtagagtaagaagggacggcacttagctctgatgagcacgtaagggagagctccacacaggcggctttgttcgcacgcatcagctttgtctcagcctttatggatcatactgagacggcctcgtccaagtaggctcggactcctactcctcctgcctccaccaccgtgtgctaggattgcaggtgtgctccgccatgcccttctacaaatctttaaagacaaattgtattctcttcacagcttgtgcgggtactggtatctcccaccaaccctcccggtgctaccagtagctgccagaaggccatgttccagtgtgggctactccagcagctttgcactatcctgatggctactgggattcctgctgatatcctgacagaggtaaatgaaaaggccactctggagaaattgggactccttggaactaggcattagcagaggaaaaatatgatagctagccatttttctgataacttcctcactcactgcataataatgacagtgttagttctaaaagacatagtctttcctcaagtttcataatattcaatgttaaccttagctcatcatctggaaatgttcttcattaattttattggaaatatttaactgaaatacatagttcttgaaattataatattgtaatcttattttcccctttcctttcctccctccaaacatgacttttcttttctttcttttttttttttaagatttatttatttattatatgtaagttacactgtagatatcttcagacactccaaaagatggagtcagatcttgttatggatggttgtgagccaccatgtggttgctgggaattgaacttaggaccttggaagagcagtcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttgtatacataataaacaaatcttttttaaaatttcaaaaaaaaagtaaataaaagaaaagaaaggcatatcctatggcctgtgcaccttcgacagtgttcttaaaaatgaacacaaagatttgaacctcttgatttgcatgattttatggcatttttggaatcaagagagtagcaaaccaccttgagttatttcagaccattacaggagcaatttacaggttaaatcttttgtttttgtttttgtttttgtttttttttggtttttcaagtgtagctctggctgtcctggaactcactttgtagactaggttggccttgaatttagaaatccacctgcctgcctctgcctcccaagtgtgggattaaaggcatgcgccatcacgcctggctgatcctggtgtttttttgtttttgctttgaatatttatttatttatttatttatttatttatttatttattatatgtaagtacactgtagctgtcttcaaactcaccagaaaaggttgtcagatctcattacagatggttgtgagccaccatgtggttgcctcagcaccttcggaagagcagtcagtgctcttaaccgctgagccatctcaccagcccctacaggattaatcttaagaacaaatttatttagtctccctctcaacaggaagactcacagaatagtaaatttttgcctctaatttatggcattttttgtttcttatctataggaataatgaagtaagttcacagaaatatagatactttgaattatttttattgggctggcaagaagcatcagtaaagatgctactgccaaaccttggagataaattggatcccaaggacagagagaaccctgtcccacaagttgtcgtgtgatctccatatatgcatcatggcacatgcatgcaggcataaacaaacaaataaatgtaataaaattttaagtaagttataacttgtcagttaatatatacacattaaaagtgcaaataacagcaaaggttttagaacaaaccagctggttttagtcacatttgtctctcctttaagtcaaccctcaagcccccaggccccctaacacacaactctcttccttcacttcttcctggcgtgctaggatgattgtatggaatgtatgtttaaactaatgggatttatatgtaaatacaacatttgtgaggcaggctagccttgaactccaggtagtactcctgcctcagctttctgagtgctgaggctgcaggcacaagccactgctcgtggctgaggcttatgcattaatgtgtacaccagcactgctcctgctcagccaagcagtactgtgtctggtgggagaggacatagtgtgtgtccagctctcacgtgagccatgactgccttctttttcattgtgtagctctgtataactgtatatcctatactctgctcagcacagcacgccccactctagtcttggaaacccaccctccatcctcctgctccatctgagctgtagctcagctctggtcctgggacttccttccgccattctcctgggatctctcctgcacgctctcttgatttgaattcctttctttcctctatttctccattctttagctcattttactaagtttcctaaaagatgattatcaccaaaataggcgttttgttgttgttgttttatacatgaaaatattattcccttccttccggattactgtttggctaggtatggaactcaggattgaaatcactgtcactcaactttcgggacattctgttattactttgaagaaataacttcaaagtggtcagtttgaattgtaattttcccttagtgaaacccgctgtttctcttcagaacatgttgggatcctttctttaattctagttttctgaaaacgactttatgggtctcaccccctcccctcagctaaaggagtgagtgctcttccttgttcgcttctctgctgttctcaaatctctgaagctaagaatagctttagccaggtgttggtggcacacgtctttatatcctagcacttgggaggaggacactggcagatctctgtgatttcaaggccaggctgatctacagagtgagttcaggacagccaggaggactacacagggaactctgtctagatagaacaaatgaaacaaacaaaaacaaaaagcaagctgtaacgttttcttctttggaaaacagattctcacttttaacttactctccatgtggtcctttgtttttctttcttgacagaccataaatactgtatcagaggttatccgaggctgccaagtaaaccaagactactttgcttctgtgaatgcaccttcaaatcccccacggtaggaaccaggaaatgcatggcggacacaggagcggagtctgggtgtggtgggtctcacgggcacgttacttttctttttctttacctttttttttttttttttaatttttatgtatgtgagtacactgtcattctcttcagacacaccagaagaggacatcggatcccattacagatggttgtgagccaccatgtggttgctgggaattgaactcagaacctctggtagagcagtccgtgctcttaacctctgagccatctctccaagcacatcttactgttcttttttttttttttttttttttttttaaagatttatttatttattttattttatgtgagtacactgtagctgtcttcagacacaccagaagagggcatcagatctcattacagatggttgtgagccaccatgtggttgctgggatttgaactcaggaccttcagagaagcagtcagtgctcttaaccactgagccatctctccagccccatcttactgttcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtggccagtggttcacgtgtgtgggttgcgcttctgttcactcttccccttgcactctgacagaccggcaattgttgtgctgctcatgtccatggtcaacgagcggcagccgtttgtgctgcgatgtgccgtgctctactgtttccagtgcttcctgtataaaaacgagaaaggacaaggagagatcgtggccactcttctgccttccactattgatggcaagtaattcaattctaacatttagaaaggctgtgtttaaatactgtatcagaaatttattttactaaaattacttgtataaaagctattatcataaagctttgttctctgtaaatgaaactaagatgatggaggtagtgtgctgactgctttagaaatgtcattctccatgaagatggcttctgtattgtcatcatcagcttgatagctgcagtgttgtcatatgtcatctctgtgcagctacgctacttaggaggtggctttctgttgtctttcccttttgggtctgaaagtacataagagtgttttataccatttgtgtgtagaaaatggttcttgtaaacctcatgagtgtggggttattccacgtggtcagtgtctaacattgctgtctgcttgcagcaacaggtaactccgtctcagccggtcagctgctctgcggaggtttgttttctacagactctctctctaactggtgtgctgctgtggccctcgcccatgcgctgcagggaaatgccacccagaaagagcaactgctcagggttcagctggccaccagcatcggcaaccctccggtgtcgctcctgcagcaatgcaccaacattctttcccaggtaagggccacagggctcctgaggggcgagcgtcagtgactggggaggagcctggaagatgcagtagagaaggatagaagcacttgctgactgaccacttcactgaaatcggaacgttttgaagaggagagaaagcagtaactattttataggaatagttctgtcaaatggttaaggacttcattatgataaaaacacaaggtctccgcacaggtgtattttgagttttatttcttcttaaattatccagggctcttccctgtcgtttattctctgaatctgggttggtaaaggagagaaagttaaatgatgcaatttgtagctacgtgcctccctgttttctcctgaagcagttggtcatcccaaaacaaacaatagcaatctattaaatatacaaaatgtacagtgtatacgtccagtgtctgtaagttctcacgtgcctagcaagacagacgaaaatatgaaaatctgtgttcctgcagttactcatggtcgccaggcttgggcacatctcttcctacatgatttggccacgtccacttagccttctgaccatttaaagccatgctgactcacagtgtagctgtgaagtcaaaattgtgacggaagcttagttatggataaacccattgctcctggctacttgctctagcaatggaggggcctcactgccgtgctcccaccgtgctgtgctcccactgtgctgtgctctcaccgtactgtgctgtggtcttcactattttttcaccacacattgcactttctttgttttgagctttttgttgtcaatgctgctgcttggcattggactcgtcatgcttactaaacacctcccaccactgagctggaccccagttccaagggctttggaggctttttaattaaagaaataatgttgctgttcatagaagttataagtgaaatctttataagtgactataatgagaagaaatttgaatgatgtttaaattgctttacttcagttgccactttattgcttatctcttagtgatttaaaagaaaactgtattgtgtttcaaatctttacttacttaatgcttggtggtctcctgtcactgttgaaaacaactgttttcatgcaaggtgtgaaaactctgtgcccaccattgccaccttagctttgtaagtgtgctggtggtgatgtggaagtctcaggcgctggggtctgggccttgtaagtaacaggaggctgtgaaattggcctgtgtgccatctctgtagaggggtagagcttcactatcactaagtgttggcttagatttgcagagactaagagcatatgttagggtcttttctggaccagatgatttaaagcaatgtttatgaataatgtttgatgtataatttgcagggtgataagatcgacagacgggtatgtatacctgataagctgaggccttttcttctggcaggcttcttccttgtcttgggttttgcagttggtttttaacagcttgtttgaagttctgttctactcacacatgttggcgagtttgtctgtcacaggtggctctccggtttcctcccttcactcttggctggttgctgagaactatgggagcaagcacactgtgcctgggctccagggggctcgcactgtctcagactcgcagttttggttcttgtgttgtttgcccaagcttgtttctttatttcccttacaaacaacttaaagaaagccacgtttagggataaactgtgtcttttaaccagtatatgaaagaggaacgtgtgaccttctactacttacattatttaaaatgtgcaatagtaaaatttttataattgtaatgattttaaatgaagtattatggattattctgggtataatctgtatgctacaacaaccgtattggttttactatcttaggaggagagtgttgttatgttcagtttggtttagtttttcttttgacaaagtgtttaaccaaaaaaaaaaaaaaagaagaaaagtcttacaagtgttcctgtcgttgctctcagtcccctggttcagttgtgcagtagtaaatcaggcccagttagtgccagcactctatgtgtgaatgtgccctagcatgcacgtggaactcacacacacacatgtggcagcttgtgccagcagtttctgtttctttgttttactagatggttctggggatcaaactcagggctttgtgtgctaggcaagtgctctaccagtgagccataatctttagcccagaatttttgatattagagtatattttttaaagtataatgtcatgcacttaaaagacagacattatgctttcaactgattggctttttaaaaaaacaaccacataacaaattgtagaatatttttctactttcaaggcttcatcagtactcttattctttgttctcagaagccactgctaaaagtgaatctaaagctatgacagacactaggactccttattttttattggttttgagacagggtctcatgtaagccaagctagccttggactccctttgtgactgaggttggtcttgaacacctgaccttcttgcctctgcctccccagtgcaaggattatatgtagacctattatgtcaactgctagacccttattttcatgaaaaaacttaaaatttttaagtggcagcttttgtttacatgaacaaaataaaaatgttcaacttgaatgaacacagggatgaggatttttgtttagaaaatatagttgggagagtataatagtatattaaagattatttgcactaacttcaaatattttatttgtgcctgagcatggtggtatacacctatgatcccagcactttggaggcagactaaggaggatcagtgtatgtgaggccagccttgtataaatgtgagttcagaccagccagagatgcatatcaagaccttgtctcaggcagacagacagagaaacacaacgggctgcagacatggctctgcaggtaaagctcctgccacacaagcatggggcctctgtttcgatccctagcagcctcagagaagctcgggatggtggtgtgcactgtaacccagcgctgagtgagtggaggcagtggagcgagagacggctaaccaaccagtctagacaaaaaggcgagctccagctccagctccagcgagaggctcctcacgtgactcagaaaaaaagtggagaaagagagggaagatatttaacatcctgtatccacatgtaccacatgtgtgcgtgtgtgtacactctgacttctccctctcattcaaacaaaatgtgattgtgtttatgagtttacggcttgtctttcatcctttcaactctgatttctaatgactgaacttcagaatgctctgagtaatatcgttagtctccttttgtaaatctccgtggctccatagaggttctgtaggctctggcaagaggtgtgtacttgtcttgtgttttctaatctctgctcacattaaggagcttaactgttgtcctttgatatagcatatggctgcattttttttcttgcatgtcatttttcttttgataagtgctcttaaccactgagctatttctccagtccttgttttggattttaaaaatcagtcttttatggtctctgctttataagtcattcttagaaagaccatctttaggggtcctagggtaaccgtaagttccagttatgtgtttttactctgccatttttttaaatgatctgtatgtgatacagatacattcatcttttttaaattttattttatcatcatcatcttcatcaccaccaccaccatcatcatagttgtctgtgtgtgcatgtgcgcatgtctgtctgcctaccttagcacacactccacggtatggctatgaaggtcagaggacaactttctcaagtcgattctctctttctgccatgagtgctggaagttgaacttaaggtaccaggcatggcagcatgctcaacctgctgagccatcttgccagctcccacagattttttctgggcagttctctagttgctccagtattttaacatctatctgcaatacactggctgttgtttgggaccttttccacacactgagattcttatttgtacaagtccatttctggactttgattctgttgatctctctccatcatctgctttcacttcattactgttttttactgcatccttaattatttccactagtttatttttccatataatgtttaaaatcagattatttggttctacaaaagtaaaactttgggaatagggtcacactcagtattagagcccatgccaagcatggtaggccctgatgtcactttttcaaaaatttattttatatatgtgaatacactgtcattgtcttcagacacaccagaagagggcttcggatccccattaaagatggttgtgagccaccatgaggttgctgggatttgaactcaggacctctggaaaaagcagtcagtgcccttaaccgctaagccatctctccagtcccattctctaatttttttatacagtatattttgtagcttccaccaggttctcccagatccttcctaccatcctacccactcaactttatatgggtttatttttatttctaataatatgtcttggaattggtcttttaaaactcccacactatagttttgatataacatcttctagcaccatttatttatttatacgggctctcaaatagctcaggctggccttgaactcactgcacagtcaaggatgacttctgacttctgatcctgctccctccatctgccgagtgctgtgattgtaggtgtgcaccaccagacccggctttgttcagcgctgaggatagaacccagggcttcttgcgtattagtcaagcactgtatcaactgaactctcctcccggcccagacgctcctgggtttgaagtagccacttgcgttggtgcatgggaatcgtctgacttctgcactgggctctgtggcaagcgcagcctgttgcaaacacaacaatggatttttagttcagttttttaaatctggctttcttatacatctcttgatgcttaagttcttttaacacaaaagaaaaggaggaatcttaggcttgctttgagtttgaaaaaatagtaactattaagtggtgtctgccaacttatctattgcagggaagcaaaatacagacaagagtcgggttgttaatgttgctctgtacctggctaagcaactgtcctattgctgtaacacattttcttcacaactcagccaatgttccattcgtatcctttacaaagttttgataccatccacgttacttatatctttcaacctccattgcaacttttgaaaatgttatgcacatataataatgcatgcttaagctgtgtgtgtttgtgtaagtttttatggtatgcttacttggaatatatatatatatatatatatatatatatatatatatatatatatatatatatatatatgtgtgtgtgtgtgtgtgtgtgtgtgtgtgtgtgtgtgtatatatatatatatatatatatatataatttcttaaagagaatcttacataagatgtgtgttaaattcagattacaaaataaaatattccagacactgtaaatctttgaattccttaacaaagatgtcagcttacaggacagattgcagaaaatctcggagaagaagagcagttggtccaaggcttatgtgcccttcttttgggcatttcaatttatttcaacgataactcactagaaaactacacaaagtaagtgagggtagggtggccatctagtcatccacagacagacatacaatttttttgctaaagtataagtaaaccaagcttgtgacttcgcatttttttaagcatctcatatgtttatttatgtagagagaaactaaagcaactaatagagaagaggattggcaaagagaatttcatagagaaactaggatttattagcaaacatgagttatattccagagcgtctcagaaaccccagccaaactttccgagtccagagtatatgatatttgatcatgagtttacaaagctggtgaaagaactcgaaggtaagatgtgaaggtttgtgccaatccaatgtaactctgtgtgtgtgtgtgtgtgtgtgtgtgtgtgtgtgtgtgtgtgtgtgtgtgtgtgtgtgttttgggatgcccatgagtgataagccaggaagttcatctgcagcacatagaaagactttggaccctttaagattagaaagagtactgcatgactgtcttgagttagactatttttactcagtaaatcctaaaacttaagtcatgtttacagtgcttaaaatcaagctggaggcaaacaggtgagtgagtggttaagcttgtacttagcacttgaggccctgtactcagtctgcagagcctcaggaaaaccattcagtgcagtttatgtagaggaatttcaatccagaaacatggctaatctggcaagagatcacagctaaagaccacctaggtctgtgtgatccagctggaatgcagacacaccgtggattacagtgtgatctggttggatgatgtctaattgaggggcagacaaaatgacaaatcagagaaagatttgacaaaatgaactaggatacacccaactctcatgagaacagacaggaaagagaggctacttaagaccagagcagcgagaggtgaagtagagtgcagctgagttctgtgcagttcagttgactgcagctgagttctgtttgttgatacagtcagtgccgttgagttcatggaattcagaggcagggttttcaagcacagcaattcagtcagaagccaagagattcctatttgaatcagtcagcttggagggagtttgagccagaacagctatgttgaaccagccagcaagagttcaggaagagcagacagggtgagtttatttagcagtgagtctgagaggctgaaacattgcaggcccaggttagcagatggagactggaaagtgaaacctccatgatcctggcttgcagaagctcccaggcctaggtctagggagagtgcagagaaagaaagcgagctccgcctaagccttgtatttgtacagcttgggcaggttctcatctcatccctttagctgaggaaatgaaagccacattcgcatttacagtttaagtatgttttgttttacaggtgttattaccaaggctatttataagtccagtgaggaagataagaaagaggaagaggtaaagaaaaccttagagcagcatgataacatcgtgactcactataagaatatgatccgtgagcaagtaagtaccaacaaactgtcctctctgattggcagcagctctgctggagggaaggttgcttcttggcatttcaagtggatgagggatacacagagtaaacgtctgcgttttcaaatgcatctgtgtgttaaattgagggacctgctttgtgctaggcactgtgcaggatgttatagatcatggatccgctggattctcttgttggtgtcggggtgagacagatagctaaattattgtggcagaatgttataccatacattacacaatagcctagtgttattgctaatcaaaggtgtagcagctctcaggctgagctctcagagaacctagagaatactctctccataagagggccaaggaagagcagcaggagatgcatacagcaccgtaagtcagctgtggctgccatgagcctagagcagctcctggctgagtggaggagacatttgatgggaaagcatagggaggtaggccaggaaggagattattgtggtgggtcagctaggggaggatgttggtgacagtgatgacaatgatgatagttagtaactgcctcacatgtttgctgtgttctgtgaactcagtgtctttcttgtttaaggtttatttatttaatgtatatgaatgctctatctgcatgtacacctgcataccagaagagggcatcagataacattatagatggttgtgaactaccatatggttgctaagaattgaactcagaacttctggaagagcagccagtgagttgagccatctgaactattcaaccatctctccagccctcagtatcttacttcacagcatccctacaagtagtgactaactatattcagtttaggataaatgggaaatctatgcctttaatgaattctcccagcatctcccagtaattgttggaacagaatttaagtgtatgtgcgttagtgaaagtatgtcatatggcaggaacagacttgagaagtgtggaagggctggtgagatggctcagcgggtaagagcactgactgctcttccaaaggtcctgagttcaaatcccagcaaccacatggtggctcacaaccacccgtaatgagatctgacaccctcttctgatgcatctgaagtcagctacagtgtacttatgtataataataaatgaagctttgggccagagcaagcagggactgagtgaacggggctgaccagagcaagtggggttgactggagcaagcagaggtcctaaaaaattcaattcccaacaaccacatgaaggctcataaccatctgtacagctacagtgtactcacatacatacatacataaatcttttttaaaaaagtgtggaaactgaagataaaacttggcaggacttggtgatgtttctctgcaggtatcagggtgcagacaggataagtgtgatttctagatttctgtcttgggtcattgagtacagtcatggtagacaggcagttccataaagaaggtgatgggctagaccggaattctattttcagagtcatcaattgatgctttcctttcataatgctagccactgtccattatgtacattgtcttgtgcaccttagctctgttgcatcctttaaaatgtcactcagtatttgtactgaatgatatatactgtaatagaattttgtaaaggattatatagcattatctgaaaaattagattactgatgttgttaaaattctaatggcataagggaaatgtaacagcctatgtggggtaggcttaccttcttacgtatatggtatttttttccttcctcacaatataaattactgaaattgaaaatttacaagtaataataggattcttggagtttgtcctcagcttttcagtgttcagccaaatcaataaactaaaaattagtatctctgttcaaagtttgagtcatcaaactgccccagttatggatttttaatctatgtcttggttcaaatacagcagtgtggtgtgtaacttacatctggatctgctaaccacagttgatctagaaagaagaaactgttctgacataattattgatttatttatataatgttaatgttatacattcttacaacttaaatcttaacagataataaacatctaaaactataaaaatgtttatatcctttgaatgatatttgagaattcatcctaaggaaattctccaaaattcaagaaaaactgttaaatgaacatttatcattttgaaaagtggaaattatctttagtgttaaaagcatgtaatgtgccgggcatggtggtacacgcctttaatcccagcactcgggaggcagaggcatacagagaaaccttgcctcgaaaaaaaccaaaaataaaagtaatgtaatttatactctatctacttgatcaggtattgaatgagcatcaataagtatggccttatggctgaaaagataactcatgaagagcagagctgggatctcagcaccaccgtgacagaccaggcactcagtgctcagtcaccccagctttgagcagaacagagttgctaggacttgtgggctgtcagcctagccaagaagacatgagctataggttctgggaaagactctgtctcagaggaataggctgcaacaggggccctctttggcttccatatgcacactcacaggcacatgtgtgtgcttgaatacacatacaaacacaaataaatacagattttaaaaattatgattatgaaagctgtatggacatttagtaagcggtctaaatgttctaagcttctgtacgaactgactatagcaacttgataaaacatgctagagactgcttgtggcccgacttctttttttttttaatttatttttattacttttaattatgtgttatgtgtttgcatgtggttgtgcacatgaatgcagatgtccacaaaggccagaggtgtcagatccttcagacatgcccagaagatagaaccaatttgtacaaattctcctctgacttcctctcatgtgcccatgcacaaaaaacaagtaaacgtgataaatttaaatcctatggctgcataagtgtatcttcattcactaagtttcatacgtagtttggtagatatttctgtaatggtgtcatggcctcagagtgagtgagcagcaggctgcggtgctgcagtggtgtggtgctggtgagtgcagagcaagtgagcagcaggctgtggtgctgtggtgctggcctgcagagccctgcttgaagcccccacatgatgatcagcttcgcacacgttcaagtcttcatgcttcactattgatttggggcgtgttgagtagtttagcatactgattttttaaaagcccatgtatttaattattgtgtgcctggtgtatgcagtgagaacatctgactcgtgtctgtttcacaggacctacaactggaggaactgaaacagcaagtctccaccctgaagtgtcagaacgagcagctacagacagcagtcacccagcaggcatctcagattcagcagcacaaggaccagtacaatctcctcaaagttcagctcggtgagtgtctgcctcactctgtcctcaggagctggaaggagattctctgtgccctgcttgttctcaaccgtgatcactgtgaggaatatgtaagttagaacttagtgcaggatggcttgtaactgagtagctgagaccagatcattccaatagaaagtccactctccatcttcttgcttattggctgatccagtgattgctgactcctggcaacacactatatcccatgggctatttgagattgactgatatactatttcagttgcttcagaattgaaataatagcattatgtcatctgaaaaataagtaaaataatagatatgtaaaactctaatttattcccaggtagataggcaagaattcacattcctccattttgaaggggcgttttctcagatgtcattgttgtctgtggttgtgtgtgggcgtttgggtgccgctaggtctgagcctgacttgctaaaccctcccttctctttgtggagacccggtgtgctgtcctgtgccccgttatgtaaaaggcagaaggaaagggctccagccctcttagcaccatgtcttcagtgcctgtggcctcctgtccaccggctgtgtcctcaggtgtaggataccaggagagaaaaaaaggatttccattcctgtcactttctttctgggtgctggggctccaaccctggcctctgtgtgtgtgggagtggtgctgtacagaaagccatactgcaagcccgcatgtttgcagagagcatcatcttgcaggccttgtgatgatgataatgccaggtaccgaagagtaagaagttagtaactaacattttcagaaacaaatttttctttctttatgacaataattttttggccagttaacccatgtggatagctattcctctggaaaactttttaaatggatttgacttctcttacgcttattgtcagaattggaattaaagctgccgtaattcacagtcataatcaccaaaccatacagtttaatcaggagccttgaaccaatctgcacctctgccatcaggagcgccctgccagtttcccagttaggggaccttctctggggtcttaggtgatcttgtattgtagccttctagtcctgatgatgagaagttggattcacgtcagctttccccactgttgtgatgtttaacaggaaaagacaatcaccatcaaggttcccacggtgacggggctcaggtgaatggcattcagccggaagaaatcagtcggctgagggaagagatagaagagttaaaaagtcagcaggcgctcttacaaggccagctagctgaaaaggactcattgattgaaaatttggtaagtaaatgttaaaaaagaaatgtaaataagtgaccaagagtaattctcatcatcttacttgcttgctttttctgggtttgttatttgttctttttttaaaagatgtatgtatgtatttatttattttatgtatgtgagtacactgtcactctcttcagacacaccagatccctttacagatggttgtgagccaccatgtggttgctgggaattaactcaggacctctggataagcaatcagtactcttaaacgctgagccatctctccagcccaatttgttttgttttaaggcagggtcttacagtgtagctctggctggtctggaactaattatgtagatgaggctggccttgaactcagattttctgagagctgaattgaaagttaggtaccaccatagcatagccatccctgtgtggtttgttgttgctcgtgttgttgttgacgacaggctcagccatctcagggtgatcttgaattcctgatcctcctgcctttctttactctacaagtgctataccccatgcctggcttaatgcttcaaaacccactgtggtgtctagaccttgctagccttgaactcacagagctctgcctccctccgccccctggatgctgggattgagagtgtgtgcctctgcaccagctctcctgagacagggctctctatgcagccttggtttccctggaacttactgcgtaatctgcttgagccgccacactcagcttggtttttattgtttgtttatttattttcttattgatggggattatttcttttaaaaatagcgatagtgtagttttagagacatttgtttatttggtttgttttgtttgaggttagtgtgtgtgtgcagacatgggcactcaagccacagagtggaggtcaaggacagttttcaggagttgattctctcctttgcctgtgagtctcgggaatcaacatccctttggcaggcttgtgagtcacctggtctgagtgtaacttctgaggctgtggagagctgtagacagcgctctattgaaatagaatcttacatataaaaattcaagtctttatgtgcagtccttagtgagcttctgtaaggtctgactgtgagcgtgaacctctgctctgactccctttctttccaggtttaatttcagtttatttctatgctaattgtagaaatcttcgcaagcgtctggcatgagtgaacaggcttcagcaacatgtcctcccagagatcccgagcaagttgcagagttaaagcaggtaatgttccagtagagtaacaccaccctgagtgttgtattgctgtagaatgccattgtcaggagcaatacgattggtagttaagacaagctttgaaaaacctagaagctgtgtttacttgacagtaatgtagttttgtctttcattgatttgttttattttttttacatttattcatgtgttaatcttgtgctataaatgtgtgtggacacagcttgtgttataaagaccacatctggaagtcagagcatagctgcagggagttgggtctctccctctaccatgtgggtcctaagagtgacttcagtagtcacccactgagccatcttgctagcccagcttcttatttcagtttccttctttctctctcttctctgtcatcctcccttctttctgtgttataaaggaatgtatggttattagaaaagagaaatcagaaaccaggctgtgcttctgtgctagctatcgtcccctgcagggggcagtgcctctcatgcacacggctgtgcctgtgtcaccagtgtccttgcctcttaaatctgcagaggctggctggctttctttctttctttctttctttctttctttcttcctttctttcttcctttcttcctttcttcctttcttccctccctccctccctccctccctccctcctttctttctttctttctttctttctttctttctttctgtgtgtgtttttgagacagggtttctctgtatagctctggctgtcctggaactcactctgtagaccaggctggtcttgaactcagaaatccgcctgcctctgcctctgcctcccaagtgctgagattaaaggcttgtgccaccactgcctggctgatttctttattcttatattatgtgtttcagtgttttgtgtgtgagtaggaggtttttggtcttgttgttttgagtcagggtctctctatgtagccctggccattctataacttgttatgtagaccaggctggcctcaaacttacagagatcctcatgcctttgcctcccaagtgctggcattaaaggtaaaaaccgctgtgcctggcaaatatacaagttcttttaaaatgatggctttatctagcaacatagggatttatgtattatattgcatattacaaaataccgtatgtgggtctcctcactctcttggatcattgcctgatggtccacaagggcagtgggagcagagccaacaacagatgtgggtttggaagccccacgagtacttacggcgaatgaccacactgggaccagctatcgggagccacatcagctttactttgggtggctcaagggtaataaagttttgggggattgagagtaggaatatccaggaggggcagaggtcattggctgagggcttagggtacctgaaatgcctcattagtgtggggaagcatttcgagaatcttaggcactggctgaacaggttctatcaggagaaaggagctgatccggtaatctaattgaagctacatgccatttctcaggtagagtcttatgtggggacttagaattccccaggcaatttcagaggagaatccctgctaatgaacggagtctctcatatttctcggagcccagaagctatctggtcattatggactttgaccttaattagcagagtgttctcatactgtgtaggggcaggggagatggctcagtaagtaaatatgcttgcttacacaagcatgagaacttgactttgaatccccagcacccatgtaagagaaaggcagacatgttatcacatacctgtaaggcagctggatcctagggatggctttccagacagtctagccaaaacagctccaggatcagtgagcagctgtctcagaagtaaagtggagagcaagtggaggacacccggtgccagtgtctggcctccacacaggcctccaaggcgacatcatcgcccaccctatatatatgcaccacagacacacagaagggaaataaagacaagaacaaaatgatcggtactatcacactccgcatactcttgttgataattgacagtaggaagtaattagagaagagactgtactcgatggatggttgatgcattatgcacctccccatgcattatgcattatgcatgtccccaatcattgcctgaggggaaggagcatcactgggggagctgcattttcattgcttttctgtcactgtacttggtgggaggaggtgctgagcgtcagaacgtccagcagtgtagcagcagcttcttccctgtctccccagcactgctactgccgtgcgagggccctgaccttgagctggcctgctttgagttgcaagcgccaagcctgtaggcttgagcggggagtagcagggtgtgagctctggcagggatctgatggctctctcagaaataagacattgaagcagccctcagtgcttagaccccattagctgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctgtgcctgcctgcctgcctgcctgcctgcctgccttctttccttccttccttccttccttccttccttacttccttccttccttccttcctgttatccctttaggatgtttttggtgggagggggaggacatacaggatctcaggaagcaatagggatgcatatataggtttcattctctagcttgataaattctaatacttggacatgaatgagttttgaagatagtgtcaagaagggatttctgtaagtgaacatttccttaatgaaaccacactgttcctaccacaacttactgttctgtgtttaggaactgacagcattaaagtcccagttatgttcacagtctctggagatcacgagactccagacggagaactgcgagctgctgcagagagcagagaccttggtgagtcaccctcatcgtcccttccaaaggcagcagcacacagttaatctgttctctcagccgtagccagagctcagtgacagaggcttcctgcttcctggtggcctggtgtggcctggccttgccttgccattctattccattccatttcttttcttcttactgtgcggatttgtttacttagtgactgaatggttaattcactggcgtaacatcccgtttccatccttttccatccaagctgatagtatccctgctgctgtgaacttgtcaaaatcccatgcacggccaaaccttcgcccaagaaagccctccacatataaatacctcgcctctgtccctggtgtctgccgagtgtggccactaacaaaaggtggtgcagacccctcatggtttccccagaacacactttctcatattttgcaatctagataggctgaaaatgtcaaaattttatttttacttactcatttgtaaacttctcttttctcctatgctttctaatagacacagagcgaaaggagactgcactgcggtgcttggtttagagcgtgagctataaaagtggcttagggtaggtatggttaggtaaccatgccaagcacagtggtaactgtgaggtggggcccatcttggacggcgtgacaagacacattctaacacagatacacagaccacaggccggccagtcagttgttctgtgctctcaaacaccggaccatgtgctgtcttttccctaattcccaactgcgtgcttcccatttctctctgtgacttcaccatgcattctctccacaaaactaaaatatcctcgagaactttctctgttctttatgaatctattgcagaattcctttgaggttcatattcctgtcagtagtgtctttgaagtggcttaacccttgtctgatacttccacaaaactgaattcattgtcctgtccaaagccactgtcacacccttaggaggtgctgtgtcatctccactctggtatattttagagaaagggtggtactgaaagtttcactcatagaacacttaaaatacttacttcaccaagtgctggcattgggttggtttaaagcctgaggtgacagtgttggacttacctcaggaacttagaaggcacagtgttgagtctctgccactggcacctcctcttcctgtctgccttgtgccttgccttccttgtgtgccgttgacatttagtgccactccatggtgggacagctcatctgtcagagtgcattctgttgctttcgcataaatacatgagttattttctttcatttgaaataaaacttcagaatggcaagaagatacacacacaaagtttgtatcatttataaccttcaagagactttttaattttccgttttcaggcaaaatcagttcctgtagaaggagagagtgagcatgtgagtgctgctaagaccacggatgtagaaggaaggctgtctgctttgctgcaggagaccaaagagttaaaggtcagttgtggtagaattgctatttattagacctaatatgacctaaagtccaaaaactttgactttgtttcattttatctccgagttcctcaggcttataaagaaaactgaaagttagggttttgttttccaagacagggtttctctttatagtcctggctgtcctggaactcagtctataaatcaggctgacctcaaattcacaagaatccacctactgagtgccaggattaaaggtgtgtgccaccatgcccagcaagttttcttatcaatgacagtatttaatcgtaacaaattaagggtaacaactttggctaatggaaaagccatgtagagccaggcatggtggtgcagtcctagtgctgaggcagatgtgaaaccatgagttcctggccagccagagactattgcaaatgacaaaatagtatacaaacttccatagggttgaggaacattgtgacagacatgtcagagtaagtagtgtaaagaatcgggtgacattcataagtaaatcatgaagaaaagtgtgaaaacggaagatgatatatagttatactttttggattgtgtttaaattaatttgaaactattcatttgcttctctgaatgaaatggaacttttttcctttgagttttgagttcaaattctgacgcttaccatcttctgtacatcatcatcttcagggttagggtaggggtggccaagtgaaattaaggtttgtaccgtctactctgttctttactgtggctttctttgctaagtaggctgacagatgcttacgttcctgggtgtgtgtgtgcctgggtgtgtgtgccttgcatacccagttgctgccacgcacctcagactcaacagctgtcccttattagttacctccacagtactgtaagcaaaagccctgacagaggggacgtaaggagcagagggttgttttgggtcactgtccctaatggctgggaagaggtggtgtctgtcagaagcagtttacagctgtgtgtgatggccagatgtgggcagatcaagaaatgactgctccagtcagaccagaaacagacatcaagactattgtggctactggcccatatctgccatccagggagacatttcacacctaaactaggacatacagtgatttgtcatcaacagaaactgttaggggctctaggaagtaagtactgttgtagacagctgttgtcacctttcttgtagaatgagattaaagcgctgtctgaggagaggaccgccattcaaaagcagctggactcatccaatagcaccatcgccatcctgcaaaccgagaaagacaagctggacttggaagttacggattctaagaaagaacaagatgaccttttggtgctgttagcagatcaagatcagaaaatcctgtcactgaagagtaaactcaaggatctcggtcatccagtaagacgcctcacgtttccacacatgatctctgcctgtagagcagagcatgttcctaatgtaatgttgcatgagggagctgtgcctgtgtcatgttgtgtacatggattattatctgcatgtagttctcgctgtttagagagttggtctgagatacattagaatctctctgcaatatttgaagacctggagcatagagaacagctgttgtcactgctcctaggtattaagcgtcactgtccagggtgagttgggtggtcatgtttttaccaccatgtattcagactcctgggtagaaaggtgtgagcatttaccgtgaccgttaactgattagcataacccacagaaatgcagagagccacagggagccccgagcgctatgaagtcaaggaaatctgatttcaccataggacagactgataatatttattagcaggcgttttacatgtatatgtttcccagtgtgttattctgtgtgtgtgaacaaatctgtattctccccttaggttgaagaagaagatgaatctggagaccaagaagacgatgatgatgaaattgatgatggtgacaaggaccaggacatctagctttaaaccctaggaatgatagagattacgtcattatgtggaagaagtcttaacagtgctttggtttgcctccacacaaaaaataaagacagaaccaggtggaaacattgactagtaaaactattgatatatgttttttaatattgccacccatgtggaaaactgacttcatgtggaacttttatttatgttcatctgaactctcccaaaataaaatttgcacagggcaccaagctccaaaagtaccccctttgaaggcatgtggtggcaatgcagtttgccatgttggttcactgatggctttcagacactctgtgacttcagtactcacacatttgattaatgtgtattcaatgggagtcatcatttctaagtcagcgtttgagttctcggctgattaatccttgtaaagaaaggactgtacttagggtagcctggggctcctgtatgtcatcccctcaaacccccactgtgcctcccgagatcaggatgggacagttccgagtgagtgcttgccgtccagcggggccacattctgcctactgagaggaaagattgtcccagagtgtggagggcgttctgaggaactggaacagtgtactaatgtggctggttttctctctgtttaagctaaagatggaaaacagattatagtcagcagttcatatagctgggatttagaattgtttgattatcataaaacatgttcttagttttaaaaaatcccacactatgatttatgtaatttattggcatttttgctgaataggtgtaagtcagataatagatttttaaaaagcaaatgaagcaatgtgtcaaagtctaatgttttcataataaaaatagatattatgttcacttaatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacacacacacacacacacacacacacacacacacacacacacacacacactgtacatggccgtttgaaacctcaaagacacacttcctccagtcaggtcacacatctcctaatctttctaaccctatcaaagtcattccctagtgacattcatatatgtgagcctgtggaggccattcttactcaaaccaagacttctctttctcagcattaaactggatgttcggagcattattcccactgaagccagtgaccagggttctgtgagagtgaaggggctaattggagcaggtgccagaatgcaagaggttttggacgtgggttttagggttggtttttttttttggtttggtttggtttggtttggtttggtttggttttttgagatagggtttctctgtgtagccctggctgtcctggaactcactttgtagaccaggctggcctctacctcccaagtgctgggattaaaggcatgcgccaccactgcccagctcctcttatttttttagtgggtctttgagaattctatacagtgtgttttggtcatatttacctacctgccttaactctccagcaccaggtctgcatgtgttctgccatgttccccacaataaagataatagattaaacctctgaaaccataagccagcacccattaaatgctttccttattaagaggtgctgtggtcatggtgatgcttcacagaaatggagcacgaactaagacaggccttgttctgccctgcagaactcatcttcattgccaaagcaaaactcattgattcagctccaagcactgaggatacagaggggaagacaaaagccctgtttaacttacattctagagtaagtaccaataaatacagtcaagtgctctgtagcttttggaaagaagtctgcatgttgttcagaattggatgagaagccagaagagtgattagatacacgactctccatagatcccatctctcctatgttgagaattgtctggggcagaggtcatgaactcaagagaccatataagaagctattgccacggatcagactgtattataggggtaatggtgtttaaagcggtaggagtggaggtgcactctgcaggtagagctaagaggacttaaactgcaaatatctaggggatagaggaggaagagaaagaaagcaaaaccagttcctggaaagggcaacatggtttgccgagttcaagataagaggagcaggtgatcaaaggctatgtttcctgtggacttgctgaccctgaggtccaagggcacatggttatctattggcacgttcacctgggaaacagatgtggtaatctggagttcctggagccagaaaaatatatctggtaaacagcaatgcaaagaagttggatgttaaacatgggcggcttcttatccttggagccccaaagcacaactatacagataaggaatggattggcacaacttggaaacaagcaaggtagtgagtctgcagtgttctagtatctcctgcacacccatcctctgctgagtgctatactctgttgacaagcaaccatggttgtcaaccaaggagcaggaggcatgaccctgtgttgctagctgtgtggtgctagattctcactagcttgatgatgtcaacaagcctgtcagatgtgttcatagtctggtttttatcacaaacacttttttcctagactagagagacatcaatttaaagcacttgctctcacgcgggttcagatcttatcaccaacatagtagctcacatgcatctgtaactccagttctgagatatttgacaccctcttcttatcaggcatacatgtgataaacatgcatacatgcaggcaaaatactcataaaagaaatctaaaaaattcaaagcaggagtcatttaccctgctgacctcagcaagctagtactgcagttcacagtgttcatgcatggggaatatcataggctgatgttgattttccttgtttcagagaaatgacaacccatcatgtaatcaagagatctacttcttaaatgagctattatacataaatatatctaatatgtgatgaggatgatgggattttgaagtagtgcatgtgtgtcacatatctaaataccttctcattttctcacatgcggtctcttttaagaacttcttacgtttaacgataatgcgctcttccttctcccccatctccagggtttcctgctaactcatgaactgtaccaagaaagaggaaacacagcttcagcaagcagttaatatctaacccagcacattaatacataaccaagtgtccgtggttggcagcaactgctgtcgcagcatagagaggtggtggaccacatgctttcatgatttcattattgacccctagcatctccccatatggtaatcaggagatctaattcttctcacgcccagggctctctgcagcttagtagcctgagtcagttcctcatccttgcctggctcacctctgaatgttcctactaagccatggaaccaacaacccagcaagacattttaagccttttgatactcatctgactgctgtttggaacaggttggtgggcaaattgttgtcagaactaagttttcattgagagagaatgaagtaaccgaagcagccaaaccagggccttgtgttgacttaagcacatcaccataaatagcagaggacttgtgatttattccgctctcccacagttctcagagacaaacaagaatgaattctggcctgagctttctttttctgattctggggaaatgtctgtcacaaagtgaaagtaaaaattgcactagcaaagtgaagaacacaaaggcaaggcgagagtaaacaaagtgttcccttggaaaaggccaggagattctgcacaaatattcccacgggtccttgccatgtgggaacccaactcctcaggccttgccataagtcaagtgtgactcacatcacagtcatgcacctttccaaagtaacagcttggccaccgacaatttgtctcgtgtgtgtgtgtgtgtgtgtgtgtgtgtgtgtgtgtgtgtgtgtgtgtgtgtgtatgtatgtatgtatgtatgtatgtatgtattttggtccctgggacttgaaccaaggcttcccccacaccctaccactaagctgcatacccatggtgccccacccatctgtctcttattaccattctggaactctttcctccaaaccagctgccgacttcccgtaggtacgaattgaccctggacttggttgcctaacacatttacgcctattggggaaagtgaccttgagtacagcttctcactgtcttcttggcaactacctagttaagctagatgaagaatgttacatgctgggagctaactgtgtgccatgaaacttgcaattatggatcttttcgtggacaggaatctctatggagatgataaagctgtcgaatgaacccaggtattgcaatcctcctaaacaggtatgggcttagggaagcacaggctgagtgtcggaagccaagacactgtccatattgtagccaccaagcctctggatggaacatgggtataggtgctaagtattgttatctcacatccctctataacagcagttctcaacctgtgagaagtgatgacatggaggtggaacaacccttccacgagggtctcaaatcaatcagatgtcctctatataagatatttatgttaggtttcataacactagcaaagtttactctgcagaagtacaacgaaaataactttatggtggtcaccataacatgaggaactgtattaaagggtcacacagcatcaggaaggttgagaactactgattagaatgaagtctattgtgccatacaagtttgattgaaagaactgctgaccattgttggtaaaataattgttttaagggttgatactcaaagcctaacgtcaatttgtcttctcctaccttatggccagaagtgactcacagccatgtgctggtctaagcactgttaaacaaatcgagaccagtgggtaccttgcctgattgcagttcacccatgtctgggagtgcttgaatagaaatctctccatgaagtgcctagctttatgggaatgagggatttgtaaatgaaaagtttaagtgtgagagggaaacacagagccctggtctgcaaggacatgggctagggagccatgtatgctcattctgtatatggaaggcatgtgcacagggtataacagaatctactgtcaagatttcactttcagctctttgcctagatgcaggaggatcagcaccagaaagtcctacttactagttgaccttcctgttagagaattatgtcacaggccagacaggtacctcaaacaccaagggattcattcagcttagacttccaccctgctgttcatcaccaaaggaagtcagtgcaggaacccaagcagggcaggaatctagaggcagaagctgatgcagagattatggagggatgctgctcaactggttggcttcccttggcttgctcagcctgctttcttatagaacccaggactaccaacccaggaatggcactgtccacaatggtctgggtcctccaattgatcattaattgagaaaatgccttacagctggatcttttttttaaaaaagatttatttatttattttatgtatataggtacactgtaactgaacacatggttgtgagccttcatgtggttgttggggattgaatttttaggacctctgcttgctctggttggctctacttgctacagacgcaccagaagagggtgtcagatctcattatgggtggttgtgaaccaccatgtggttgctgggatttgaactcaggaccttcagaagagcagtcagtgctcttacccactgagccatctcaccagcccccttacagctggatcttatggaggcattttctcaactgaggctccttcctctctgatgactctaacttgtgtcacgttgtcatagaaccagctggtatgattactttcatacttcaagagggaacaaccagggcacaaccaatgtgaacaaagcaaacaacaaacaaacaacaaacaaacaaacaaacccaaacagtacaaatgatgcagagtctaatatctggtatttactcctgatcatttgtgctcttccaaaaatcttggaagtctccctccctgacttcactcttcaggcatgagcccgtttcctccggctgagcttccaaacacttcccaaagaagcctttgaatccttcatgaccgacttgtggtgactccgcatcccagagggacagatggatgagtagactgttgacatccttcacaaatgatgagccagggctactattgctgttcccttcctgagagataggctctgtgttcacagagatggaggagacaagtcaccagtgtttgcctttttgcttcatatagcttcatgggcagatacagagagaccttccctcccaactgaggcaaatttaaatgcatatctctgtgggtttatatgtttaaatcacaattaaaggagtcaggatgccctctctgtttgctagacacaccccacggagtctgctcaaggccttgaatgcaggggtgagacaggtcctcacttcacccaccgcatcctacagcatggaatgcaggctgccctctctgctatttccatttttcttctgcgtgatggaatccctgattcctagctagacttttgattaggaagactagacttttgattaggaagaaaggaaggaaggaaggaaggaaggaagaaagaaagaaagaaagaaagaaagaaagaaagaaagaaagaaagaaagaaagaaagaaagaaagaaagaaaggaaggaagaaagaaagaaaggaagaaaggaagaaaagagagagagagagaaagaaagggaggaagaaaagacaagacagacaaataaactatgtcctaattgcttttattttcctgattcttctacaaagacctggtaatggtgggagatataataaataaataaataagtacttattatagtctgctttttgtgcttggtaaaacactgatcaaaaccagcttggggaaagaatttgtatttagcttacaggttagagtccatcactgagagaagccaaagctcaatacacgaactttgggagagacggctgaggaaagcttcttcctgctcgcttccctggcttgctctgctagcttatttatttatttatttatttatttatttatttatttatttatttatttttcgagacagggtttctctgtgtagccttggctgtcctggaactcactctgtagaccaggttggcctcgaactcagagatccgcctgcctctgcctcccaagtgctgggattaaaggtgtgcgccaccacgcccggcttctgctagcttttttttttttttttttttttttacacagcccaagtacacctgctatatcactatagcatcacccacgcatggtacgtgggccgcctacatcctttgaatcaagaaaacacccccacaggcatctgcacaggccagtctgatggaggtaattcctcagatgagattcccttgtcctacggctagagagatggctcagtggctaaggacactgacttaaccacttaatgatggacgcaggtacaaatcctagcacccacatggcaactcacaattgtctgtatactccaagacccaacactctcgtttacatgcaggcaaaacagcaatgcacataaaataaaagtaggtgaattttttaaaaagagagattccctcttcctgatcatgtgtaggtttgggtcaagttgacaaaacctgcccaacacaattacatggtaaccagtgtaatgtaagctttttattgacacatcaggtagggaggagtcactgtggtgcaggaaggagctggaagcatgatccgactgtagcatgggcactgtgtgggggaagaggcttttctgggctgtgaggaaccctactatcttgaatctccccgcctgtcgggagtaagaggacccccagtcagagaaaggtcagcttctgttgtgagtgggaatgatgggaccacagtagttcttctgctcagtggcggcttcctctgatagaaacaagaatcaagacagaaatgcacttataaaaaaaaatgacatataaaaatcgcacagctagtatatgtatccataaaagtgacatggctattttgtgtaataatgtttttaagtgatatgggaagggtgggaagaattctcaacaagaccagactcttttccgtttcgttctcctcttactaacttctactgcttcgcacgtgtggggtaataaaatctgtcttatctgtgtgcgacatgctgctgtcagaagagaccaataggtgtcctcctccctccctctctgcctctctcctttcagacagggatctttcccagccaggaagtcattgtcctgtccatctacccgggatcccaggcgacaggtctgtggggacaccctgcttgtcatgtgggagctgggacccaaagtctggttccttgtagttgtggtcagaagaaggcatctgatcgtctggaattggtgttacagatggtcatgatggctcatgtaggtgctgggaaccgaacctggatcctcagcaagagtagcaagggttcttaactgccgggtcaagtctccaggtaggtcccaaacaagaactttgaaaacatagttttgaagtttttttggttttgttttttaattataattatgcgattttaaacaagtgttctctttctttaaaaaaacctctcagatattttcatagataacataattgaaaactgcctcctttagcattttcaaggaacagtatggtatggtagttctttatttggggggggggtaagtattttagttgctaaatgatggtttagggctttatgaaaaagaagctatggattggcagagtgtccaaagtcatccgatccttctactccccgccttcccctttacctcccccaagtcttcatcctctctgagcactagagaataaaacagagaataaaaacttacacagattttaaagaattcacagaacctctggcagtgctgcaagaaaaggaaaggaacggtcacagctcaggtgattgttagcgactctaagtttaagtgtgttttgcttttgtttggtttttcaagacagggtttccctgtgtagccctggctgtcctgaaactcactctgtagaccaggctggccgggaactcacagagatctgcctgcctctgcttctggagtgctgggattaaagaggtgcaccaccactgcccggctaagtgtattttccaatgttttgaagaaagctctcttaagaaaacatttacacagattgcttcagggtcatcatacggaagtggagggggctgggggttagctgggcagtgacgcacacttatctctctgctcttctatttaaaatatgagagaagaagccatttggtagctgtctgagcgtagtaagcatcttcgggaagatttgaagcatcaggagattgccaagaggccacaacctatagtttaaatctgagtcaaagacaacagctaaaaaaaaagtacaaaggtggctgccagatttcttgacaaaaagggaagaaaagaaaagagctttactgattgacataaagttctctaaagggaacatgttacatgcaactttgagagggatttgaacatcataacagatatatctaagaaacctagactatgaggaaaacactggtagacgttaaagatgtcaaacaaaacaatttgctaatttctgactaattagttactcacttgacttctgtttatttgtttgtttgtttagtgtgtgtgtgtgcacgcgcgcacgcgtgcgcgagtatgtaacagtgtctgtgtgatcgttttctctaaatcatatctttctaaagaagaagggaagaagtgatggagggagggggaggggactttaccttccggttgaagaaaggacagtagaggaaaatcttgccagggaatcttgatacctgtggaaatggaaagtacaaccacagtgtcttatcaagaataagaatcctctccagacggccagccccctgacacagtcatctgcaagtgtgttgggctctatccagagttgccctgaggtgccaatgggctgcaagcctcaggttggacaccactgtgagtctgagtgacagtctctctcttctttctctgcagtgacaatcggggctgtatggtctagactggcctgcctcaggctcgctccacttcatgtccatcactgagtatgcgtcttcctccatggtcctcagcccagccaccagtgggagagtcacccaggagcttgtgaacctccagacacttggcaccaaccccagaccagtcaagccagattcggggagtggcacccagatgtcagaactttgtgaagtctcccaaaggtgtccaaagggcagccaagattgtgaaccactgctgctctctgaggccaggagagcttcctgtgtccatggctacatactgctcttggttttctaacaaggtctttccaaataggttgaaagatctacttccttataggtccagagaaggtcctaaataaaatggaggtgctgttttgctcttggggtgctctgttgtccttatttcaggactgagtataactaaagattcaggatgtatgcggtaaagctcgtttgcagacacggacatttgttcagaggttacttactggtacacagtgagctgtgagcacaagaagggccatcagaatcaccaccttcatttttctttatctacaagaaaagcaagtgtatcattgccatcagttgaaattaagtcacacggagtagctcaggctagctgaaactcaggatctcctctccggagggcttctgc

SEQ ID NO: 218 - DNA, 3145 bp, Mus musculus
tgatagattcagaagctctgtgaccgcgtagcttcctctacgttactggatgaccgaagaaatgctgtacgtgcccttaaatcactctctaagaaataccgcttagaagtgggaatccaagctatggaacatcttatccatgttttacaaacagatcgttcggattctgaaataatagcatatgctttggacacactttataatataatatctaatgacgaagaggaagaactaggtgtttcaagattaatggacttactagcagattccagagaaattatacgcaacgatggcgtcttactactgcaggcattaacaaggagcaatggagcaatccagaaaattgttgcttttgaaaatgcttttgagcgactgctggacattattacagaggaggggaacagtgacggaggtatagtagtggaagattgtttgattttacttcaaaacttgttaaaaaccaacaattccaatcaaaacttttttaaagaaggctcttatattcaacgcatgaaaccttggtttgaagttggagaggaaaactctggttggtcagcacagaaagtgaccaatctacatttaatgctccagcttgtgcgggtactggtatctcccaccaaccctcccggtgctaccagtagctgccagaaggccatgttccagtgtgggctactccagcagctttgcactatcctgatggctactgggattcctgctgatatcctgacagagaccataaatactgtatcagaggttatccgaggctgccaagtaaaccaagactactttgcttctgtgaatgcaccttcaaatcccccacgaccggcaattgttgtgctgctcatgtccatggtcaacgagcggcagccgtttgtgctgcgatgtgccgtgctctactgtttccagtgcttcctgtataaaaacgagaaaggacaaggagagatcgtggccactcttctgccttccactattgatggcaaggaaatgccacccagaaagagcaactgctcagggttcagctggccaccagcatcggcaaccctccggtgtcgctcctgcagcaatgcaccaacattctttcccagagagaaactaaagcaactaatagagaagaggattggcaaagagaatttcatagagaaactaggatttattagcaaacatgagttatattccagagcgtctcagaaaccccagccaaactttccgagtccagagtatatgatatttgatcatgagtttacaaagctggtgaaagaactcgaaggtgttattaccaaggctatttataagtccagtgaggaagataagaaagaggaagaggtaaagaaaaccttagagcagcatgataacatcgtgactcactataagaatatgatccgtgagcaagacctacaactggaggaactgaaacagcaagtctccaccctgaagtgtcagaacgagcagctacagacagcagtcacccagcaggcatctcagattcagcagcacaaggaccagtacaatctcctcaaagttcagctcggaaaagacaatcaccatcaaggttcccacggtgacggggctcaggtgaatggcattcagccggaagaaatcagtcggctgagggaagagatagaagagttaaaaagtcagcaggcgctcttacaaggccagctagctgaaaaggactcattgattgaaaatttgaaatcttcgcaagcgtctggcatgagtgaacaggcttcagcaacatgtcctcccagagatcccgagcaagttgcagagttaaagcaggaactgacagcattaaagtcccagttatgttcacagtctctggagatcacgagactccagacggagaactgcgagctgctgcagagagcagagaccttggcaaaatcagttcctgtagaaggagagagtgagcatgtgagtgctgctaagaccacggatgtagaaggaaggctgtctgctttgctgcaggagaccaaagagttaaagaatgagattaaagcgctgtctgaggagaggaccgccattcaaaagcagctggactcatccaatagcaccatcgccatcctgcaaaccgagaaagacaagctggacttggaagttacggattctaagaaagaacaagatgaccttttggtgctgttagcagatcaagatcagaaaatcctgtcactgaagagtaaactcaaggatctcggtcatccagttgaagaagaagatgaatctggagaccaagaagacgatgatgatgaaattgatgatggtgacaaggaccaggacatctagctttaaaccctaggaatgatagagattacgtcattatgtggaagaagtcttaacagtgctttggtttgcctccacacaaaaaataaagacagaaccaggtggaaacattgactagtaaaactattgatatatgttttttaatattgccacccatgtggaaaactgacttcatgtggaacttttatttatgttcatctgaactctcccaaaataaaatttgcacagggcaccaagctccaaaagtaccccctttgaaggcatgtggtggcaatgcagtttgccatgttggttcactgatggctttcagacactctgtgacttcagtactcacacatttgattaatgtgtattcaatgggagtcatcatttctaagtcagcgtttgagttctcggctgattaatccttgtaaagaaaggactgtacttagggtagcctggggctcctgtatgtcatcccctcaaacccccactgtgcctcccgagatcaggatgggacagttccgagtgagtgcttgccgtccagcggggccacattctgcctactgagaggaaagattgtcccagagtgtggagggcgttctgaggaactggaacagtgtactaatgtggctggttttctctctgtttaagctaaagatggaaaacagattatagtcagcagttcatatagctgggatttagaattgtttgattatcataaaacatgttcttagttttaaaaaatcccacactatgatttatgtaatttattggcatttttgctgaataggtgtaagtcagataatagatttttaaaaagcaaatgaagcaatgtgtcaaagtctaatgttttcataataaaaatagatattatgttcactta

SEQ ID NO: 219 - protein, 758 aa, Mus musculus
IQKLCDRVASSTLLDDRRNAVRALKSLSKKYRLEVGIQAMEHLIHVLQTDRSDSEIIAYALDTLYNIISNDEEEELGVSRLMDLLADSREIIRNDGVLLLQALTRSNGAIQKIVAFENAFERLLDIITEEGNSDGGIVVEDCLILLQNLLKTNNSNQNFFKEGSYIQRMKPWFEVGEENSGWSAQKVTNLHLMLQLVRVLVSPTNPPGATSSCQKAMFQCGLLQQLCTILMATGIPADILTETINTVSEVIRGCQVNQDYFASVNAPSNPPRPAIVVLLMSMVNERQPFVLRCAVLYCFQCFLYKNEKGQGEIVATLLPSTIDGKEMPPRKSNCSGFSWPPASATLRCRSCSNAPTFFPREKLKQLIEKRIGKENFIEKLGFISKHELYSRASQKPQPNFPSPEYMIFDHEFTKLVKELEGVITKAIYKSSEEDKKEEEVKKTLEQHDNIVTHYKNMIREQDLQLEELKQQVSTLKCQNEQLQTAVTQQASQIQQHKDQYNLLKVQLGKDNHHQGSHGDGAQVNGIQPEEISRLREEIEELKSQQALLQGQLAEKDSLIENLKSSQASGMSEQASATCPPRDPEQVAELKQELTALKSQLCSQSLEITRLQTENCELLQRAETLAKSVPVEGESEHVSAAKTTDVEGRLSALLQETKELKNEIKALSEERTAIQKQLDSSNSTIAILQTEKDKLDLEVTDSKKEQDDLLVLLADQDQKILSLKSKLKDLGHPVEEEDESGDQEDDDDEIDDGDKDQDI

SEQ ID NO: 220 - DNA, 109586 bp, Homo sapiens
  misc_feature (1)...(109586): n = A,T,C or G
caacaaaagtgaaactccatgtcagaaaaaaaagaaaagaaatgataaagcaaatggggtaaaaaggttcaccttttgcaatctctctgcaattctgaaattagttcaatataaaaagttaaaagggtagaagaatgggaaaggcacactcatttgtagatactttttccccttcacctttgccccttttcttgcccagaataagaaatgtgatgctggagatagaacagtcagcctgtaacctcaggccaaggatgcctgcacagaaaaattccagcttgcatccaagctggcatcctacagcctctgttgttagtcctgcactgcctacctcctaatttattcaagacactctttagtttggtgttctattgcagcacgtggtaatccaattgatacagcaaaattaaataatttgcccaaggttacagcagtccaaaagtggcaacatctgtctaggtttgcaaagaaaacatgcttttctggtctgtatcatgctgaagtctaggcttctctctctgtgaaacaggaataagaatttctagcagtccagaacgaaaaacacacagaagactgcctatggcagggcctggcacagaggacagaggctcaaatgtttgccgaatcaataattcaagaaaccaagcacatctgttttcagtattctggtatactgagctattttaagtactgaaggaaaaaaaaactgtatttatgtgggtgcaatactctagctgctgcagatattagtcagcaatttcattcagtttcttggatctctctcacactcgatcctcactgtatccttcacagaaatccttctaccctctctttgtccatcagctcctgcaactcatgtccccatcaaaggggcagagtatggatcccatgtgaaaagctctctgaacacagtggcttactcagctggggcaggcaagtgttagaccacaagaaggaccatccttcccaggttgtcagaaaaaaatcaaaactgctgcaccaggaaggcctagcctctggccagagctaagcagctatccagaggctgaggctcaaaaagcttcatgcaacagagttaaaggtgcaggaaagaagacactgaaagctaatcaacccatcagccatgccccggggcttttctgaagttgatagcaatcactaatatatgttaaaatgaaatgtgttaaatacttcctttcactgattggttttaaatgggacaaattacgaactttttaaaaaacaaagatcctggtatttattacaccataaataccaaaataccagtatagtcatttttctctgacccagatactagaacgagacctagatagcagcaccctcacatgaaggagaccggctgctgcaataacctatacagaccttagattctgagctttttaggagtcaatactcacatacttgggaaagagagagcacatctaggactagggtctaggtcactttgggtcacagactttgtgcccctgtcctgaaaaggtcatgtgtgtaggtattggaggtggggagagggcagtgggaagggcaagttggagcttttctagttcttttttttcccctggagacacagtattgctctgtcactcaggctggagtgcagtggtgcaatctcagctcactgcaacctccgcctcacaggttcaagagattcttgtgtctcggcctcccaagtagctaggattacaggcacgtgccatgatgcccagccagctaattttttgtatttttagtagagatgaggtttcaccatgttggccaggctagtctcaaactcttgagctcaggtgatctgcccacctcagcctcccaaagtgctggaattacaggcgtgagccaccacacccggccctcttctagttcttgtttttttttgtttttctttgttttgtttttgttgttgtttttggagacagagtttccctcttgtcacccaggctggagtgcagtggcgcgatctcggctcaccgcaacctccgcctcccaggttcaagcgattctcctgcctcagcctcccgaatagctgggattacaggcatgcaccaccatgcccagctaattttgtatttttagtagacacggggtttctccatgttggtcaggctggtctcgaactcccaatctcaggtgatccacccgccttggcctcccaaagtgctgggattacaggtgtgagccactgtgcccggcctcttctagttctttataccacccacaactagtatggtgtttgtgcgatcctgtaaggaagcatcaggggacagaggccaaacagaagacttctcttctttgcctctttgtacttacaatcttctcatcttccatccctctgcccatggactcctaagctactggcagaaaattatgtccacacccaactacctctccttttcccaaaccacctgcctatgccagttctggaccctccacataacatctgcaggttactgagcccatcctgattatctccctagtgtatttgtcaatcacaggccattggcatcttaaagtcaacttcattaaaaaactggaattatggccgggcatggtgactcatgcctgtaatctcagcactttgggaggctgaggcgggtgggtctccaggagtttgagagcagcctgggcaagacggtgaaaccccatctctacaataaaataaaataaaaattagctgggtgtggtagtgcacacctgtagtcccagctacgcaggaggctgagatgggaggatcgcttgagcctgggagaagggggttgcagagaggggaccttggaagtgtgggctgactttggaaagttttggtccaggtcagctaccatctgctggcctggaggcccagtctgatctcaagagacaactctgtcactccctcctgccacaaatacttgcttggggcatagcctcaggcaaatgacagagatcagctgccaactactctaaaatcatagcttgctgggaagttggcaatgactccattaaaatcatcttaagcttacatggaatcttggcatcacccaatgcgaacttcaaaggctttggtctagctattgaatgggacagtaaagactgcaaccctaccctggctattcaggacatacttgttcagctggcttgaggtgttgggggagagacaatggtgttgggaggtaacagtcaaattctccacaagaaacagtgctagggcctggatctgataaacttgtccctcgataaacagttttataaaaagtcctttggccaggcgtggtggctcatgcctgtaatcccagcactttgggaggctgaggcgggtgggtcacgaggtaaggagatcaagaccatcctggccaacatggtgaaaccccgtctctactaaaaatacaaaaattagctgggtgtgctggcacgcacctataatcccagctacttgggaggctgaggcagaatagcttgaacctgggaggcagagattgtagtgagccaaggtcgcatcactgcactccagcctggagacagagtgagactccgtcgcaaaaaaaaaattacaaataaaataaataaataaataaaaataaaaagtcctttggaaatgaaaatgggatttcctaatttaggtgtttcttctttctttctttcttttttttttttaggtgtttcataagtaattctgcttattgtattttcttaaaaatggaaacacacctgggttatactttctttaaaaaaagggtatagatttgcttgctgatttaagtacaatgcaatgtcaaattacgtttattaaataatgtaacatgatcttttgaatctttgcagagaggcagaacttatgctagcatacactagtgataaggctggaaaaataatttcaaaaaaaactggcaagcagtttaagtacgttaggggatacagtgagcatgtattgtttttcttatcctgataaacattctcctggcatactattccagatttcctaggagaaatgtgaatgtccctgttccccagctcctatgccatatgctttgagatgagatgaagacttctactccttgctttagaggtgggaatgtgactcaaggccaatcagaacatctcaaaccttaaactacaggaattagctcaccacataggcatgcgaccctatcaggtaaaatgagtcacaaggagacttttgctgggactcttaggagagaggttgggagtctttgatgaacttgggcctaggatactaggactataggtcctggcagccatcttgccccgcatggagctagagaaaaaaaaacaaaaacagttaaggagagcagagtccagaaatagtggaaacccagatcacagggaaattggcttgataccccagattaagcctcatctgaagtaacagacttctcagtaacatgagctagtagggctggagttgaagacttacagggtaatatctttaaacgttcagttgttaagaaattgataataccgtggctcacgcctgtaatcccagcactttgggaggccgaggcgggcggatcacgaggtcaggagatcgagaccatcccggctaaaacggtgaaaccccgtctctactaaaaatacaaaaaattagccgggcttagtggcgggcgcctgtagtcccagctacttgggaggctgaggcaggagaatggtgtgaacccgggaggcggagcttgcagtgagccgagatcccgccactgcactccagcctgggcgacagagcaagactccgtctcaaaaaaaaaaaaaaaaaaaagaaattgataataccgaagatgatcagggtctccactctaatcattattgagtacttactatgtttcaagtactaagtaatatgaacgttacagatattatctaataaaatcccaaaaacaaccacaggaggcaacaattaccattcctttaaaaaaaagtaaagcaggaactctgggctctatagcatgtgagacacctcaactattccaagtccttaccttggtctcatttcttttttgagacggagtttcgctcttgttgcgcaggctggagggcaatggcaagatcctggctcactgcaacctccgcctcccagtttaagcgattctcctgcctcagcctcccgagtagctaggattacaggcatgcaccaccacgctcggctaattctgtatttttagtagagacgggatttctccatgttggtcaggctggtctcaagctcccgacctcaggtgatccacccgcctcggcctcccaaagtgctgggattacaagggtgagttaccgtgcccggcctggtctcatttcttatctcctgagagaggtagctgtccaacattttagcctctgaatctttttgttcaagcgaaacaggaagtataaacaaatgaaaccaatcaaatggagcaggatgggggggcccagaaccctttttttttttttttttttttttttgagaaagggtctcactccgtcacctgggctggagtgcagtggcacaatcttgactcactgcaacttcaagcaattctcatgcctcagcctcctgcgcatagctggaatgataggccaccacgcccagctaccaaaaccttctttcttggactctcctctcccaaggatttcctaaggcttttaaaaatattttgagggcgccgggcgcggtggctcatgcctgtaatcccagcactttgggaggccgaggcgggcggatcacgagatgaggagatcgagaccacggagaaactccgtctctaccaaaaatacaaaaaattagccgggcgcggtggcgggcgcctgtagtcccagctactccagaggctgaggcaggagaatggcatgaacccaggaggcagagcttgcagtgagctgagatcgcgtcactgcactccagcctgggcaacagagcgagactccgtctcaaaaaaaaaaaaaaaaatattttgagggctaggcgcggtggctcacgcactttgagaggctgaggcaggcggatcataaggtcaggagatcgaggccatcctaactaacacggtgaaaacctgtctctactaaaaatacaaaaaattagccaggcatggtggcatgtgcctctattcccagctacttggaaggctgaggcaggagaatcgcttgaacccgggaggccgaggttgcagtgagccgagatcgcgccactacactccagcctgggtgacagagcgaggctccatctcaaaataaataaataaataaataaataaataaataaataaataaataaaaatattttgaagcctggggcagttggctcacacctgcaatcccagtattttgggaggctgaggcaggagaatagcttgaggccgggagtttgacatcagtctgggtaacatagcaagacttcatctctacaaaaaaaaaaaaaaaaaaaaaattagccaggcatgatggtgtgcacctgtagtcctagctactcaggaggctgaggcaggaagagctcttgaacccaggagttccaggatgtatgtgccaccacgccgagctaattttgtatttttagtagacaacggggtttctccatgttggtcaggctggtctggaactcccaacttcaggtgatccgtccacctcagcctcccaaagtgctgggattacaggcgtgagccacctcgcccagcctcaactagtcttttttttttttttttgggacagggtctcactccatcctcccagctggaatgcagtggcacaatcatggctcaatgcagccttgatctcccaggctccagcgatcctcccacaccctcccaagtaagtgggactactggctgggaatacaggcgcatgccaccatgctcagctaatattttattttttgtagagacagggttttgccacattgcccaggctggtgttgaactcctgagcttaaatgatcctcccaccttggcctcccaaagtgctgggattatagccatgagctacgtctttaaaaacctatatacgatactgaaggggcttataacctagcaaaataataaataaataaaaacctatatatgatagatttcaaatacaaatgatcatttatatttatcctcccaagcaggcatagacaacattccaccttactaccaccccaactaaaaaacaatcttatgcaattatatttcgttgtttttgcgagttttccactagaaagttaagtgggccactgaaaaaagcaatttgaaaaaatgaatttcaaaccaatgaattttgttcgttgatctattgtcaggtttggtttagaaaaagatcactcttaattttgattatatgtattttaatgattcataggactcttatcctgaatgcttagatttatgaaagccagaagtattaacagtgcaagtcaggccgtcacaatttgttcaagttttctcttcctttattaactcaggtagttcctgagcatctaccatattaaaggaattatactagatgattaaaggatgcaaacaggaatacaacacagtccctgacttttctccctctacaaaatcagtagaagtggattaatatgtaactcttcctctgaaataaggagtctatttcatggttgttctgtagtgacaatgcctcggggatcccaccttcatcacctttgcacccaactgtccatcactcctgtgcaggggatgctgctggggaagaaaacaggtcaaatgcagggaaaattcatagtaagctgttactactacactcacgaaagtatagtaacctactttactcactgaagtacagtaacctactgtacccaccaaagtttaaaacaaaacaggacatttgacaaggctggtgcctttaaacaactttgctaaaatgtcaaggcactctttttaattattaaataagaggagtaatagacatttgtggcccactccgtctatgagcctcattcctgatgatggggtagagtgagtttcagggacaaggtgaagtgaggttcagggaggggtgaggcttaggggcttaagtgaagttctttgcatgcatttcttagtaacaaaaatgctgagtaatttactggttactttttttaggctgcaacaaaatgctcccatggaaaatgtctacggtaaaatgtcaagtgtatagctttaaagcagaggacaatgcttagcgcacagtatttttggcagtatgaccccaccattctccaagttgcccaggcttaaaatgttggcactaggaaacacatagcttatgatgtcttccctacaatttcactttacagattaaaaaaagggaacctcctcttagtataatattcatatattctttcaataatttattcatttatccatcaatatcaccttttatgagacagtggtaagcaacagagatataaaatgaataacatagtcctgcccttaacagtttggtttagcaagcatttattcaatgtacaccatatacagtatcaataactgcaaagtgctaacatatagatgtgtacctacattttagggaaagctttcaagaatgatgtcagagttgagtcttaaggaattagcaggagtttgcttgatgaagagaaaggaagggaagggcatatccaggtctgagaaaaatgcccagagtatgtgggggaggcaggagctgaaaaagtaggcaggagctaaatcataacaggcctgtatgacaaactaaggagtttggactttattctggacagaatggggaacaactggaggattttaagaggaatgacatgaacagatgttttgttgttgttagtctcacccaaggatggactggagattggactggaaggaagccagggctgaatgcagacaaactaattaggaggctgttgctgtcatctcaatgagaaatgatgagaagaacataatctatgtcacaggcacagaggatggagagcagaacacctatttgagaaatattctataaatagaaatgataggacatgactattgattggacatgtgtgggtggaaagccagagtctaagattcttcccagcttcctctgtctagcttaggcaattatttggacagtggtactactgagcacggcacgcacacagtagaagcagcatattgactttttttctttaagggaggcagggaaagatgacgagttcaattttaaatgctgaatctgagacctgtggggaatccaaggggagaggtgcatgagtcagttagctaactagacctgtgctttttagcctcaagaaatttacaagactattccagaagcatgtgtactgacaacctcactgccaaaggaacaggcataccaattagagaaaatgacaatttttcatgttaaaaaaaaaaaaactgaaaacacaggggttgagagttaataacgaaacattatgttactcgccaaactgacacagcagaacaatgtatttctctagtaagctaaatgtagggtttgatgggtttcctcctgacgacacttgaaaatagaggtgtacctggtgtttagatctaggaattcctttcagcaggtttgaagagcaagagctgagaaatgcgccctccagtggcagtggaatgaggggtgtctagtaaccctttttaccaccaaacaaagccctgtaaagaaatgcaatttaccgggatcagaaagccacaatgctggtaccagtaaaccgtcaaaccaagcgaaccctctcaggcgccaggaagccttacctgtcacgttggccaaaggaaaatttcactttcgactcaacaaaataagacctcagatttgatagcttgcagtaagtcccgcttggcgacgattaaacaccctgcaagtcgaaacgcgtagtctaatcaaatcctctccagcctgcagggccgggcttccaccacgtgggtggctgcggccagcaggatcaatccgcgaagggtgggggtaggaggcgtgcccctgcggtgggaggcggggtctgcgcagtgggtggggcttcggcggaacctagctaagaggttcctctcgcctccgctccccttttgccttcaaccttcgagccgccacgtaatgccacgtccccgcgcatgcgcatcttggccgctgctggcggctgtttccgggcttagagggctggagtggccgccgagttggaggcggtggtggcagcagtaggagtgtgtagagtgcgggattgggggccaggccctgcggagggcgggggaagttgtcttcttttttttccggaggggccggtaaacctggtggctgaacggcaagatgaatttcctccgcggggtaatggggggtcagagtgccggaccccagcacacagaagccgagacggtgagaggagcagcgggtctgggacttgggaaggggtccgggcagggacggggacggagcactcggagacccgaaggtcacctccagcgtcccaccatggaggggggatccacatgccgcctccccctttgccctccttccgctcctgaaatcccagagttattcaatcacgcccccagctcagtccccattgctgccgttcggccggactgacggcggccgcgccccgcagctctgtaggccctgaagctcgggctaggagagtggtccgcaggtggtaccgcacgggaagggacggatgcgcggccgagctggcccgaactgcctcccacgcccctcggggccgtgggcccctccctctttctctttcgctcgtctgcactggccgagaggagcctgaagtcctgctccctccctcgcagtctgaaactggggcgttggggaaaactgcgagaaggtttaaaacccagctgttggtgagagcatttggctaagaataaaacgatattctttgaaggacaaatccacctgctcctgtcccatcaactggaagagcggtcgttctgcctggtgttatttgttcagatccggcttttcgggctcacccaaatatatatcatttggcaaatgctaccttgaacgtagtagggatcttaagcgctcaaactgctttggggacacgtccaccgctttctgcctgaactcctaatgacatgatttgcggcgttatttaaaaaaaaaaaaaaatggttagccgctgaaaacattatttaatagttgcttagattctaggtttagaatacacttattttgaagtttggttagtgtttaatggaatcgagggtgtatgcctttttgaaataaactttttatttgagaagaattttagatctacataaaagagactaagtataacactttaatggctaactttgttaatgggatcctgagggataatatagtagctttcatttgtcaggctcttaccttgtgctaggttctgtgctgagctctttatattccacattatgctttaatcgttaactaccctgcaagataggtgagagtattctcaccttaaaagtcaaaaaatgagactgagaggggtgaagtaggccggacgcggtggctcacgcctctaatcccagcactttgggaggctgaggccggcggatcacctgaggtcgggagttcgagaccagcctgaccaacatggagaaaccccgtctctactaaaaatacagaattagccggccgtggtggcacatgcctgtaatcccagccactcggaaggctgaggcaggagaatcgcttgaactcgggaggcggaggttacggtgagcagagatcgtgccattgcactctagcctgggcaacaagagcgaaactctgtctcaaaaaaaaaaaaaaaaaaaaggggtgaagtaacttgaccaatgtcacactgctaataatagagccaggattcaaccaagaggtaccttacttcaaagccttcactttattgctcatgcctgtatttcaatactttttgggaactttatatagtattactaaaattaactgcagctagtcgcagtgacacaggcctataatcccagctaaggggatgctaagccaggaggatcgcttgagcccaggagtttgagactagcctgggcagcatgaagagactccatctcaaaaaaaaaaaaaataactgcgcaggtctggttagaattgtttaaagcataagatgaaagccggtaaatctgtttctttcatttgaaaatcacttttctgtctctcactgtaacacacgcacacatttggcttcactcatccattcccacttggcaacaaggcagcctgagctaccctactagaagatcatgttctgtctagattaccagagtcataccataatcacagcccaccacttttttgtctgatatttgtgtttgtggcaccaggttatgaaatatggtttattacagcttgctttgtggagttagactttgatttgaatcctggctttccacccctgattggattggatatgtaagagatagctaataccctctaagtaaaatgaggaaaatgcctgctttttaggatgtaatgaagattaagtgaaataagtagaaagagcctggcacttagtagatgtataatgagaggtaatttttactatgtgtgggttgaacgaagaataccctttcctgtttttgttattattggccttgtcacagtgacttctgtagaaaagatggaatagaattcacagtgtataggattttaaagctagaaagtcccagatagagcctcttcattttatagtcacagagcactaaagtagcttgcacaaggttgaagagttggagctagaacattttgatcttgccactgtggatggaacaacatagtttttatatcacaatttcaaagtgaaacttgagtatcacttgcgtatgttgtatatataaactgaaagggtcctttcttgttcttgcctaactttgagtatgtacatttaaaattggaaaagtaatttgtcttctattttttctttttaatcacctccacaataaagcaatttgccttctgaaaattattattctgaggtacagtatgaataaaatttgtttcactatttcgttccaccaggaagtacaacaggtaaaaggggtcatggattactaatttagaagtatttatagagcatcagtggagtgtatatacaattttagatgttttaattgatgatttagtctggccaggatatttgagttaccagagcttggaacccctagcttctatattatcatttattattttgtagttttttccatttctgcaaaattaaatttttttcatggtggctttccatctttcttgctttttctaacatcttttttccaatggaagggctcttttctttgtctgaattagacctgttatttaaattcatcatcagcgcctcccctaatctgtactttcccccagcacgtttcagatgctttttcctttctgagctacctttacattttaactacagtgtgcatatatcttattccttctagactcttaaaagtgtctttagggcagggttcataatgtattttaatctttgtttttccacagtagtagatgcccagtaaatacttgtgaaatgaattaattatagttttatttgaaagaaatcacagatctgtaattatagcaacttacgttactaggtactaaaacactttttaaagactagaaactgaagttctcaaatgaagttcattgtgtcaagctttttacttaagggattttttcatatttactaaatgctttgactgctttcttgtttttttttttcttattgaatttaagtatcttttaaatgtgtgagagttatgtgattgattgtatagtatctagcttttcatactcttagttaagagtaactttggactgatattaagatgttcttcaggccgggggctcacgcctataatcccagcactttgggaggccaaggcagatggagcacttgaggtcaggagtttgagaccagcctggccaaactcctttctggagtcaagcacatttttatggtgaaaccctgtctctactaaaaatacaaaaattagctgggcatggtggcacatgcctataatctcagctactcaggaggctgaggcaggagaatcgaggcggtggttggcagtgagcaaccactgagtggttaagattgtgccactgcattccagcctgggcgagagagcgagactgtctcaaaaagaaagatgttcttgagaacctgtcaagtagtaaatattttatcataggatagtcaattctataaagtactggatattttaaattcagaatttcatccacattaaactttttctgttttagagtcatgtacttttgtttttgtttttgttttgttttgttttgagacagagtctcgctctgtggcccaggctggagtgcagtggcgcaatcttggctcactgcaagctccccctcccgggttcacgccattcttctgcctcagcctcccaagtagctgggactacaggtgtctgccaccacaccggctaatttttgtatttttagtggagatggggtttcaccgtgttaaccaggatggtctcgatctcctgacttcgtgatccgcctgccttggcctcccaaagtgctggaattacaggtgtgagccacggcgcctggccccagagtcgggtacttttacatttcatttctcttttttacttgacactgatttctggtgattgaagcctctttagccttgacacagtttgctgggtgcatattattatagtacaaatcctactcatgcttttgttttttagttttctctttttccctaaccactagaccaccagggacttcatgcttttgaatgtaagcttatgtgtgcttagtgttatatctgccttctatctagcaccttttttttgggtaggggggtggggtacgatgtctcgctctgtcgcccaggctggagtgcagtgacgtaatctcggctcactgcagcctccgcctcctgggttcaagcagttctcctggctcagtctcccgagcagctgggactacaggcgcacgccaccacgccaggctaatttttttgtattttagtagagacagggttgcactgtgatgcccaggctggtcttgaactcctgagctcaggcagtctgcccgcctcggcctctcaaagtgctaggattataggcgtgagccactgcgcccagcccccaacttgtaccttttttaaagctagtttcttgaaaattccaagcaagtgttaactacatttgatgatgaatcatagaggcattttctgttctcaagttggaccccgagacatgaaagttgctaatgtccagaaaaagcatacagaattagaacattgttatggggtctctttccagatcaaactttcatcagctgtctcagaaagcagaagggctaacaatataaacacagccatattttcttttaataaaaattgttattaaagagtgtggacttaaatttagacatagttttcgtttagtcaagcacattttataccatgttactataaatgtgtagtctgaaattcctatttgggttgatgtattctacattaataaccaggtcaatgtcataactggaatgtgttttctctcttggcctgttttgcaataacaatgtcggagagaactgtaataatgatttgtgttttggtcatttctatatcgaagcactctttttaagtagggcctattgaatactacatggctttttggaaggttaattttgtagattatatagggttcatttaaaagttagaatcatttaaattatacatgccgtagcattaccaaggtatgcttcaaaaaatttgaatagatgtccatgaaaaaaattttgtcagcaaagaagtgtgtgcaacgaccactaacaaagaaaaaacctctagtatttatgcaaggttttgtaagcaggcactgtgttatagtttcagatatttttaaaatgtagataaaaagtaagctgtttgccaaatttatctgaccagacctttttttttcctctagggaactttgttatctattattttgagaagcatacttagggaaaaattgtccaagaggatatataattctgatgcctttttctttattttcctttatttcattaaaaacattactcttgaatctgattaggaaagaatattagaattccttatatacatttgttgataccaaatactgttcctctttctttttatgtatttaccttttattattaatattactgctttgtactctgctttttgtctgttgtaggtatagtaaagttatgcttattatttttatacctcaagcagaagtgccataaacattttttgtgtcaaaagttattcaccattaatttgaaaacttttttgtttttttaaagagacaggctcacaatatgttgcccaggctggtcttgaactcctggcctcaaacaatcctcctgtcagcttcccaaagtgctgggattacagaaaaacttttgtggtgttagattttgagatgctagcatttgtgataggttatttggtagacatgtttcattatgaccccttgcttaaaacgatgtccttttgaaaagcatagttcatttatgggaaagagcatggagaataaatgaagcagtatattacttggctgacttaaggtaactataatggaaatggattcattggatttgtctacaaagagacttgtgtttgattttttaatgttcccacatctctttttatagattataataatttaggtcatatgaagataagatttgcttttgctgttttaataaagtcttctcagtaacagagttaaatttaaaacaaatttctgggccaggcctggtggctcacgcctgtaatcccagcactttggtaggctgaggcgggtggatcacctgaggtcaggagtttgagaccagcctggccaacatgacgaaaccctgtctctgctaaaaatacaaaaattagctggacatggtggcaggtgcctgtaatcccagctactagggaggctgaggcaggagaatcacttgaacccaggaggtggaggttacaatgagccaagatcgcaccactgcactctagcctgggcaatggagtgagactccgtctcaaaaaaaaaaaaaatgacttttgtaatctaaaacaataatatttttatttcatctaaaacataagtgaattgactattagcatgaattatttgtcttacagttagggaaattctgttttaggaaggtacaactatgttttaaatttcaaggtaagattatatcataaaattaaatcaatattaggtgcttgacaaatatttgttggataaatgattgattgattagagttagcattttaattgccattcctgttctttattttttcctgtcagttaagtagttactgaatacttaaaaaaaagaattgtgaaaaaatactgcaagctgtattacactagtgtcctttaatttttttgcttttatatttttataaacgattaaacgtaaattagtattgtttcataagcaaatgtgtttatgaaaataaacatttctctaaacaatattttttccccataactttaaagttttagaaggttacatgtgcaggttgttacatgggtaaattgcctgttgctaaggtttgatgtataaccatcacccaggtagtgaggatggtacctgatgggtagtttcttaactctcgccccctctcccaccttccccccgttgttgtccccagtgttgactgctcccatctttaggtccgtgcttactcattgtttagctcccacttgtaagtgaggaaatgcagtatttggttttctgttcctatattaattcgcttaggataatggctaccagctgcatctatgttgctgcaaagggcatgattttattctttttcatgtcgacatagtattccatggcgtatatgtactgcattttctttatccagtccactattgatggacacctaggttgactccacatctttgcagttgtgaatagtgctccagtgaatatgcaagtgcatatggctttttgatagaatgatttatttttctttattttcccttatttcattaaaaacattataattgaaatgactattagcatggattattttagtcttacaataaatagtcatagttactggacgcagtggctcaagcctgtaatcccagcactttgggaggctgaggcgggcagatcacgaggtgaggagatcaagaccatcctggccaacatggtgaaaccccgtctctactaaaaatacaaaaattagctgggcatggtggcacctgtgcctgtaatcccagctacttgggaagctgaggcaggagaatcacttgaaccagggagttggaggttgcagtgagccaagatcgcgccactgcactccagcctggcgacagagcgagattccatctaaaaaaaaaaaaaaaaaaaaaagtcatagttgggggagttctgttttaggaatgttttaagcttcatgaaggtaaggttatatcataaaatcacgtctgtagggccgggtgcggtggctcatgcctataatcttagcactttgggaggccgaggtgggcagattacaaggtcaggagttcgagaccagcctggccaatatggtgaaaccccgtctctactacaaatacaaaaattagccgggcgtggtggcgggcacctgtagtcccagctacttgggaggctgaggcaggagaatagcttgaacccaggaggcagaggttgcagtgagccgagatcacgccactgcagtccagcctgggcaacacagtgagactctgtctcaaaaaaaaaattaaaaaaaataaattaagtctgtattagctgcatgacaaatatttgttgaaaaaatacagtagtgagactgctgggtcgaatggtagttctgttttaagttctttgagagatatcccaactgctctctacagtgactgaactaaaattacattcccaccaacagtatatagcattcccttttctctataacctctctaacatctgttttttgtttgtttgttttgtctttttaataatagtcattctgactggtgggagatggtatttcactgtggttttgacttgcatttgtcagatgatttagtggtgtggaacatttttccatatatttcttgcctatgtatatgtattgtttggagaagtgtctgttcatgtcctttgcccattttttaagagtttttggtttttgcctgttgaattaagttccttacagattctgaatattagacctttgtcagatgcatggtttgcagatgttttctcccaggttataagttgtttgtttactctgttgatagtttcttttgctgtgcagaagctctttagtataattaggtcccacttgtcaatttttgtttttgtcacaattgcttttgggcacttagtcataaattctttgccaaggccaatgtccaggatgatatctcctagattttcttcgaggattttttttttttttttttttttttttgagtaggagtctggccctgtcacccaggctggagtgagtgcaatggtgcgattggctcactgcaacctctgcctcccggattcaagcgattctcctgcttcagcctcccaagtagctgggactacagatgcacaccaccacacccagataatttttgtatttttagtagagacagggtttcaccatgttggccaggatggtctcgatctcctgacctcgtgatcctcccaccttgacctcccaaagtgctgggattacaggcgtaagccaccatgcccagcctcttctcggctttttatagttttaggtcttatatttatgtctttaatccatcttgagttaatttttgtatatggtaaaaggtaagggcccagtttcattcttctgcataaggctatccagttatcccagcaccatttattggataggtagtcctttctccattgcttgttactgtcaattttgtcaaagatcagatggttgtaggtgtgtggctttagttttgggttctctatcctgttccattgctccatgtctgtaataggctgttttggttagtgtagctttgtagtatagtttgaagtggggtagtgtgatttttccagctttgttctttttgcttaggattgctttggctgttcaggctcttttggttccatatgaattttagaatagtttgttctaattctgtgaaaaatgacattggtagtttgataggaatagcgttgaatctgtagattgctttgggcagtatggcttttttttttttttttttttttttttttgaattagagccttgctctgttgcccaggctggggtgcagtggcacaatctcagctcactgcaacctctgtctcccgggttcaagtgattctcctgcctcagcctcccaagtagctgggattacaggcacccaccaccacacccagccaatttttgtatttttagtagaaacagggtttcaccatattggccaggctggtttcaaactccttgcctcaagtgatccacccgcctcagcctcccaaagtgctgggattacagacatgagccaccatacctggccccattttaacaatattgattctttgatccatgagcatgggatgtttttccagtggtttgtatcacctattatttctttcagcaatgttttatagttctctttgtagagacctccttggttagatgtattccaaggttttggggtgtgtgtgtgtgtctgtctgtctgtctagggtaaatgggattgcattcttgatttggctctcagcttgaacgttattgatgtatagaaatgctactgatttttgtacattgattttgtatcctgaaacattattgaagtcgtttatcagctctaggtgccttttagtggaacctgttgggttttccaggtttagaatcatattattagcaaagagatagtttgtcattttttcctattcggatgtcaattctttctcttgcctgattgctctgattaggacttcctcctttaaattttaagtgtactttcaccatcctagttctatgctgtcttctttttaatcttttgatagtttttctttttttggaaacagggtctcactctgttgaacaggctggagtgcagtggtgtgatcacgtctcacttcagcctcaacctcctatactcaagcaaccttcccacctcagcctcctaagtagctgggactacaggtacaaggcaccacgcttggctgatttttaattttcttgtagagacagggtcttgctatgttgcccaggctggtcttgaattcctggactcaagtgatcctctcaaagtgctgggattgcagccatgagcccctgcacccagccagtagtttttcattttcacattcctcatctcagttttttctttcctagtcactcctgttcccattgtgtcttttttggtcatctttgtgtagcaatgaatataaataaatagccctattggctagcaaaaaatgttttttttaattgaccagttgttagactataattctgattatgcccaatttaccagttgttaaatggattgtttgtcattttcatgtttcccttggtaagtgaaattgtgaacatcatgtagcaattatcattttttgattttacaaaatggcagacaaaatgagtaaagtttaagttctctttactcctgtcaccaatttcagttctctttccagagataaccactattactagtttggcataaatccttccagacctttatacgtaatcatgcctctgtgtaatatacaaatatatatttgtattagcatatttattcttatttacataaatggtatactgtttattgtgttctacagcttaccttttttttttttttttttttttttttttgaggcaaagcctcattctgtcacccaggctggcgcaatttcagctcactgggttctcagctcacctccgcctcctgggttcaagcaattctctgcctccacctcccgagtagctgggattacaggcctggctaatttttgtattttcagtagaaatggggtttcaccatgttgcccaggctggtctcgaactcctgacctcatgtgatccacccaccttggcctaccaaagttctgggactacaggcgtgggccaccgcgcctggccagcttacctttttcattgatgtgtttggagatctttccatgttaaaacatacagaggtactttaaaataccagattttcagttacttttgttaattacactaaagtctcttctaataaactgtaaaagcttcttgataatagaatccatgtcttattcattattatgtttctcagagcacctaatacctagttagcataatatagattagtcaaactgtctcttttttctactgtcattcctttctggtccttctaaataaaacagtgggctaaattgtactcatatatgtttctttttcacttttgttaatatatagtattctgttgtttaacacaagggtcacaaattcaaagtccagttggggaggttcaatgtagctggtcaggtcatagagaaggcagaggtttgggatgttactcgagcctgcatatcctgatttgaggatgtggctagtgctcaaatccagccagttattgcctcatgaaatgttggcccagagaaccaatttaatgtagtgggaaagcactcaaactacttggctgaatgctatctcactacttactttataaatgtggacgagttacttaaccactgtgcctctgtttcctcatctctaaaatataaatagtaatattgcctatcttactgtttttgtgaagattaaatgaatttcaaaatgtaaaacacattaggacagagttagcacatagtaattggcatagataccacattttaccaattctgagatgcacattagcatgtaaacctctttgaaatcaggatacatcttgtaattataactgggggtatttcttttttcttcgtgatttcattaaaaagatggggggtcttaaaattgatggcttcttaaattgtacaaaataagagtgttagctaccattagctgtcaggctgatgtttttcaagaaaagatacaaatttgaagctgagctctgtgttgcatgcgtgtagtcccagctacttgttagactgaggtgggaaaattgcttgagctcaggagttcaaggatatagtgagctatgaatagtgccactgcactccagcctgtacagcagagcaagaagatcctggctctaaaaaaagaacagtgaagaaaacatagaaatctggatttttaaatgctggcttaaaatttattttaaatgctgtatgagtcaaatagatttttcaaataatatagtaaatataatacattattattattattattattgttattttgagtcagaatcttgctctgtcaccgaggctggagtgtagtggcgtgatctcggctcactgcaacctccacctcccaggttcaagcgattctcctgcctcagcctcctgagtagctgggatcacgggcatgtgccatcacacccagccaatttttcacttttgtatttttagtagagacagagtttcaccatgttggccaggctggtctcgaactcctgaccttgtgatctgcctgccttggcctcccagagtgctgggattataggtatgagtcattgggcctggctaatacactattattttttaaaattctataatattaagttgggggccaggcacagtaggtcatgcctgtaatcccagcactttgggaggccaaggccggcggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacagtggcttcaacctcctggctttaagcaatcctcccacgtcagcctcctgagtagctgtgaccacaggtgtacaacacaatgcttggctaatttttaaaaatttttaatggagataggggtttcgccatgttgcccaggctgttcttgaactcctgggctcaagcaatcttcctggcctaggtccccaaagtgttgggattacaggtgagagtcactgtgccgggccaagtatatatatatatttttttatcctttaagttctgtcagacctgactggccaagtgtttttttgtttgtttgttttgtttggtttatttttttggagtctcaccctgttgcccaggctggagtgcaatggtgcaaactgggctcactgcaacctccacttcccgggttcaagcgattctcctgcctcagcctcccgagtagctgggattacaggtgcctgccaccatgcccagctaattttttgtaactttagtagagacagggtttcaccaggttcgccaggctggtctcaaactcctgacctcgtgatccgcccgcctcggcctcccaaagtgctgagattacaggcgtgagccactgagcccagccaagtttttttaaagtgttgtaaattttgagcgttaagtaaccttagagttattctactttatctttccattttgcagataatgaattttactttaaaagattatatttaagggacagtccatcctcattatttgtcaatttcttacttgcaaattcacctactcactaaaatatatttgtatcgcacaaatcagtactttgagcactttatggttatttgtagacggtacagcagtgaaaaatttgattctcccaacatacacatctccaattgaggtcaaagaaggtgatgctttgccttcttgtttcagttctcatgctgtaagtgtgtcctttcatggtctgtttagtgttatgctttttgcatttttgtattttatctttttcttttttttttttttttttttgagacagagtctgactctgttgcccagggtggagtgcagtggcgtgatctcggctcactgcaagctctgcctccgcctcccgagtttaagtgattctcctgcctcaccctcctgagtagctgggtttacagtcatgctccaccacactcggctagtttttgtatttttagtagagacagggtttcaccatgttggccaggctggtctcgaactcctgacctcaagtgatccacctcagcttcccaaagtgctgggattacaggcgtgagccaccacacccagcctcatctttgtattgttttgtttgggatttccctattaaaaatagaccccgtgtagtgttgtctggtgttcctaagcacaggaaggctgtgatgttccttacagaggtgatatgtatattacgtaagcatcactgaggcatgtgttatagtgctgttggccatgagatcaatattaatggtcaaggatgtatattaaataagatgtctttggccacatgcagtagctcacacgtgtaatcctagcactttggaagacagaggcaggaggaccacttgagctcattagttcaagatcagcctgggcaacatagtgacacctcatctctaaaaaaattttaaaaaggtgtctttaaacagaaatacacataaaaggttttatattgatcagttgatgaaaatgtgatcagaggcttgcgggaaactaaccctgtattttctctaggaccagtgggttttgtttttagagatggagtctcactctgttacccagtctggagttcagtggcacgactgtggctcactgcagtctcaaactactgggctcaagtgatcctcctgcctcagcctcctgagtagctaggactacaggcactcgccaacatgcctggttaatttttaaatttcttataaagacaggatctagctgtgttgcccaggctgatcacaaattcctggcttcaagcagtcctccttttcggcctcccagaactctgagattacagacatgagctactgcgcctggcctaggagcagtggtttagtattcactaattcagttttcatggtaactttataaaacatagctactgtaaatagcaacaaacagttatattcataaaccaggtgaatagtcaatcaggtggtattttagagtaggtaataaaagcaagatctaatatggaaatttctttaatttttttctctttatttattgaagcaataatggaaatatgcttgctgtaaataatccaaatcagtatgtagtctaaaattgcctctttcttccttcacagtcttacttcgcatcactcgaagtaatctctagtaaagtttggtgtacatccttctacagtgttgtcttttgtatttaccaatatatatatttacacaaatgagtttctttataaaaatctgtaactgtgatagttcttggtagctcagtgtcggggctaaattctgagaaatgcattattaggcagttttgttgtgcaaacatcctagagtgtacttaaagcaaacctagatagtatagcctactattcacctaggctgtatggtgtagcctattgctcttgggccataaacctgtacagcgtgttactgtaatgaatactgtaggcaattataacaatggtaaatatttgtgtatctatgcatctacagtaaaatgtggcataaaagatagtaaatagtatgcctatataggtcgcttaatcatgaatagagcttgcaggaccagaagttgctctggatgagtcaagtgagtgagtggtgaatgaatgtgaagaccaaggacattatgtaaagtatactttataaacactatacacttaaggctacactaaattcattttttaaaattttcttcagtaattgaccttagtttactataactttttaacttcataaagttttaaactttttttaaagctttctgtaataatgcttagtttaaaacacaaacacattgtacgatatttttcttctatatccttcttctataagctttttcctattttaaaatttttactttttaaacttttttttttttttttttttttgagacagtctcgctctgtcagccaggctgaagtgcaatggcgcaatatcggctcactgcaacctccgcctcccaagctcaagtaattctcccgcctcagcctctcgagtagctgggattacaggcacctgccatcatgcctggctaatttttccatttttgtagagatggggtttcaccatgttggccaggctggtgttgaactcctgacctcaggtgattcggcctcccaaagtgctgggattataggcgtgagctaccatgcccggccacttttttgttaaaaactaagacacaaacacctgttagcctaggcctacacagggcagggtcatcaatatcactgtcttctaccctcatctcttgttccactggaaggtcttcaggggcagtaacatgcaatagagctgtcaactcctataataataatgccttcttctggaatacttcttgaaggacctgcctgaggctgttttacagttaacttttattttttgtgagtagaagtacactctaacataaccattaaaagtataatatagtaaatacataaacaagtaacagtcatttgttactgttatcaagtattatgtactgtacacaattgtctgtgccatactttcataagcctggcagtgcagtgggtttgtttacaccagcatcaccacaaacacatgagtaatgtgttgtgctaaggctaggacatcggtaggtgataggaattttgcatttccattatcatcatatgggacgtctgtgcagtggtccattgttgacttgaatgtcgttacgtaggccatgcgtattttaaaatttttaacagtgggttttggagatttgtttcaaacaaataggctgaggcatttgtttcttgttaacacttttctattctgtaatcttacctatcttcactgtatttacatatgtgttattcagatggtgaaattttggaaaagttacttgtttcaagtacagaatggttgaaatgtgtgccttggtagtatgctgagataagaaatactttgttaaaaggcctaggggcaaacatttctgactttctcatgaaaatagagtggatcaatttcttctgtgttgtaactccctcttttgatcactaattgataaggtgctagattacattaaaatctgatatctaaatgttttacatccttcccaactttcctatcatgtagatgagagtgttgagaactaagataagagtttgtgacttcagatgaccagtgagtttatgaattttgcttaaaactactaatcgtcttctttggtcggtttccaagagaatgaggttccagcaacaaagcctgcttcaggatcccatctgggaaagtgaataagcatatctttttttttttttttttgagacagagtctcgctcagttgcccaggctggagtgcagtggcacgatctcggctcactgcaggctccacctcccgggttcaagccattctcctgcctcagcctcccgagtggctgggactacaggcacccaccaccatgcctggctaattttcttgtatttttagtagagacagggtttcaccgtgttagccaggatggtcacgatctcctgacctcgtgatccacccgtgtcggcctcccaaagtgctgggattacaagcgtgagccaccatgcctggccgaataagtgttatcttttaactgtacaattaaattgtttttccttctgatggtaacatactcattgagtcggttttcctactcttctttttgcttcattcttgttacccttactcacacttccatctgtatccaaaattgtgtttctctaaggcccctctgcctggctgtgctgtccaaagtagcaccttcactcagtcacggtctcacttccctcactttctgtgtttgtcttacttgtttttaatatattctgtctctttgccattatagtttcattagaataggtaccttctgtactggttctctgctattttcccagcgtagaccagtgccttgcaaaatgttaagtacttgaacggtgtttcccagactgtctgtagtgaaggaccagttgattttttagtttgtttttcaaatttcatcataggccagtaaatacattttgttataaaatacaataaaaatcaattactagaaaaaatgacatcacatacaagcccttttttttgagacagagtctcgctctgtcacctaggctggagtgcagtggcgcgatcttggctcactgcaagctccgcctcctggattcacgccattctcctgcctcagcctcccaagtagctgggactacaggcgcccgccaccacggccggctaattttttgtatttttagtagagatggggtttcaccgtgttagccaggatagtctggatctcctgacctcatgatccgcccgccatggcctcccaaagtgctgggattacaggcatgagccactgtgcctcgcccctgtttttcttttttttattagatccaacagccataaaagtatccattgtctatagaggtttctaaatgcttagtctctatttctgaagttagtttattataaaccactgcttcaggttgcactgttcttggcccccccataagtgtggcagcactctagtatttgttgaacaaatgaatggattaccagcctcagggttaccacaataaattcttcagactgtattattcctttgacctttaactttcctaaaccccagagtatatactgagatacggaaggatgatggctcattcatgatatcagacttcagctggcttattcactgctgttttttgattctataataattattattttgagacggagtctcactctgtcgcccaggccagagtgcagtggtgtgatcttggctcactgcaacctccgcctctcaggttcaagcagttctcgtgcctcagactcccgagtagctgagattacaggcacccaccatcacacccagctcttttttgtatttttagtagagacaaggtttcaccattttgggcaggctggtcttgaactcctgacctcaggtgatctgcctgccttggcctcccaaagtgctgggattagaggcgtaagccaccgcgcccagcccctatcctttttgttttttattataaaagtaatatctgaatacatgattgtttaaataaatgctgtgtaagtgtataaaatgaaaagtaaaaggcccccatgaatggacattaagatacttccgatgtgttttgttttctattgctgcagtatttgttactgtacttgtgatggtacatgtgcatatattgctctaaaacaaatttctagaagttgaattccaaacagtgactgttccagatgtcttattttttaggaccccaagcctcttaaatttaggtctttccgttattcccttaccttctcccttatcccttcaaatctttgcccactgccatcacattaatgccttctttgaccttattttatctgttatagtaatgagctgccctgttctttctatctttaatctccccactccaccttgtccttattatctcagctagtttaattcttaaaagtgagtatattaatccttggaatctttcttttttatatatatatatagtactgatatttttcagttagtagcttctgattataactttcccaaattgaggctttcatttccttagaacaaggaactgccctggctgggcagtttagtcaaaggcttgtcagggtgtttagtagacagttgtgcaagtggagctattcacagggactgtattactatgttcctttgttactaaaaaaaaattcttgcagtccctgtagttcgcaacagatactctgactcatatttctctacataggagaaagagtatggactttggagtgatacatctatagctcggttaggatctagactctgctcccaaactggtagtgtattttggggtgcactgctatgtttctgagccttcatttcttccttataaagagtttattagtttgtagccaggcgcagtggctcacacctgtaattccagcactttgggaggctgaggttggtggatcacctgaggtcaggagttcaagaccagcctggccaacagggtgaaaccccgtttctactaaaattacaaaaattagccggacgtagtggcacatgtttgtaatcccaactactcaggaggctgaggtgagagaatcgcttgaatccaggaggcagaggttgcagtgagctgaaattgtaccactgcactccagcctaggcgacagagtgagactccgtgtcaaataaaaaataaaaaaaaaacaaaaaaaacagtttattagtttgggcattgtttcagccgctgtaacacaggccaggaaacagaagtctaaccaagataaaaatttatgtctttgtctgataaaagtccaagctagtagataatccctacggtatgtagttctgttccttaggtggtccaggggaccaggtcctgctttttatcttattctgccatcttcctgtcccctccctcttgctgtagtttgaattgttaaaggcacctaataaccaccagcctaagttctaggccaagggaaggagaaagagcaatgaagaacaagtagcttcctttagggacgtgaacttaaagatactcacaactcattggccagaatgtattatagtttctgtccatgcctagctgcaaggaaagcctgaaaataggatataggtggacagtcatgtgcccagctaaagcacagagacgtctagtaactgaaaggaagaaggatagaatggacaatgtggcacaattatactgcactgagttggtttttcaagtaggaaataaatggaataatagttttgagatctacaatttctgagtagaaactaagcgtacttttgtacagaatttttgtttggtaaatatcaacagaaaaatatagacttgtgtatagactaaaacatgactaggtctttgtagggtttggaacataagtaatatgttttcctttcatttggcttcagttgtctgtaaatagcaaacataatgctttcttatagagagatcactttttcagaaacttcaactatctggaatattgttaggaggtaataaggcctcaaggtagcaaaagtataagttgcatagtccgtgttctcaatcttgatttcaagcttgagtaattttggggtatagacatattactattcaacttaattatttagtacctcgctcagtagcaaatttaaatctgcaatatttgaatggtccattaaaggtatatatgatggaaatgatagccaaaagcctgataggatagaagaataatacaaggaagaaaaatacaaagaagtcataagcttggtaataataaaatttgctaacatttattgaagattcataggtgccaggtattatataaagcttttatatgtattatttcatttaatatctaagacatcctctatatcatataggggaggatttaggtttatatgctaagaaagctcataattacattcttctttgtttatgaagatagagaagcatgtaactaattttagatcaccatcagaaatcattaaaatgaaaaggccattttggtgcttgacagaggtatctgaaagagctcagtctaatggtgctaggtaaataagttgttctttttaaaattattattatattttgaggcagggtcttgctctgtcatccaggctgaagtacagtgacgcatccacagccacactcactgtagcctcggactgctcaagcagtcctcctacctcagcctctggagtagctaggactacaaacataccaccacgcccacttaatttttttattttctgtagagatgggatctcactatgttgcccaggctgggcttgagttcctagcctcaagcattcctcccacttcagtatcccaaagtgttaggattacaagtgtgagctgccattctcagccataagttgttcttatattcacctttgactttttttttttttttttttttttttgagatggagtctcgctctgtggcccaggctggagtgcagtggcgcaatcttggctcactgcaagctccgcctcctgggttcatgccattctcctgcctcagcgtcctgagtagctgggactacagatgtccaccaccatacccagctaattttttgtatttttttttttagtagagatggggtttcactgtgttaaccaagatggtctcgatctcctgacctcctgatccgcccacctcggcctcccagagtgctgagccacctcacctggccttttttttttttttttttttttttgagacagagtttcactcttgttgcccaggctagagtgcaatggtgcgatctcggctcaccgcaacctccgcctcctgggttcaagcagttctcctgcctcagcctcctgagcagctggaattacaggcatgtatcaccacgcccagctaattttgtattttcagtagagacggggtttctctgtgttgaggctggtctcgaactcctgacctcaggtgatccgcccccttcagcctcccaaagtgctgggattacaggcgtgagccatcgtgcccagctggtatttcttttttttttttttttttttacaggctggagtgcagtggtgtcactttggctcactgcaacctccacctcccaggctcaagcaattcttgtgcctcggccttctgaacagctgagactacaggcgtgcatgaccatgcctggctaatttgttgtagtttagtagggacggggttttgccacattgcctacactggtcttgaactcctgagctcaggcaatccacccctctcggcctcccaaagtgctgggattacaggcatgagccaccgcgcctggccatcctccagtatttctaaagctaagtttctctaccaacattgaacagcttttatatttctgcgtttagcaagtaatgattgaagagcatccagacatggaaatttatattttgagacaagtagctctatacaccaaccaaaggtaaggttgaggctagattcaagccctgcatggtactgggactaagtacctcaaggtagataagaatcccagatctagaaccagtacttgaggtctaagactaagaagaagcagaaaacgcctggaaaaaaaatttaccattcatagtatcaactataagctaccttaaaaaaatgagcaaaagatgtacaagtcctaagtaaaggcaattgcagtcttgcttaggaaaactattttgactcaataaattctttaagctgagagtaatgaggttcatgtttttaagagataactaagtagtttttctaagtagtaaaaaaaatatatatatacatatatgtgtatatatatgtatatattaggaaaagtgtcaaccagttatataataaagagaaaattatatcatttccatgaatgatttttaaatgtgaacagttagaatgaataaagaaagaatgtaaagctaggcttggttatcctgctatatctgctatatgaagaaatgcaaatcagcaattgtaaagactcctagaaatcatgcaatgcacaaaccgagttaatttcgtataaccttgtgtttcccacttgttctgtgatcgtagggaatctattaatatcttctgggacactagaagtctgcaaaacataatttgggaaatgctatatgtatttgaacaccattaattcagatacgtagggtgcaaacatttgcattgccaaaatcttaatgtacagaatctttaaagaatataataaacttatactttcttttttttttttttaatggagaaacaaggtctcactctgttgctcaggctggagtgcagtggcgtgatcatagcttgctgcaacctctaacttctgagttcaagtgatccacctgccttagcctgctgagtagctatgactacaggctcacaccatcatacctagctaattttattttttgtagagacatggtctcactatgttgcccaggctggtctcaaactcctggcctaaagtacattctttagtaagttaaaatacttgcttttttaatgatagtcttgaaaaaaaaaaagttaaaatactaattggccgagctagaaaggacccaagtgttttttaaactatgttcttttttttttttttctcccgagacggagtcttgcactgtcgcccaggctggagtgcagtggtgcgatctcagctcactgcaagctccgcctctaggttcatgccattctcctgcctcagcctcctgagtagctgggactacaggcacccgtcaccaggcccagctaatttttattgcatttttagtagagacagggtttcatcatgttagccagcatggtctcgatctcctgacctcgtgatccacccacctcagcctcccaaagtgctaggattataggcgtgagccaccacgcccggcctaaactatgttcttcatcagatgttttccaaatattttcacccagtctgtggtttaccttttcagtctcttcatagtgtctttcgaacagcagaagtggggttgggtgcagtggctcacacctgtaatcccagcactttgggaggccaacgtgggagaatcacttgagcccaggagtttgagagcagactgagcaatatagttagaccctgtctctaaaaattacaagaaaattagccagatgtagttgtggttgtgtgcctgtgggcccagctactcgagaggctgaggtgggaggattgcttgaggacaggaggttgtggctacagggagccatgattgcaccactgcacttcaacctaggagatagagcaagaccccgtctaaaaaaaaaagtgatgaaatctaatttattacatttttcttttttaatttttatttatttatttttgagacagggtctcgctctgtcaacaggctggagtgtagtggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttggacagcacagccaggcagaggggccttagagaaacacaattttggatacagatggaagtgtgagtaagggtaacaagaatgaagcaaaaagaagagtaggaaaaccgactcaatgagtatgttaccatcagaaggaaaaacaatttaattgtacagttaaaagataacacttattcggccaggcatggtggctcacgcttgtaatcccagcactttgggaggccgacacgggtggatcacgaggtcaggagatcgtgaccatcctggctaacacggtgaaaccctgtctctactaaaaatacaagaaaattagccaggcatggtggtgggtgcctgtagtcccagccactcgggaggctgaggcaggagaatggcttgaacccggaaccgagatcgcattgtcgcactccagcctgggggacaagagcgagacttcgtctcaaaaaaaaaaattttttttttggtttctataaattattttataatgaagcgtttcatccttgtatattttgaggcacacttaaaagttttgatataaagttttgacttcttcttgttcagatatatgatgaaaatgttaggaaaaagatgatgtaaacaattactattttaaaaattttaaataactttctgtcttctatcataaccatattggattatgctcccctcctggttcaaacagtcataataggcctaattagaaagctctgattttaccaattatttcttttaattcctcaatttatatgatttattttgacttctctttcagcccctcccactttttaagtctctgcaaaactatttgatctctgtaatgagattataatactacctaaatgcatagttagatttctgaaagaccatttctgttacatcccatgtgctgattttttttttaattacatggcataaatttaggggacaaaaatttcacggttttttttattcttttaatgccattttattttttcatgacagattcaaaagctttgtgacagagtagcttcatctactttattggatgatcgaagaaatgctgttcgtgctctcaaatcattatctaaggtttgtaactttgtaaatgttttaagtttcttaagttggatattagttactttagtaacatttttattttttatgtgcagaaataccgcttggaagtgggtatacaagctatggaacatcttattcatgttttacaaacagatcggtaagtctctgtttaatgatttttttccctaatttttcttgaacttttgttttagagtcagcatcactattccaaaagattgctttttttttggtattttttggtagagatggggtttgccatgttgcccacgctggtctcgaactcctgggctcaggcgatctgcccacctcggcctcccaaagtgctgggattgcaggtgtgagccactgcgcctggccctaaaagttgttgacatactaaagctgttaagtttttacttcagatgtcatttcgataaagatttattggacagagtgcgagccactgtgttaagcataaaacagacatataaaaatgggataaagcaactctttaatgccttgagattttgagtttgaattgggcaagtggtattcatttacactgggcaagtagatattcatttacatataatatacatattttggtattcagacttgcttttttaagagaaataaactgcagtaataagagttaagtgttaaatatgagcctgtcataagagaaagattgccagatatggtggctcaagcttgtaattccagcaccttggaaggctgaggtgggaggattgcttgagcccaggagttcgatactagcctgggcaacataaaaaataaaaattaggccaggcatggtgtctcatgcctgtaatcccagcactttgggaagccgaggcaggtggattacttgaggtcaggagttcgagaccagcctggtcaaatggtgaaacccggtctctactaaaaataacaaaaattagccaggcctggtggtgcatgcctgtaatcccagctacttgggagtctgaggcgggagaaatcacttgaacccaggagatggagattacagttaaccaagatcgtccaactgcacttcagcctgggcaacagagcaagactctgtctcaaaaaaacaaaaaagataaataataaaataaaaattagctgggtgtgttgtcacatacctgtggtcccagcttctcgggaggctgaggtgggaggatcactcgagcccaggaagtcaaggctgcagtgagccgtgatcataccactgtattccaacctgggcagcagagtgagaccttgtcttgacaaaataaatataaatttaaagaaaaagaagcatcatttagcccatttttagctctttcaatttttttttttttttttttttgagattaagtctcgctctgtcgcccaggctggagtgcagtggcatgatctcagctcactgcaagctccgcctcccgagtttatgccattctcctgcctcagcctcccaagtagctggtacctgttacaggtgcccaccaccacacctggctaattttttgtatttttagtagagacggggttttaccatgttagccaggatggtctcgatctcctgatctcgtgatccacctgccttggcctcccaaagtgctgggattacaggcgtgagccaccgcgcccagcctttttttttttttcagatagagtttcgctctcattgcccaggctggagtacaatgttgcagtctaggctcactgcagcctccgcctcctgggttcaagtgatttctcctgcctcagcctcccgagtacctgggattacaggcatgcgccaccatgcctggctaattttgtatgtttaatagagatggggtttctccatgttgatcaggctggtctcgaactcctgaactcaggtgatccgcccacctcagcctcccaaagtgctgggattacaggtgtgagccaccacacctggccctcaatttctttttaagagattttatctccatctttggttttcattaactgtgcatggatagcttccagatcttagctacagttgaatgtgtcttacaagctttagctgtgcattgtacatttctactctaccaagatctctcataagcctctcaaattcaaaatgttcaaagttaatttatctctggtcctccaatccttctaggctttccatgcccccttcgaccacttttaccctaagttcatctcagtcatgagcatctttccattcaagcgagaaactggaggattcttagggaactcattcctctcctgaacccatcatgcctacacaggccaaaaaacagctagagtccattattttctttccgtttccttttttggccttagttctggctcagtgtcaatcacttaaataatttccacagcctctgtgtttgttatctttggccgtgtaacaaattacttcaaaacttagtggttcaaaataaaatatttatcacctcatagtttctgtggatcaggaattgaggatcaacttagctaagtgggctcagggtctctcatgaggttgccatgaagccatcagccaggtctgcagtcatctgaaggcttgactggggctggaggatctgattccaagatgtcttacattgctattggcaagaggcctcagttcctcaacatgtttctctcttggtaaggctgtttgatatggcaactgctctcccagagcaaactgtcctagagagagaaaaatagaaagccacagtgccttttataactcaatctccagagtcatgtactggcaatcccatcatattctagttgttagaagcaggttaataagtacagcctatacttaaggagaggagaattaggcttcacttttttgaaaagagatgaatcgaaaagttttggacatagtgtaaaacaatcatcatctccaaagtattattttcctccagtctctttgtatttccattcagtctatatgttgcaagaattatccttctgaaatgcgtatcttcagtcattctctcatttaatgcatttcaccagttcagtgaagtgtgaagttcatgtttctcaaacaaagctaaagatacaagctttttaaagatctgtgtactgcctgtctaatctcgtagactcgttttcagttatatttcagttatgcccagctgcttgtccataacagttaggaccttttttcttctccccagacagtgtaactcaaattgactaccttttcaaagccactaagtctaatgcatttgaataagcgaattggatgcatcaggactgtctgtgttattaacatcacagtaggtaactgtggtagacagaattatggcctcccaaagatatctatatcctaatcaacaaaacctgtgaattttaccttagatagtgagagagactttccagatatgcttaagttaaggactttgaccctggtggacccagtgttatcacagggtccttagaagtagaacaggaaaaggctgggcacggtggctcatgcctgtaatcccagcactttgggaagccgaggtgagcgaatcccaaggtcaggagatcgagaccatcctggctaacacggtgaaaccccatctctactaaaaatacaaaaaattagccgggagtggtggcgggcgcctgtagtcccagctactcaggaggctgaggcaggagaatggcaagaacccaggagggggagcttgcagtgagtcaagatcgcgccactgcactccagcctgggtgacagaacaagactccgtctcaaaaaaaaaaaaaaaagaagtagaacaggaacgcagaagaggaagtcagagtgtagtgatagaaaaaaaggactcaacctgctcttggtggctttgaaaatggagagaaggagccgtgagccagagaatgtgggtggcctttagaagagcaggaaaaaagaagcagattagtgtgatgattatacatacttataatcttctttattctatgagtgttaaatcacacgcatattttattactgagtcttataaagttaatgatgaaatgattaacatctcaatatggaaaatagaatgcatctcttatgtaaagtggtctttattgtctttcataataattttttttttttttttgagacggagttttgctcttgttgcccaggctagagtgcagtggcacaatctcggctcactgcaacctctgcctcccaggttcaagcgattctcctgcctcagcctcctgagcagctggggttacaggcatgcaccaccacgcccggctaattttgtatttttaatagagacggggtttctccgtctctacttttggtcaggctggtctcgaactcccaacttcaggtgatccacctgcctcagcctcccaaagtgctgggattacaggcgtgagcaaccgcaccgggcaccataagatttttttttaagaaaataatatataaagaagaaaaacactctagtagttgaactagagataacagttacttttctttatatttttaagtctacttcgttcctctagatatgaacagttagatttttatatatgtatacatatatatacatatgtaaacatacatagacacacataaaattaactgagtcatgctagttttgctggttttaaagttgtacttattttgtaaatttataatgttttaaaatatgcatagatacaaacgtatacatatatattttactaaatgggataactctgtgcataaatttttatatttttccacttgctattatatcaagaatttttaaaattatcatgtcactaaatattcttcggaaatacattttttagcttctcaggattcaaagtaaaaaaacaaaatacattttttaaattgccgccttatatgtatgaatttgccatactgtgtttttttattattgagcatttaggttgcttctaaattttcacaattagaaataaaactacacattttttacagtttgcactctgatattttcttagagtatgcctttagaaatggaattttctaaaattgctaaataactaaaaatggtcataacagtttatactctcatcagcagtgtataagtgtaataatttcttttttccagttcagattctgaaataataggttatgctttggacacactatataatataatatctaatgaagaagaagaagaagtaggtaagtttccagttatttttactgtgttttctgtacttaaaaccaactgggttgtgctaattttgctggttttaaagttggacttgttttataaatgtataagtttttttacttttttcattaaaaaatttaataaacacataggcttagatctagaaaagtgtctttaggatgattgctttgtgtgtaagtcagaacattatagtgagatggaataagatccttctttttaactaatatttttgcccgcttgtgtttggttttagttaggcagtatgcatattagccagttctggattaaataattatttatggctattgattgaaaatttatattattatctagtgagcaatataaaattagagagtttttcctaataaatacttaaactttttacataggacttatgttaatttataaagtgcaacaattttttaaatttagattttttttctttacattttgtctgtttggtgaacattgctataaatcggtttgaaatccacacatttctttggcacattcattttcttttttgttttaaaatatttgcacacttaacataaagttatctgtcttatttattgtcactgtgtgaagcttgattggaagtctgtatacattttgtcctgtatacattttgttctatatgttgcaaaacattcgcagtaacatttcacaattctgttgaagagtgtatttgtcatatcaaattggctgttacagtaggacgtagtagatttttcattattctgtaaagtcagaacagtggatatattcatacattttataaatctaatttagactgaagttatatgatctctcaaaattctgagtagacaaataataaagaagtatagatacatactgaccttgctcatattttattaaaattaaaagtagagcaggaatatatgtcaatattaacttcacagaatactagtattgagaacatctgaaactggatcatgttgcatagtcacaatttcttagacataaatatcctttttaaaaaacttttattttggctgggtgttatggctcatgtctgcaatcccagcactttgggaggctggggtggaaggattgcttgaacctaggagttcaagagcagcctgggcaacataagtgagaccccatctcatttaaaaaaaattttttaaacaaatttctccatgatatctatcctatagcttaactttattaatttcttaagggtgaaaaatatttagtaaatgtaatttggtacccatggaaaaagaggttgtcagtcacgtgacaatacatagatacaatacacacaagaatatactttgaagaaaaagatacttattttccctagttatttctacaatgagaaaattagatgcaacgcagttgttcaaatacatttttaaaaatgacattcttttctttccttttatcccccttagttgtttcagattaaaaatttagctctttttccagttaatttgctgggataattttttctgttcttaaaaaaaatgtgtagcaacaatattttttagttaggaggtttttttttaataaatttataatcatgtttagagcccacctgttgcatttttctttgtgtttttaggctctttaatttagcatccaaaaatgatcctttggataaacagtaatagaatcacttttattaaggacctttttttttttttttttttttttttctgaaaatttagtcatcctgaaagagtcagttaaaaagtagacattgggctgggcgcggtggctcgcgcctgtaatcccagcactttgggaggccgaggcgggtggatcacttgaggtcaggagttcgagaccagcctggccaacatggtgaaaccttgtctttactaaaaatacaaaaattagctgggcgtggtcgcacacacctgtaatcccaactactcaggaagctgaggcaggagaactgcttgaacccaggaggtacaggttggagtgagccgagattgtgccattgcacttcagcctgggcaccagagtgagactctgtctcaaaaaaaaaaagaaaagaaagaaagtagacattggctgggcacggtggctcacgcctgtaatcccagtacttcgggacaccgagacaggcaggtcacctgaggtcaggagttcaagaccagcctggccaacctggagaaaccccgtctctactaaaaacacaaaaattagccagccatggtgttgcacacctgtaatctcagctacttgagagactgaggcaggagaatcacttgaacctgggaggcagaggttgcagtgagccaagattgtgccactgcactctccagcctgggcaacagaacaagactctgtcttaaaaaaaaaaaaaaaaatagaccagacatggtggctcacgcctgtaattccagcactttgggaggccaaggtgggtggatcacctgaggtcaggagttcgagaccagtctcaccaacatggtgaaaccccatctctactaaaaataccaaaattagccgggcgtggtggtgcacacctgtaatcccagctactcaggaggctgaggcagtagaatcgcttgaacccgggaggcggaggttgcagtgagcggagatcgcaccattgtactccagcctgggcgacagagggagactctgtctcaaaaataaaataaaataaaaataaaaataaaaatagacattgagacatgtccttcagttctgttattgatactttgcttttattgcttcatgaaatgtaattcttagctgacacaatgaactacattttagagttctttaggactgttttacaaccctctaatgataaatctgtctcgtagtcctaaaaatatagcgtatgctaaatctcttttagtgtatctgaggtatttgaccaaagtacatatggatctcttcttccaaaggattatgtagcttattaaacatttttaagctcctattttacgtgtatactactacattaaaaaactattgtctttatcatccactttttatttatttatttttatctaccttttcagatgatgttgaaggtaaaagattgcatttacatctgcatgatgcttttaggcatagtttctgataatataaaaggacactgtcaagtactgtttcttctggctggtaaaaaaaaaatctgaaatttgttttactatataagaattctttaattgaagaggaatattttaataaacttacattactattatttctgcagctactaaatctgtttactgtccagaacacataaaatattctagtgcacctttaaataaaattaaaggtttttctggccaggcgtggtggctcacacttgtaatcccagcactttgggaggccaaggcgggcagatcacttgaggtcgggagttcaagaccagcctagccagcgtggtgaaaccctgtctctactaaaaatacaaaaattagccaggtgtggtggctggtgcctgtaatcccagttacttgggaggctgaggcaggagaattgcttgaacccaggagacagaggttgcagtgagctaagattgtgccactgcacgatccagcctgggcgacagagtgagacttgtctcaaaaaaaaaaattaataaataaaaattaaagctttttctctggtaggacaatttattcaaaattacttgtgtgtatttcctggaaaaaagtttttagacagttcatttaaaaatacttgccaagtgcagtggtgcatgcctgtagtgccaactacttgggagactaaagtgggaaaaccgcttgagcccaggagttcgaggctgcagtgagcaatgattgcacctgtgaatacccactgcactcaaggctagacaacatagtgaaaccctgcctctaaaaaacaaacaaacaaaaatctataaaagtaatatttcagtatgtatacatatattttttacctatattcagtaagaactggaaggtattctagttcagagaatgtatattgatattgtccctttaaaataatgcatactcagtaatgatgttttagttactgacatttcttaccttaactcgtagaactcactagtttttttattttcttctctctaatctcttttaagtttcatttacttttaacattgatacttgttttcttcataactaaagtaaccaagtttttttggtttgttttgttttaccaatttccttgaggtgcttaacttttttaaatgaagaaggaaatattcgtatctaaagcagtgtttaaaaggtacatcacaaagttgcctatatataataaaaatactaacaaataaactaacttattaaagtatgaagcattaccttttgtgacatttgaatctcttgtttgacatcagatgataccagagcattgtgccttgactcttgtcaagctatttccttgctgggtagtaaagatcagtagttgtttctattattgtgatactgtagagagctttaaaatttatctttcatgtttatcttatgtaatcctcatagcagccagtgaggtaggtggtatttttctactttctaaagatgagaaaatggaagcccagagatgatgtaacttatatggtatcactgagtaagtagaagaacaattttactttttttttttttttttttttttgagacagagtctcactctgttgccaggctagggtgcagtggcacagtctcggctcactgcaacctctgcctcctgtattcaagcgattctcatgcctcagcctcccaagtagctgggattagtgtcaccacacccagctaatttttgtatttttagtagagacagggtttcactatattggccaggatggtctcgatctccagacttcatgatccgcccttcttggcctcccaaagtgttgggattacaggcatgagccaccacgcccagccagaacaatatttttaaatacattttttccttccttttttttttaaagtatttcttagatttttaattcaataaattgtggccaatttttctttatttttctgactgggttctttattaaatcatgtaattcacaaaactagtttatagaatattcagataaatgttaaaaagtatacatgtacctggccaggtacggtggctcacgcctgtaatgccagcactttgggaggctgaggcaggcagatcacaaggtcaggagatcaagaccatcctggctaacatggtgaaaccccatctctactaaaaatacaaaaaattagccaggcgtggtggcgggcccctgtagtcccagctacttgggaggctgaggcaggagaatggtgtgaacctgggaggcggagcttgcagtgagcagagatcgtgccactgcactccagactgggcgacagtgcgagactccgtctcaaaacaaaaacaacaaaaaaagtatacgtgtacctgtttaattaactaccagtataaacgaagattatttgatatttcttcactctgaggactgattttattaggatatctccttttataaagcaatttcttttcttcataatatagattgtgaacttagtatagaatagaattccaaagagaagatccagaaatgtttttaaatattgtttacacctctggaaaaagtactactagaaatacatttgaagagtaaatatatctatgcatgcgtacttaaatgccagccatataaacaggcctgaaaactatccagagctatacagacagatgatggttcaacttcacgattttttgatttacgatggtgtgaaagcaatatacattcagtagaatctatacttcgaatacccatacaaccattctgttttttcaccttcagtacagtattcagtaaattacatgagataatactttattataaaatatgatttctgttatattttgcctagctgtaggataatgtaagtgttctgggcacatttaaagtaggttaaacatattaaatacattttcaacctatgatattttcagtttttgatgggcttatcaggacataaccccattgtaaattgaggagcatctgtgtaagtacttagaacgggcatttttttattttacattcctatattaaatttatttttactatggtaacaaagggccatttcatttttatcttatttttttcatttaccttacaataaatggtcatttacaggttataaatgcacaatataatatataaactataggctataaaaaacttagctataaaggttgtaatctaatgattaatgatgagagaagatggtttacttgtttcatgcctttgcttacacgtataattggtataatttctcatggttctagtttttgttcacaacttttagatattagtgtagtagtttatagtagtttgtagcttaatttactgctacacttaaagctttgtgtattaccttaattgcttagctaatttggggatacttcattaaagttcagaagtgctgtcttatgactgtaacttaaaagaaatggcgtatatctcacactttttcaaattgacagtgttaaaccagaaggaaccattgatccttgtaataggaccatattttactagttcagttcaaaatgtaaattttaattctatactgataagctacagcatattatacaatatagctacagaataaattaaagatattaactctacttcttcctaagttatttgcttgtgcccagtgcaaacactgaattaaactttttctggtattagacctgacttccttaaagcatagcacagaagttctagagagtgttctgtattaaaacgggttcatagttaaataaacataaatactatattcccctctgaagcttcataaaatttacactggtgtagtaagtgctgagaagcctgcagtgaaaaatcttgttcaactttgtttaatccaaatatatttgtccacaggggcttagttctgccatgtacctattaacatgccacactatcctttgttttgaaatatactaaccaaggcttggttagttgtttatgtttacatatgtaaaaatatttcaacattttaaaatacattttaggggaagaatccatcaagtctatatgtggttttttttcttcctttttagattagtttataatttttaatgttttcccaaatgtcaataactataatttttagcttttctcatgaggtcacaaacttttggcccaagggcattgtctatcttgtaagcaaggctgtttgacccacatagtattttaagtaaggtgaataagttgccactattataaattgggagcttgtgtcaacgtttgtattttagacttctttttgaaaaaacctgaagattggcaatacctggatctgcattcctacatggcaacaggcagctggagttgagtaactgctgttttccttagacagagcatatactccccatcctctaatgttagcctgcttcactcactcacattactgtcttttgtttgtagtcaagttttcattctctgctatcttcacaccactgagataaaaaataattatgctataaattactttcaaacgcatgatttttaaagttatatatctcattcaacaaatatgaatatatgcaaatggaaactagccctacaaagcacccatgactaagttaatattgctgtgattttaatttcttgagggagacaattctgagagaatattacttgtcttttgaacatagatttctcatgtatttggagaataatttatttgacatgcattcccaatgggccctttttgtataatttctttatctgcttttttatctatacagtttcactagaatttggctaacatctccatgatttgttagggttctggggtggcttaaaaaacaaggtaggctcattagcccaccagctcttgtgagattttattgggtacgtaacatttgccatactgtgggaatcaggacttctgttcatagctgattctaaagatgaaagctttcaaaagattctaccagctcccaagttcccattatcttttccaattttttcacagtctccttttccatcatcctgtcagtttgtaaataaaatgggaagggtgtgcagttcttgctatgtgcctggtaccagttctttttttttttttttccaactccattcataagttcacctttgagctttgaaaatcacaatttaccaagcaaggttttaccttcaagcgtgtgtaagtaattaggacacaattttatcagctcacaaaggaacaacaggaaatcctttaaggagatctgtagcagagaatgtcccttgaatccactctagttatgtttgagtattaggcttccttatgattattatcaggcctttgtagcatcaatcctctgccaccttcacttaataccctcagtatatctgtgattatgtagtaacatgatagctttcaagtgtacttttggtgtttgttttttgtttgttttttatcctttatcctctcctctacctgttttcctgaagtggaagtagtgactgcttcccgatataattcttctgaagccaccactaacctaagatataaaactttaattaaaatacagtgaatttacttttatttagagtcagttactttttttgataggttgcatataacttttatgagaaagagagaaatataaggtaaaatatcaagacttacagacaactttctggaagtataggatatactttttcttatgtcttttgcatcttggtgataatacttattaatgataaccttataagaatccaaaattctgaatcatcaaaggaagattgttaggttctgtttcatttgaaaacttagtaaatatatagcttatgttgtaaatcttaggaccatggttctcaagtgagggcaatttaccctcctttaccccactcctagtacattccgcaacgtctggagacatttttggttgtcacagtaagaggaagtaagagagtgctactgcgtctagtgggtaaggccagggacagtgctaaacatcttaaactgcacgaggaggtcatacaacaaagacgtacctggccagaaatgtcaggagtgccaaggttgagaaatcctgtcttggggatgatgattttgatgatggtgatgatgacagtgcttctgtttattgagcacattatttacaaagccctatgctagatgttctacttattttaaatcctcacagaaaaccccatgtgaagacattatctccattttacaaataaggaaactgagacttgacagagttaggctacttgcccaaagtaacatggctattaagtggttgaatatgagtttaactggtcttactcaaaaatctttgtgagcttcttccattatactgtactgctactcaggaaagtatttaactactcaaccctagtcattttgtaaatgaatggaaattacctctacctgtgttagtaatgtacctcatttcttgaagttcagaggggattctacctatcattagtatttgatagtcactcctttctcattgagtactttcttcatttgtttgtcagtctgcgaagtctcctggctttcttcctttttcattggttactctttgtctccttcgcagttttcctccccatctccccaacctcttaatattagaatgccacagggcacagatttctttccttcccccttccctcccttgttgatttcatctaggcttgtaacttcaaatataatttatatgcttgccactcaaatgtgcatgtccaacccagacctctccactgaagttcatcattgtatattcagatattcactcaatatctttacttagataccccctaacacatacagctttattgacatctaattaatgtaaaataatgaacatatgtaaataaacaatttgatgacttttgatacatgtataaacatgcttggctttttcttttaaaagtttgtaactcttggccgggcatggtggctcacgcctgtaatcccagcactttgggaggccaaggcaggcggatcacaaggtcaggagatggagaccatcctggctaacacagtgaaaccccatctatactaaacgtagaaaaaattagccgggcgtggtagcaggcatctgaagtcccagctactcgggaggctgaggcgagcggatcacgaggtcaggagatcatccattttgagttaatgggtgtatttttggtctgttctcttctattgatctatgcatggcacatcatcttgattactgtagctgtataataaatcttgaaattatgtagtgttaagtcttctaactttgttgctcagaattgttttgactgttttaggttttttgcatttgcaaaccaattttagaatcagcttgtgaatttctacaaaaagggtcaactgagaatttgggattctgttgactgtagatcaatttgtgaaaacctgacataaaaatattgtaccttctaatacaagaacacagtatatctctgtttttgcaggtcttctttaatttctttttttttcttctccttttttgggacagggtcttactttgtcacccaggctagagttcagtggtacaatcatggctcactgcagcctctaactcctgggctcaagggatcctcccacctcagcctcccgagtagctgggactacaggcatgcgccaccaagccagcctaaatttttattttttgtagagacaagttctcactatgttgcccaggctggtcttgaattcctgagcttaaacaattctgcctcagcctcccaaaatgctaggattacaggtgggagccactgtacctggcctgttcaatttctctcagcagtgttttggagttttcagagtgtaagtagcacacacctattgtcaaatgtttttgttgatgctattgaaagtggtactgttttttgaattttaatttccgattgtcattactagtatctattaatagaaatacaattaattttgtgtatgaccttttatcctgcaactttctaagcttacttattagttctattagctcttttgtagattccataggattttcctcatagacaaacatgtcatctgtaaataaagacagttttacttcttttctaatctgtattccttttctttttcctgccttatggcactgactaggatcttcaggtcaatgttgactagaattgatgagattggacattcttgcctccttctgatcttaaagaggaaaacattcagtctttcaccattaagtatgatgttagctgtaaggtttttgtagttgcactttgtcatccagtcttgtgactttaaatatcatttatatgtttaccactctaatgtgtttatccacacagacttctccactgatatctatgttagtatttatccagcttcttacttggtatatgcacttggatttttataaggtatctcaaacttaatatgtccaaaactaaacttctgattctctgtatacttccagcttgcttctcccacagtgtttccaatctcagtaaatggcaaccctatccttctagttctttaggccaaaagcttggaatcactcttccttttctttccccacactcctctgtgcaacatgtcaacaaatcataatcctttgtaataaaaattatgacatctaaggtctaagccaccttcatgtgactcttttcttgattatgcctcctgacctgtctccctattttccttactcactgacagtgtgttctcagcatagcaaccagagtaatccttttaaaatgaaagtataaagcagtgaattcttttactgatataagagatgattaagagaaatatttcttggagtttctgaaggataaacccagcatatttaggtaattaatcaactggaaaacatttcatttctacttttggtctcttctttttcctctataaacaattagatgggattatgactgtcaatcttggattgctttgcttttcctgtcatctgctgggttttttccctcacatttagaaaagaattttctgagggataatgggtttgatcttgactttcagctccattggctgatagtcacttagtggagtactatatggaaaagtattctgacgctcagccaatgctgtgattaattagctgtgtctggtgtgagtgagagaatgggaagtagtatgtttgcatcactaatttgagtttataatataggcagatcttaagtagtttgctttggcagttgttgctttcatttttagtgatctttttttttttttttttacatagtacattgagacaacaaatactttaattaaaagacatttaaacattaaagacaaatgtaaaatcctttaaacaataagtgagaaattagatgtcaaattctgattttattgccaaagaattttgtaggatatgtatatgaaaaagatactgagaaatctggagtagattggtttaatttcataattaaattatttaacccagtaacactaacagtcagcaaggactatatgttcaatattgttttggggacaagggttttaagatacaacttatatacaataaaatttactctgaattgtagtctgagtttgggcagaagtatacagaagtgtcaccactaccacattctagatagactatttctatcccaaattgtttccttatgccctaatagaagagtaacctaaaaatgcccttgagaaaatatgagtatttaagtatcctttttttagatatcatatttaaacatttagccaataaaatgtatttaaatgaatttgaacattattttaaggatatagctttacataataattgtgatattgctaccagccacactgttccagtgttgaattgtttaccaggaaaattatcattcacgcttaactcttcaatgaaaggatattttaaaataacctactattaaattgaaattctttatttttgaatattacagaagaaaattccacaagacagagtgaagatttgggaagccaatttacagaaattttcattaagcagcaggaaaatgtcactcttctgttatctttattggaggtaaatagggaaccttgatgtttttgtcatcttaataagctgcttttgttgccttttggatgttattgaggaagtaacatgtatatacctttaaaggtagtaaagtttattgtattatagcaagagatccacatgcatgtttcaagaactatgtaatcacttaaagtatgctaaacttccatgttttacttgtagtttctggtaaaagttattagtggaaaaaatgtttttctcgaaaatgtgaattacagatgttaaatattttgaattcttacattgcaggagtttgatttccatgtccgctggcctggtgtgaagcttcttacttctcttttaaaacaactagggcctcaggtgcaacaaattattttagtcagtcctatgggtaagtgacttatcttttttatattattttgattcaagcatgagtatcatttcctagagaaagggactgaaatggtgtgttagtaaattgttaataatttgagtcactatttgtatttttggtctgccagcatttttcacatggttgtatgttctaggtgtttcaagattgatggacttactagcggattccagggaagttatacgtaatgatgtaagttaaatttcaaaaagaaatacaaaaatatgtggcttttttttctcttgcaaatgaaatccttgttgttgagttttaggaaattagatttagaaagctggagtaatgacctttttttaaaaaaattaaaaattagtaaacagagatgggggtctctctatgttgcccaggttggtcttgaatttctgggctcaagcaatcctcctgtcttggcctcccaagatgctgggattacagacatgagccactgagcgtggctggagtaatgaccttttaaagttgtacaaggccacattgtttcattctttcctggctatccagtattttgggttagacaaaccattttgccattcaaatttatttcttccattagtttaggatttcttatactatctgctgaaaggttgtatttgacaccaaactctacctctgcaattttcttttcctcataaagagtagcggagatacctccagacattgaactgtgtaaacccaacaaagcattatatttggaatccttgcccttatttgattgagtgtgtatttctaaggatttgccttgttaatcatggagcatgatttgctctggacttattttccattctgatttattttatatttgcatataagtttgaatattttgtatttgatgctgtatattttgttgcataagcatttttctctattgttacctacaacttgataaaaattctgtaatatttaaaatagcaattagaaaaattaaattctggagctaggagatcatatcaagctaattaaatctccatatttatagtgaaatgcccaagacccacagaaaccaagtaaagttaagtgttctttgttagccatgtcttactcatctttttatttatggtattggccgtgtgactttttcatcctaagttttagtaaatatcatttggattgctcttagccttataactggttaatggcaaagcagagacaaaactgaagcattcttaactcctagtctatggatacagtttttaaaatttgttgtacttaaaattttgtaatatgtatatcaattcagtattataggtagtgaacttaatacagtatgtaacttacaagaaggacatttttttttgagatggagtctagctctgtcacccaggctggagtgcagtggcatgatctcggctcactgcaacctctgcctcccggattcaagcaatttttctgcctcagcctctcgagtagctgggattacaggcatgtgacatcacccccagctaatttttttgtatttttagtagagacagggtttcaccatattggccaggctggtctcgaactcctgaccttgtgatccacccacctcgacctcccaaagtgctgggattacaggcgtgagccaccgcgcccggccgagaagtacattttttattctttaatatttaagtgtcatttttaagaaatgtcttatttaactaggtatctatctattagaaatttggggtatctttccttgactaaaatatgactatgtatctttaaagcttctgttctattctttccatgtcctgcagtttaaataagaggatatcatgcaaatcataaattatgtctccccacatcttttaatttcattaccacttattttcattttcagatataaaagtgctcttaaaaaaaataactgcattaggccaggcgtggtggcttatatctgtaatcccagcactttggaaggtcaagatgggtggatcacctgaggtcaggagtttgagaccagcctggtcaacatgatgaaaccctgtctctactaaaaatacaaaaaattaactgggtgtagtggcgggcgcctgtaataccagctacttgggaggctgaggcaggagaatcgcttgaacctgggaggcggaggttgcagtgagctgagactgtgccattgcactccagcgtgggcaacaagaaagtaactctgtctcaaaaaaaaataataataataactgcattaattctggaatctcctgttttcctttaactctttacctttttattctgctcctaaccttttttcaacttttatttgagacagacaaataagtgtctatttatattggtttttattaattttatgatcacagattaagttctgtttttgttgtaatgtctggattattggtttttacatgttttataaccttttttttattttaataaacctattcaagagggtaaagagaaaagaaactaatatactaagaccttgaaagctagtgggttctatagaacttattttgtctcctttagtctttataaaaaccctgtgacaaagatattacatgagtatactataagttcatgtaatttgcttaaagttggcacaactagtcagtagggcaaccaattttttatttttttatttcattagtttttggggaacagtttttggggaacagtgtttgggcaaccagtttttaaacccactttatataactcagagcctaaatattttctccactgtatttcttcttctctttgttagtagttaaactgaagttggcagcattaagtgggagaatttgacatccaaaaataactgttttcacctttttctctcatattaatgttgaaagttgacaagaaaatgagtggaataagcccaataaagtcataggcattttttgtcttatatgaatacttacctactcagtactggtagccaacagctagtttgcctctatgggactttttactacctatttgctattcctcttcctctacaataatatctgtgctttttttcgtaaaatatttgttgtctcttttaccatcatgctattatttaatacttagggactcataaattgcataataccaaaataagcaaaaatgggtaacagtgagtttttattgaatgataaagatattataaaatatataaactgtatccagcttaccaggagctgagaaaaactggaagtcagaggcaatggctgctgtgaattgtcttgtgttggacatgccattcacgaagcatcaattttcatcttccttttttattttgacttagaatcaagttttggggatttgaaggccagatgtttacaagaatttctgaactttctctactagactgtggtggtgttcattgatttatattattgaattgcaagtttttcattattactgttgtgaagcaggtacagtggcattcctgagacagatactttcatgctcaactctttagctgcaacgaaagctatgtagtggttaatgaatataaaggaattctagtatgtttatatcataaagttgaaagataactgaactaggaattgttagaagaggattctagtctagtgtctgtctctttgaggtttataaccttagggagacaaattgcttaactattctgttcttgttttccttatgtataaagtaaaggagttgggcttgcaaaatctctgccagttctaaaattctgtgatttttgaagtaatttaaaaatgtctcataaattttgtactccactaaacattttcttctctatagggcgtcttactactgcaggcactaacaagaagcaatggtgcaatccagaaaattgttgcttttgaaaatgctttcgagagactactggacattatttcagaggaggggaacagtgatggaggtatagtatgaagaaattatttgaagacattccttttgtactcactgacttgttagggtatagggaatacagttggagggagaaatggggactcttatttatactctttgtttttctttcactatggcatgttgactatcgatttctctttatcctgtttcatatttgttaggcttttacaatctaggttggtgtctttccttgtttagaaaatctcacctatatctcttcaaatactgtattgctaggtttcttttatttttctgaagctatagattattatgcatgtccttttgcagatttggtgatagggagttgagttgaaggcagaattatatactgagtgaatagggaggacacaattgagaattaatgggaaaggttagaaatagtcttttggagaataggagagctagttaattattgtaattaggaagattttcaaagtgatacgaaccccagctgggcttgatggctcatacctgtaatgccagcactttgggaggctgaagtgggtggatcactttaggccaggagttcgagaccagtcgggccaacatggcaaaacctcatctttactaaaaatacaaaaattagctgggcgtggtggtaaacacctgtaatcccagctacttgggaggctgagaaacgagaatcacttgaacccgggaggtggagattgcaatgagctgagatcgcaccgctgtactccagcctgggtaacagaatgagactctgcctcaaaaaaataaaaagggggataagggccccattaagggtattcaccatgattttacaatagcaccaactacttgagtgtgtaatttattttctcccctagcagcactcagctgcctaggtgcaaatatagaaaaaaaactcagtttttcacagggttgggccttttctgggaaggtgctatgaaaagacagtaagacaagagaacatagtatattcctattccacttctgtagagtggaagaaacgaaaatctctataatctaagctagatagggaaggaaataaaaacaagggagtttctaaaaaaggcatttggttggtgggccaagagactcaaggaagccatggaacaaatgtgttgaaaatacttgagccacaaaaataggttttagtaagagaggattatcgccaaagatgaggcaaaaaaactgagtggtctaggtattagacgggttgctgttgaaattaaaattaagtagacagcagagcttagagaaagaagactttgagcaagatgccaatgatgttttccgtggacaaaggatagtgactatgaatttgttatatatctgcaatgagaagtcgtaagagatggtacagccatatagccaagcctcaagggaacaggagattttatgagagtagaggaactatggtctctcgaaagtacactgggctgggagggtcacagcttcaacatgctgactctaaggtacatgggattgagaacatgaattactttcacttgagaacattacaagataaagcagattctttaaagaaacggagcatttcaagatataattgggttatagggtgttttattaaccaatatctgagagttggcaatggcatcatgaaagggtttgaaaagattaaatggaagaggggaaatgcaaactattgtaaaatgaaaaactgggaaagcagagatgaccagagaggtgtacatttttggaggcaattgaagaaaatagggttttaaggaaagatagaatttgctaagttttcctagttgctaaaacaagtttcagtggctctttgtaagtgatagtggccattaaggctctagggttcactaaggtgcatgctggaaagaaggcctgccagttgtagtgagggcttttgacatgctttttccttcaaagccttcagatggtcctaatggcagaccatatttaatagatatttatggtcctacctaagaggcagatagagtggttcctcctcataagatgaggatccatatggttcctcagtaggaggtgaggaagcctctaatctggagagattaggtctggttaaatcaggaattcttgaaaagcatttaaaatgtgcaccttaagcattttaaagttaaatgtaataaaataaaggtgtatatttatgtactaatctttggaatagggccagaactactaccttgaatatgggtatgctgattaaagtttttcatcatcttccttgcatacatcacgcctataatatatcatgtaggatttgcattttgttttctttaaaatagattgcaggatatatctgggtttttaaaattacttttctatcttttagaattgtattatccatatttaacagctatatttttagtgacgtcctttcattgagttttgccaaagacttaaatttaattttcagcaaaataactgttttcacacatattttggtagttttatatagtatttaattaataaccagtgcaaatagcatggtaggtttgtgaatgaaacaattgattcttagatgcaataccaaaagtgtgatccatagaaaaaaattgataaatgagacttcattaaagttgagaacttgtgccctgcaaaagattctgttgagagaatgaaaagatacttcacagatgagaagaaaatatttgcaaaacacatgtttgaaaagggacttgtatctaaaatatatttagaactcttaaaactgaaaaataagaaaacaataagccaatttaaagatagacaaatgatctgaacagacatctcaccaaaaagatatacagatggcaaatgaccatatgaaaagatgctcaacattatatatcactagggaactgcaaattaaaacaatgagatatcactacataccttttagaatgaggaaaactaaagaaaacattgacaccaccaaatgatggcgaagatgtggaagaacaaaaacacatttgttgctgatgggaatgcaaaatggtacaactactttagaaaacagtttggtggtttctcacaaagctaaacatagtcttatgactcaacaatcacgctctttggtatttacccaaattagtttaagacatattcacacaaacatctgcacatgaatattaaaacacctttgttcataattgccaagacttggaagcaaccaaaatgtcctttagtagttgaatggatagataaactgtactacatctatacaatgggatgttatttagcaatgaaaagaaaagagttatcaaaccatgaaaggacataaaggaaccataaagccatattgctgagtgaaataaaccagtctgaaaaagctacataatatattattccaactatagttgacctttgaataacttaggatttagggacaccaatgccccagttgaaaatctactttttaacttttggctcccccaaaacttaaccgctaatagactatgtttaccagaagccttaccaataacataagcagtggattaatacattttgtacgttgtatgtattatatactcgatttttacagtaaaataaggtagaaaaaagaaaacattaaaatcagagggaagagaaaatatatttactgttcattaagtaaactggattatcataaaggtcttcatccttgtcatcttcatgttgagtaggctgaggagcaaaaggaaggattggtcttgctgtttcagggatggcaaagaggaagaaaacatatatataagtggacccatgcagttcaaacccaactgttgttcaagggtcggctgtatatgacattctggaaaaggcaagactatgtggaccataaatatttagatcagtggttgccagggatttggggatagaggaaagaagagatgaataggtgaagctcagggtattttttagggccatgaaactattctgtatgatactgtaatggtggagacaagagattatacttctgttaaaactcatagaactttatagcacagagtgaaccttaatgtaaactgtggactttaattaataatagtgtattagtattcatttatgaattgtattgcaagaaatgtaccacattaatgcaatatattaatgatgggggaactggaaagtacaggcatacattatttcattgtatttcccagggaatatgttttttaccagctgaaggcttgtgtcaaccctgcattgaataagtctgttgactccatttatccaacagcacgccctcacttcatgtctctgtcacaattaatatttcaaaagtttcattattatatctgttatggtgatgtgatcagtgatttttgatgttactattgtaattgttttggggtaccacaaacagtgcccatataagagggcaaacttaagcaaaaatgttttatgcattctgacagctccacagactggcccatcctctctctctcccactctgtcttcccctcttcccctccctccctcgggcctccctattccctgagacataacaatattgaaatcaggcaaattaataaccctacagtggcctctaagtgttcaagtgaaagaagagttgtatatctctcacttttaatcaaaagctagaaatgattaagctttctctgctgaagatacagaggaaggcatgttaaaagctgaggccaaaagctaggcccaatagccaagttgtgaatgcaaaggaaacgttcttaagaaaattaaaagttctacagcagtgaacacatgaataattagaaagcaaaacagccttattgctgatatagagaaagttttagttgtccagattgaaaatgaaaccagccacaacacttcattaagccaagcgtaatccagagtgacgccctgactcttcaattctgtgaagactgagagaggtgaacaagctgcacaaggaaagttggaagaatggatattgtgcatgaaagtagcagatgttgctgcgtgagatctaaggaaagaagctgtctccctaacaaaagtacaaggtgaagcagcaagtgctgatgtagaaactgcagcaagtgtatccagaagatttagttaagataattgatgaattatgctaaatgttcagcatagacaaaacagccttctattggaagaagatgccatctagaacttttgtatctagaaagaagtcaccccctggcttcagagcttcaaaggacaagctgactctcttgttaagggctaatgcactgttgactttaagttgaagccagtgctcacttaccattctgaaaatcctaggacccttaagaaatatactaaatctactctgtctgccctctataaatggacaacaaagcctggaagacagcacatctatgtaatagcatgatttactgagcacacatttactgaacacacatctcttacacttctgtgtaagagcatggttttctaggcccagtgcattagaaaaaacgattttcaaaatattacttctcattgacaatgcacctgatcacgcaagagctctgatggagatgtaaaaagagaataatactgttttctttttttttgagatggagtctcgcactgtcacttgggctggtgtgtagtggtgtgatctcggctcactgccacctctgcctcctaggttcaagcaattctcctgcctcagcctcctgagtagctaacattacaggcacccactactgtgcccggctaattttttgtatttttttttttagtagagatggggcttcactatgttggccaggctgatcttgaactcctgacctcatgattcgcccacgtggcctcccaaagtgctgggattacagacgtgagccactgtgcccagccaataatattgttttcatactgttaacacaacatgcattttgcagcccatggatcaaggataaattttgacttttttttttttttttttttttttgagatggagtctcactctgtcccccaggctggaatgcagtggtacaatctcggctcattgcagcctctgcctcccaggttcaagcaattctcgtacctcagcctcgtgagtagctgggattacaggcatgcaccaccatgcccagctaatttttgtaatttattagagacagggtttcaccatgttggccaggctggccttgaactcctgacctcaagtgatccatccacctcagcctcccaaagtgctgggattacaggtgtgagtcactgcacccagcaattttgactttcaagtcttaatatttaagaaatacatttcataaggctatagctacatagatagtgatttctgtaacgcatctgggcaaagtaaattgaaaactttctggaaacgatttgccattctagataccattaagaacatttgtaattcatgggaagtcaaaataccaagatttacaggagtttggaagaagttgattccggcaaccctcatggatgacttggaggggttcaagactttagtggaggaaccaactgaagatgtggtataaataacaggagaattagaagtggagcctgaaaatgtgattgaatttttgcaatctcatgatcaaacttcaacagatgaggggttattacttatggatgagcaaagaaggtggtgaagatgctgtgaacattggtgaaatgacaacaaaggatttagaatattacatcaacttagttgataaagcagtgtcagggtttgagagaattgactccagttttgaaagaatttctactggaagtaaaatgactcactgaagactcaggtggtcattagcatttttttagcaatgaaatatttttaaattaagtaatgtacattctttggacatgatgctattgcacacttaataaattacattatagtgtaaatgtaacttttgtatacactaagaaaccaaaaaatttgtgggactgacttgattgtgatacttgctttattgcagaagtctagaaccaataagtagatgtctgtgtagagaaactctatttgtacttactttttctataagcctaaaactgctctaaaaaatgatgtctttttaaaaaaaaataatttatttttgtcaacatacagctcaactattaggaataaaagtgttgatgtaccagatgagcttacttgtcgttacgtacagcatccagcatcagtcaatatgtttatcagaagaaacggaggctattggttaatctattagtacttggtaaagtagagatcaattggagagttttcactgtgataatagtgaaagctgtagtgtggatgaaactgccctggagagtatatgctgtaaacaaagaagaaaaaggataaaaccatggaggacagaaacaatgaaagattgagcacctgcagagctgtaaggaaaatcaagagagcataatgttttagaaatcaagggaagtttcaaggaagagacaaaccgacaatgttaagagcttcttagagatcaaataagatatggttgattcattcaacaaatgtttaatagttaagtactgtgtatatacatgatatcatgtctctgtctctgctaaagatacagaggtaagtagactgttcacaagcgtttgtgaattataatctagtggagaagacaaacactacctaataataaaaggagaaggctactgtaagagcatgtagctggtgacgctaacctagtcctgtagtcttggtaatcattcctgaagaaatgatgtttaagctgggatttgaagataaacaatgagttactaaggcgattggttacttgacatagaagtcaagagatctttggggtacctgagaaagagcatgcaggttatggcctgtggccatcaggtgtcagagcagactgtctatctgcctggccatattgaagagatgctgagcatggagatttatctttttaaaaatgtttgggagttttgcgtcaggttttacgagccttaacgcttgtgttttacattatttccccaggtatagtagttgaagattgtttgattttgctccaaaacttattaaaaaacaacaactccaatcaaaatttttttaaagaaggctcatatattcaacgtatgaaaccttggtttgaagttggagatgaaaattctggctggtctgcacagaaagtgaccaatctacatctaatgctacaggtatactatccttagacataaatgtggtaagaattttgacagtgatcttttcaaagagaagaaaatcgcttgtatttgataaatccagaatatttgatggatttcaggttggcttaaaaaaactgtaatatggaaatttgcagttatcctctagctagagatcttgcctacccattacttagctttgacagttattaacatctggcaattttgtttcatcgtttattcctctctgctgtatgattttaaagcaaattcagacatacagtttcctgatgggttttacattaaggaataataggttacattgttgatttgaatttttaaaaacctgctttcttcacttagggctctaataggataaattttaatattcaaactattaagttcaaataaattcattcagtaagcatttactgagagccaggcactggatgctaggaaataaatgatcatgtcctgcccccaaagatgattagtctgagttttaagtccaaaacatgttaaattgacagaccacctgtgatttattgatcctttatggtgaaagcttagtggtaataataaaagtgaggacagtaggatcccaaattatttcctcatcagagaaaattttgaagttctttgaagtagtctacttactcctttattgaatcctccttctccaaactgttaagtttatactagtctccttacttatgaactcataattcttgtgggcctttgaatgtctctgaattatacctgtgtttctcggaagttgtggacctaactagatggttaggtccgctagtaattagaggctgaatgttgtcccatgccatgggagttgcctgcataggactgatgattagggtaatctgtgtcccagtttgccagtacattactcgttttgtaattactaatagcatcctctttcacttcaaaagtgtcctggtttggattataaattatgcagttaccctagttagaatatgcctaaaaactgttacaaaagtattttccaggagaacttagttacagagtctatttgtactcccaactcatcatttctgttttcaaatgttggtattatacatttaagaagttaatagttttttaatgttttagaaacagtgtcaccaagtggtaaccttgatacctttgttcaaaactgctttattttgttttgttttgtttaagagacaggttcttacttagttgcctaggctgagtgcagtggtgtcttcacagcttattgcagcctcaacctccctggctcaagaaatccccccacctcagcatcctgaatagctgggactacaggcgcaagccaccagacctgactggattttttatttttagtagacatgaggtctcactgtattgccaggctggtcaggaattcctgagctcaagcaattctcctgcctcagcttcccaaagtgctgctgttataggtgtgagccacatgcccggcctacactgctttcttaaataaggaaattcctctagaaaagtaatttccaaaatgtgattagagagggtgagagaatctgatgatataaaaaagcatgtatttcgtatcaaacagtgaaaatttaaattgtttgaggaagctacacatgttttatggtttagggtactatgtaaagaattattctgaaggaagtgtcactgttaaaaagtaaagtaggtcaggtgtggtgactcacacctatgatcccagcacttggggagcccaaggcaggtggggatcacttgagcttaggagtttgagaccaacctaggcaacatggtctttatcagcccggtgtggtggtgtccacctattgtcccaactactcaggaggctgaaggggaggatcacttaagcccaggaggttgaggctgcattgaaccataatcacgccacgcactccagcctgggaacagagtgagactctatctcaggaaaaaaaaaaaaaattaccaaaaaattattagagtacagcatgtaaacagaaaaatacagtattctcgttatataacaagttgattctttaagaattctttacttttaaaaagtgaataaactgactttctgtagcttagtaaagcttttatctcttacacttgtcgtgaagaccgtaaactccaaagcagaggaactgagtttaattcattttaatatattctccacctgcaatactgaatagtagattcactcatgactttacaggccaggagttatcttctgctattctgttagaacctgttggaatactttatgtataactttatttagagttgcttggattttaagttctctattatacactaaataaaaatgcatcattgttttcctgttgggacatacacattctgtgttggaactattcatcatcacagttatcatgattgcattctgagctactaaaaacagaattgatctgcttgctgagttttaattcaaattttgcagactatatttagggaaaacatcttttgaaaagttttttagttataaaatattttatttttttaaaaaattatagttttatggctagtctactttttatccctgcaggagtctcttctatggcattttattgggaagatactgccaatagctcccagaaagttcataaccttataagataatcattttcattctagggtagttttaattattagaaactttatatattaagtcataaactgtcttgatatgacttctgtaaatttacttttgctttctggaatgacacatgttcattccttgtgaatatttcatatatttacatgttgctattagatctctttttatcctcataaatattccctttttctttatttacatcatcagtaaagacactcaactgctattagaggatagtagaaaattactgttgattttgtccgttgtaataatggtatgattatatttcaaaaaatatcaagtggagatgcatacagaattatttgtggtacaattgacatattgcgtagtatttgttttaaatactcaaaaaaagaaggaaaagaagtagtaaggataggagggaaataaattaagggaggaaaaaacaccagaaatctcactagaaaagtccaaggacaggaaccaatgtaatcctgaccttctctttagtgacatcaatttattaatgaaccctctttgagatgtctgttaagccagacatggaaacatctaaatctgttttgtcattactcactgagttaactactggttgaagtttttctctaattctagtgatttctggttacctttttattcaccaacaataaaaagtaccacttttcaaacttttttttgttttagtatttaactcctccctcacaaaaaatcccctttcttagtggagtcaatccatagatcacaatatgtgtcggctgtagtaatacaagtgttttagtttactctcttaaatcattgattacttctgtgtatctcctataaaataatggttaatgtttgtatagcactttgttgttaacaaggtattatcataaatacccccatttgatcttgatttagaagattttgcacatatatatacacataactctagttttaaaatgtgacacacatgtaaaatgaatttggagacataactgttaaatagttatttgagatgacttttttcatgtttctgaaattttatgtttacagtccaagtaatcatagaatcatagggatttaattggcattagcaatcaatgcagcccaccccatgcctaatacatgaatcttttaccatctctccagttttggttttagcctctctttaaatatttccagtttaggggagatttatcacacatcaggtcattctgttttcagacctgctctcttactaggtagttcattattaactttgaaaagaaatctgccactctgtaacttattcattcatttacttattaaatatgtactgttacaagtactatgcttctttgggaaacaaaaatgaccaaggcagtttctctctgggagttcacagtcacctgaagaagacaaccttaagtttaagaggcataatgtaatattactatcacagaacttattgccatgggagcacgaaagaaagagcacctaaatgtagctaagcagctaagggagtacttcatgcagactttcttgttcacatagatcagatttgcctcaagccttttcaaatctttaaaagacaaattttgttttctctttctttcacagcttgttcgtgtattggtatctcccaccaaccctcctggtgctaccagtagctgccagaaggctatgttccagtgtgggttattgcagcagctttgtactatcctaatggctactggggttcctgctgatatcctgactgaggtaaagcaaatgaagtcaaagccaactctgtggaagttgaaatcctgaatcctaggaagaattagatatttgttgaaggaaaaactacaatagttaaccattttttaggttaaaatttttaatgatcttactaaaatataattcacataatgataaaagtattgattccaaaagatatactcatccctcaagttttatagtacataaataataatgttaaagctttgcagatccatctacaaagatttctcattaattttgttatattcaacaggagtgcacagtatgatttcgtttttattttgagaacaaagtgacttagtcttactcaaccggcagattcattgaatagtaaattcttttcccctaatgtgtggcattctctgttgcttacctataagaaaaagaagttagtttgaagaaaaaaagtttgtttatatttttaaaatttttctcaaattaacacgtgcaatatcgaaagtacaaataataaaaattttataacaaaaataactgccttcagcctcaattgtccttactgtaagtcccactttacttcctcatgtcacctcataattattttatggaatttatatttaaatcagtagttggggtttatatttttacagctgtattgataccattcctgctaagccaaatagagtcctatatccttttttaaatatatatttttctcatccatgagttgtaattgtgttcttcattttactgttactctatatatgcataggtatatatgcttaataatcatatacttaacactttgtttcccaccacaggccacctgcagaccctccattctcctactccaatctgtgctctaattcttccccatgtctcttgtcctgggaattttttttgccatcttcctaggatttcctttacttgtctcctgacttggcttccttgattatctggatcctatatctttatttatttatttatttattttttttttttttgtacagagtctcagtctgttgcccaggctgtagtacagtggcatgatctcagctcactgcaacccccgccttccgggttcgagcaattctcctacctcagcctcctgagtagctgggattacaggcacccgccaccatgcccggctaatttttgtaattttagtagagacagggtctcaccatgttggccaagctggtctcgaactcctgacctcaaatgatccacccatcttggcctcccgaaatgttggaattacagacaggagccaatgctcctggcctggatcacatatctttttcctctatcccttggttcattaactttatttttcttaattttcttttcttttcttttcttttcttttttttttttgagatggagtttcgctcttgttgcccaggctggagtgcaatggcatgatctcggctcactgcaacctccgcttcctgggtttgagcaattcttctgcctcagcctccagagtagctgggattacaggcgactgccaccatgcccagctaattttttgtatttttagtagagacggggttccaccacattggccaggctcttgacctcaagtgatccgcccacctcagcctcgtgaagtgctaggattacaggcgtgagccactgcacccggccgttatttgtcttaattttctaaaaaaaagaataagtaacgagaaatttttttattttttgctctttcatgtctgaaaatgtcatttctctactttcagaattaatttaatgtttggctagatatggaattcagggttggaaatcactaatactcaactttccaaacatcattccagtgttgctattaggaagtttgaagtttgaagccattataatcctccttttttttttattgtaatctttttctctctagaaacttttgagatctgttatttttgattttctgaaatttactgatgatgtgctgaactgtggaccttttccccactcccttgctccccagttattatcatcattcactgagcactttcagctggaaatatacatccttcagttctgaggatgtttttggcattgcctgataattttctcttttctgttttgtgttgctgttgttgttgttgttttgaggcagtcttgctctatttcccaggctggagtgcagtggcactatttcggcttacttcaacctccaccttctgggttcaagcaattctcctgccttagcctcacaagtaatggggattataggcacaccaccttacccagctaattttgtatttgtagtagagacagggtttcaccatgttggtcaggctggtctcaaactcctgaccccaagtgttccacccacctgggcctcccaaagtgctgggattacaagcatgagtcaccacgcctggcctcttttctgttctctttctgcaattccattagtagactttctgggtaatttgtctttttaaaaattaatttttaattaacaaaaatggtatatatttatcttgtataacatgttttgaaatagtctttttattttttaactttatccttaaattgaattttttaactctttaaatttgttctttgattattattttaaaacctttttctgtttttataaaatattttatctcatagagaatagtatagtttttgagatttaaaatgcctgtcaagtgttattttattggagacccatgcttaatgctttaaaattttcccttgaggaagtgttacaagattataatgttatcattgatgtttttgtgcctgaattttggcacttaaaaagtgggatataagattttttttcatgtatacatatgtaactaacctgcacaatgtgcacatgtaccctaaaacttaaagtataataaaaaaaaaacaaaaaaaaaagattttttttctattgaaaacatattttccttcttgacttaatttctctaaatgttctttttctttcttccccttaacagaccataaatactgtatcagaagttattcgaggctgccaagtaaaccaagactactttgcatctgtaaatgcaccttcaaacccaccaaggtagaaaaagggaaatactgagattactctgaggaagtaaaaactttgggttgttaatgtatctcatatacacatcttactctttttaaagaagtttagttgtatgttttggaactagaaattatctgacaagataaatgatattgatattttaaaagagttggtagtctttggaatttagatacttagattcagatatcatgtcgtccacatcctagctgtatgccttaagcaagcagtcacttcacttctgtcagttacagttttctgtgaaatagagatggaaatacttaacttgctggtgttctggttatgattcttcaatcaacaaaaatgactagttattgacttgtatacttgggttgcaatgtttcattttgttcttttctttttaaatgcaacagaccggcaattgtagtacttctcatgtccatggttaatgaaaggcagccatttgttttgcgctgtgctgttctctattgtttccagtgtttcttgtataaaaaccaaaaaggacaaggagaaatcgtgtcaacacttttaccttctaccattgatggtaaataatttagttctaatttttatttgaaaaagtaaatcattgtcttccaagcttttaattgattctttctttttatgctttagcctaaaatactttgcatgcttaggagagaaaaaaaaaaaacaaaaacacctgaattctaaggcctgcaggtaaatttagacaacaggctttggagtcagaccagagtttgcattgcagaattttcacttttgctgtgtaacttctgccgtataactttttaacttgagcctcactgagttatgggggataataatactcatctctatgtggggttaataccccattaggaacattgtgaggattaatgcagttacatgcattacattacataaagtactcacgccaaaacttagcatgtatagatgccagtaaacagaatctactgttaattataattgtcattctaaagatgaattttgccaggtgcggtggctcacgcctgtaatcccaacattttgggaggccaaggcgggcagataacctaagaccaggagttcgagaccagcctagccaacatggtgaaaccccgtctctactaaaaatacaaaaattagctgggcgtggtggcaggtgcctttaatcccagctactcaggagtctgaggcaggagaatcgctcaaatcctggaggcagaggttgcagtgagctgagattgtgccactgcactccagcctgggcaacagagagagactctgcctcaaaaataaaaattaagaaaaagaagatgaattttaccattaaatcacatttaactttcagtctgttgttctagtataggttagagtcattaccctttttatggggtctttaaatatttcatcttacctaagataaattttttaaatgtttacctttgttaacttttaaacttcaagagcagtttcataaaggtaattggaaacatcaataaaactcattttaattacatacattgaggttttttgttagaatttaagtctgtttaattatatttaccaaaaaaaatttggtaaaaaattaccataaaaaattattgatcattaatgaaaataagaccctgatgtagtagaatgatcaaaatgtggcatttccttaagtttgttttagaaatgttgtttttaattaaggtaattttttggaatgttaccatcatcagtttaatgccgaaaatactgtaatacaagttgagcatcccaaatctgaaatctgaaatgcttcttttttttttttttttaacattccttcaaacatttagcctttgtgtttcaaataatctaattgtactcattaagtaattttgaaatgtatacttaagccaggcgtggtggcttacacctgcaattccagcattttgggaggccaaggcaggtatattgcttgagtataggagttcaagaacagcttgggcaacatagtgaaaccccatctctactaaaaatacaaaaatttaggctgggcttggtggctcactcctgtaatcccagcactttgggaggccaaggcgggtggatcacctgaaggtaggagttcaagaccagcctggcgaacatggtgaaaacccatctctattaaaaatacaaaaattatccgggcatggtgatgcatgcctgtaatcccagctatgggggagactgaggcaggagaatcgcttgaacttgggaggcggaggttgcagtgaactgagatcacgccattgcactccagcctgggcaacaagagtgagactctatctcaaaaaaaatactagccaggcatggtggcacacaccggtagtcctagctacatgggaggctgaggtgcgagaatcacctgagcctgggaggtcgaggctgcagtgaactgaaattgcaccactgcactccagtctgggcaaacagtgagaccctgtctccaaaaaaaaacaaaaaataaaatatacacttattttttattatagtcaccctgttgtgcaatcaaatggtatatcttattcattctttctaacaatatttttgtactcattatccccatcttccctctaacttcccactaccctgccctgcctctgataaccacctttctaatctctgtgtccatgaattcccacaaatttttagatcccacaaataaaggcaaataaattttaccttctaccattgatgataaataatttagttctgatttttatttgttctcacaagtaagtgagaacaaatgttagtctttacatacctggcttatttcacttaatataatgatctccaggttcatctgtgttgttgtaaatgactagatctcattgttttgtatggctgaatagtactccattgtgtgtatataccacattttctttctgaaatacttctggtcccaagcattttggataagggatactcaacctatgtttcttttctctctctcctttttttttttttttttttttgaagataaggtatcactcttgtccaggttggagtgcagtggcgcagtccatagctcactgcagcctcaaactcctgggctcaagtgatcctcaggccttagcctcccgagtagctgggactgcaggcatgcaccaccaactcctggcctcaagggatcctcccacctcagccttccaaagtgcgagaattacaggcgtgagccaccatgcccagcctccacctgtatttctttgttctattacttttcttccaagataactttctctcattgttcattttgctttgaaaagcagacttttatcattttgaaagtatatttaatactactcattaatacatgtttaatgattatatttaatggtatttcacactattttatgtgtacagaaaacaatttatttaaaatttggtttacgtcaaaatctaatatatttttattgtctgcctgccatctttgtagcaacaggtaattcagtttcagctggccagttattatgtggaggtttgttttctactgattcactttcaaactggtgtgctgctgtggcccttgcccatgcgttgcaagaaaatgccacccagaaagaacagttgctcagggttcaacttgctacaagtattggcaaccctccagtttctttacttcaacagtgcaccaatattctttcacaggtaaagttttgcataagggaaaaagttctatacattttgatgtcagtgatacaggatttaaggatgtctttagaagatgcagatgaaaaaggacagagaagacttattctgtttattagttcatcataatcagaaacagttttgtggagaaaaagcaataaatactcttagaggaatagttttgctaaatagttataaggtctgcatcatgatgaaaatacatgttctgggcagaaaggtattttgagggttttgtcttgtttttaaattatccacagtgttcttgcatgtcatttttctctttcttctcagtaactgaattcaggttagtttatgggagggagtaaagtagttcatagctgtgtatttccctctttctcttcccaaagcaattgatcatctagaaacaatggaacagtggtcccttgtatatatagttatacagtatatccccttgaagtttgtgagttcttcaatccttaagtccccggtgcatataatttacctagtaagatggaggaaaacataacaaaaaatttttgcatgtcttagactcctaatgagaacaacaaagctttattgaagtgtagttgctaggcatttaggaatgtcactttttgttacgtgatttccccacatgtaccagccttgctattgaacagttcaagttcatgctttagcaaaactctaaagtcattgacgtttaaagtcactcagggaaagtaaaaatgtgactaaatctaaaattgttctgtacactgctctagcagtagttatcctacccactccccataataatgtggttgtgtccttctttagttttaatcctgccacactcgttgaatttttccttattttgagcttttaaagaaacattagctccatccatagaaattataaatgaaagcttaaaaagtaactatagtgaaaaggaagttgaagtttaaaattggtttactttaattgaaagcttattttgtctttatcacttatctcttagagattaaaaaaactatcccaaatttttatgtctttacttattacttggcattctcatgttgctatctgttaacaacagttttattttaaagccaaacagtaattatctctctcatcaccatcaccacagacttcactttaacattgaaattacaatgaatgcctgatgagaagtgctaaagatggtggtgtcttccccactcttaagtaatcacagtgctataaaattatcctttatcttctaaaatatatagcctctaaatgtatcctctaactttttattgtataaaagaagtatcattagaaccatcctgtcccaaattattggcttgagtttgtagagagactatgaaaaagtatttgagggatttttccagatttagacttttctaaagtagtaatatgtatgaataatttgtaatgtataatttgcagggtgataagatcgacagacgggtatgtatcacttgattaagcttaggcattttcctcttatagcaaagctttttctctgtcttgggttttgctgattggtttttttttaactgcttgtttgaagttacattctactcacacttttgcgtgtcagccaatttatttctattgtaaatggctctccagtttttctccatgggatattgtattggtgttactaaacactgtgggaatgagaatctgaatctatacttgtgcttcttctggggatgcttgcactttctggatttccttggtttcggttttttgtgttttttctccaagcttgcctatttatttcctctgaagccatttcaaaggaagtagaattcaggattaagaattttgtctttaattaatcagcatatgaaagaatctgatgatgatttttatactagattatttaaaatgtgcaatagtaagtataattttataatttgaaatattttaaatgaaatattatggattattctgaatataatccatatgctacagctaccactgaggattcgtttttgttgtgtgtggggaaagtgctatttttgttttgttttgttttgttttgttttgtgtgagtatttggcagaaaaggagtgtaccttaatatctatgtttgggcatgggtttcagttgaataatgtgggtagtaataaatgaggtcctgttatgaattgtatctttgtgtatgagcatgatttaacatgtgtcattaacttacacacacacatacatattttgcagctttagcctgcagaattttatattagggaaagtattttataagtatacatgtcagtcatttgaaagggaattttttttgaggtattaatttatatacaataaaatgcacagaccttctgtgtttcatgtgatgatttttggtgtttgagtgtatctctgtaaccaccacccaaaactagatgtagaacgttttcataatccatcatgctctttttttttttttttttttttttttttttgagacggagtctcactccgttgcccagactggagtgcaatggcacgatcttggctcaccgcaacctctgccttctgggttcaagcgattctcctgcctcagcctcctgagtagctgggattacaggtgcgcaccaccacgcccagcgaatttttgtatttttagtagagacagggtttcatcatgttggccaggctggtctcgaactcctgatgatctcaggtgatccacccacctggcctcccaaagtgctgggattacaggtgtgagacaccgcgcccagcccgcagcttcaaatattttgtttgtagttctcttttatcgtgtaaaatctgtggtttataattacccccgagaatgctctcaaattacagttttagcctccatttgttttctcaaatctcctcaatggttcacacactctaggggctctgaaaagaggtgtgtacttttccttttatttatatcctctgcccattttatattaacgtacttaacccttgtttttaatatgagttacagattttttttttttttctggtatgtcatttgtcttttgaccttggtgttttgttatggatttttttttttctcagacttatcttttatggcttctgcattttaagtcatacttagaaaaggcctttccatgttcagattttaaggaatttactaggccaggcatggtagctcacacctatatgttaacactttggaagctgaggtgggggcatcgcttgagctttggagttcaaggctgcagtgagctatgattgctgcactccagcctgatagacagagcgagacctggtctccactccccccaaaaaagactttataaggaattatacttcaatgtttatcttatactttctggtttctttttttttcatttaattctttgttctgtttttctcagcgaactgtatgagatacagatccactgatctttttctagatagctctccagttgtcccaaaatcttttaagtctatttgtaactcactgatagttgtatgctactttttcatatattaaattctcatttgtatatgggcccatttttctggatttttgtattctgtctcttgattcctgcttgttcgtgatccattattctctttctttttttttacagtgtccctagttaatctcacttttttcatatgatcttcagaatcatgttgttttgttccagaagcaaaaaaaaaaaaaaaaagccttttagtaatttttatttgaatcacattaattttattcatttatttatttttaatttattttacaattattattttttttgaaatggagtctcactctgtcacccagactggagcgcagtgttgtgatctcggctcactgcaacctctacctcccagattcaagtgattcgcctgcctcagcctcctgagtagctgggactacaggcgcgcgccacctcgcctggctaatttttgtatttttagtagagacagtgtttcaccatgttcgtcaggctggtctcgaactctggacctcaggtgatccaacgcacctcagcctcccaaagtgctgggattacaggcacattaattttataaattaacttagaattaacacctttgtgatgttgagtctcctatctaagaacatggtggctttctattggtttatgtccacttttgtgctctttaggagtgttttaaaattttccttgtttagattttataccattttgattaggttcactcctgagtactttatctttttttgtctctgtaataaatggagtgtttcattctgtcttttaactggttatatttgactttgctcttcttatccttcaattagaccccaaaagccatgcttttagaagattctgatttaaatcttattctgtttttttttactcatacatcagccagtgatttgataggatgttcttatatatacattgtgggtatatttggtacctgcaaatggttatgctaagtaataatgaacttatatataaccaggtagatgaacaaaacatttgcatttgtaactcgagtagttgtaagttttctgtggcacatagtcagttggcagtgactggtttttaactttccaatttacatggatgacttgaagatatattgtgggcatggtaatgacgtagaggcaaggaaacagtaaaaataatgcatcatgtaaaaactaaatttgtatcagtgcttacctggcaaatcatttgaagaggtcctgtttgaacttaattcaatattaaatatacctaaaaatagattatagaagagtcaagatattggcatcaaggtttgtgaaattagaatagtctgggtggtagaaatttttcggaacacagtgatgattactttaaattcattccttgtctagatctttgaattatatttcggacattttatgagactttccccaaagtgatgcattactattctgattttcattattttatttcaaacaagttttgttttgtttttttaaaaaaagatacaggttataggaatataaatatgggcactgtcaatattgtgaactaagagaatattctacctaggagatgtaaatgtgttgtattaaaattttgaaaactaattttgctggatatgctaattttcattattaactatacttggcagctgttaatggtttgggggcacttggctaatttaaatcttcctcttgattatgtttgtgatttctcatctggtgtgtgatgactgaatttgtagtatggtttatttattgttagagaatatattctctcatggaatttgactaaatgattcaggggattattttttgcatttttcttgatttttttgttttttgtttttttttgaaggaagtagaattttccttttatcaggaacttgtttttaaacttgtgactgaaatatcataaatttgcttggcaaatttattgtaaagggtcttgggattaatagattattttaaagcctccacactgatttttttccttagcagacaaggtttttaaactaatcatattttagataacccagtatatgcctctgaacatgaatcagttctaatttctgcactctgttcattttaggaagtgcagcctgtggtgcatacaataatttattctcttgtttagttttttaaaactggatttctggctcatctcttgtaagatgttaaagttcttttcatgcaaatggaagggatcttagggcaactttaagtttgaaaaatataaaatgaatggaaagatttctaccaatttatctgttgcagggaagcaaaatacaaacaagagttggattattaatgttgctttgtacctggctaagcaattgtcccattgcagtaacgcattttcttcacaattcagccaatgttccatttgtatcctttatgttttagtaacgtacatgtaagtatttatatcttttttagtttttctcctcaattagaagtagttctatgcccaaaatatttgaattctccactatcttatctgtgttgcaactttttaaactgttaaagttgttatgatgcttgtttaagttgtgtgtgtgtggtttgttttatgccgggttggaatatatatatgaaatttcttttttttttttttgaaatgaagtcttgctctgtcgcccaggctggagtgtagtggcgcgatctcggctcactgcaacttccgcctcccaggttcaagcaattctcctgcctcactcagcctcctgagtagctaggattacaggtgtgcgcaaccacaacccggctaattttgtatttttagtagagacatgttggccaggctggtctcaaactcctgacctcaggtgatccacccaccttggcctcccaaagtgctgagattacaggcatgagccaccacacctagcctatatatggaatttcttatgggaagtcttatgtgaagtattaatgtatgtcaaattcaaattgcaaaatatactagatattttcaatccttagcctccttaacaaagatttcagcttacaggacaaattgcagaaaatcttggagaagaagagcagttggtccaaggcttatgtgcccttttgttgggcatttcgatttatttcaatgataactcacttgagagctacatgaagtaagtaaggggaagatggttttctaatggcatcaagagataatgatgcttttttttttttttttttgccaaagcattatgtagagcaagcttttatgttttgttttgattttattttttttaaagcatctcaatatgcttatctccgtagagagaagctaaaacaactgattgagaagaggattggcaaagagaatttcatagagaaactaggatttattagcaaacatgagttgtattccagagcatctcagaaaccccagccaaactttcccagtccagaatacatgatatttgatcatgagtttacgaagctggtaaaagaacttgaaggtaagactgaagatttatattgatatttgatggaaagtaattatatttatattgtacatgtatattctggatgcatacaggttatatgataactctaaaggtatattttcttcctagctcttgatctgtagcccattgaaggacatttggctttcagtaggattgaaaagattatttcttacctatcatggagttaggttatatgtttttactaagtcttagtagtaaaatagtatttaaaacatttaaaacaaattttaaataagcttccttttataggtgttataactaaggctatttataagtccagtgaagaagataaaaaagaagaagaggtgaaaaaaacattagaacagcatgacaatattgtgactcactacaaaaatatgattcgagagcaagtaagtactaatgaactgtatataccctctgattaccaataggcactttctgctttaagggagcctttctttctgacatttcaaatgaaagaggatatagaaagcaaaacccatcatttttcaaagcatctgagtattcaacaaacagagtgcttaatatgtgctaagcaccatgcagctgatttattagataatgatgagtggataaagatgaaactacaattgcggaatcatcagttgacattttctttccaggataccagtgaactttcattacttgcattgtgttgagtaccctaaaccttcattatattccttcaaaatgttttcttgacttttactctcatttaatttcttatgatatttaccttgattggaattctagaaagtgctgaaaaatgaggttattaatgttgttaaaattccagtgtcataaaaaaatacaatagtggcagaccctgtgggacagattcatccccttccctctactgctctccacacctgtctactaattgtgcacagtttatggcaggtgtggcaagtaaaagcatagatagaaccctttaaattgacaactgtttatatcttattttcttcctcacaatctacattactgagattagtttgttttttgtttagacagagtcttgctcttgtttcccaggctggagtgcagtggcgcagtctcggctcactgcaacctccgcctcccaggttcaagcaattctcttgcctcagcctcgcaagtagctgggattataggcgtgtgccaccacgctgcctaatttttatatttttagtagagatgaggtttcaccatgttggctggtgttgatctcctgacctcgggtgatcccttcccttccctgcctcagccttccgaaatgctgggattataggcataagccagcgcgcccagcctactgagattaaaattttaagaaagaatgaaaatattgtggtatatttagcattcattctaagcttttcagtttaaaagtaaatcaatcaataaattataatcttagaatggtaaaatttgaatcatcaaactacctatggttattaggatttttcatctatatctgggtacaaagatggagccatttccagttgctaaaatgtaataatatctttggaacagtgaaaaaaacaaatagttgtaatgtgatatagagtctatacttggggctgcaaatacagttgatttggcaaaagaaaagagtgattgacacaattactctaatgacttccttagaaatgttcattttaaatattcttaccatttaaaatgctatttggcattagtccacaagcatctagaactataaaatgtttatatcctttgaatgacatttgataattcatcctaagggaattctccaaaattcaggaaaacaattatatggactaaaatatataatgtaatgaaatttgtcactttgaaaaatggaaagcaatattaagtagatgcaatacaatttatattcagtgtttttgatgctgaggttgctttccatttttctttttcttttctttttttttttttttttttttttttgagacagtttcgctcttgttgcccaggctagagtgcagtggctgagcacggtgcctcatgcctgtaatcccagcactttgggaggccaaggtgggcagattacctgaggtcgggagttcgagaccaatctgaccaacatggagaaaccctgtctctactaaaaatacaaaaaattagctggggatggtggcacatgcctataatcccagctactcaggaggatgaggtaggagaatcgcttgaacaacctgggaggcggaggttacagtgagccgagatcgcaccattgcactccagcctgggcaacaagagcgaaactctgtctcaaaaaaaaaaaaacccaagaaaaaaagaaagaaagaaaagaaaaaaaatggaaagcaaccttagcatcaaaaacattgaatataaattgtattgcatctacttaattagataggattaaaaattatggtttgaaaactatgtagcaatatggggaaattatgatagaatgttaagtaaattaaaggctacataattatatatatatacctattgtgacaaattttaaaccatggattgggaaaaaattagaagaaaataaagaaatacataaaattccggccgggcacggtggctcacgcctgtaatcccagcactttgggaggctgagaccggtggatcacctgaggtcaggagtttgagaccagcctggccaacatggtgaaaccccatctctactaaaaatacaaaaacattagctgggcatggcagcgggcgcctgtaatcccagctactcaggaggctgacgcaggagaattgcttgaaccttggaggcagaggttgcagtgagctggattgcaccactgcactccagcctgggcgataagagcgaaactccgtctcaaaaaaaaaaaaaagaaaaaaaatacatcaaattccaactatagttttattatgatggtaaaagttggaagctcttttttcaatttcctatatttattttctcattggcttttaatattaaaaataatatagaagcatatgtatacatacatatactaaatttcttaaatagtttgatgtaaatttttaaatggttttatgaccataaaatggagttttttcattttatttcccactataattgcaggctatgccatgatgtttattaatggagccttctttgaaatcttatagttctgctgcatgttaattggccttgatggatatattaacacaccaagttgcttaattactgaacgattttggaagtgttaagcactttagcatactgtcccaaaatgacctctaatttttaaaatgtgttcaccttcttaatgctaactagtatgactttaaaacacatgaattatgttttgtttcacaggatctccaacttgaggaattaaggcagcaggtttctacattaaaatgtcaaaatgaacagctccagacggcagtcacacagcaagtatcacagatccagcagcacaaagaccagtataatcttcttaaaatacagctaggtaagcatagctaagccatcactatgatagcactcaggtcattctttcctcaagagctagacaaagtaaaagattctttctgtggactagtatttttctaaccttaatcatggtgacaaaaatgtaaatcggagtttaaagcaaaatagcatgatagttaagagcagttaagactggacctttagagattgaagtccaagcttcttgctacctgtttatctggcccattgattctcaaccctggctgcatattagaatctcctgagatgcttttttaaaaaaaaataccaatgctgataccacaatagtgtttctgatttaataaatctgggattaggtccagggatcagtaactagtataagcccaccaggtgattctaatgtatagctgattaagaatgaccgctgtaatctttcagtttcctcttctgcaaaatgaagatagtaataacatttgagaactaaatgatataataaatgaaaaatttaagttgtgcctggaaaatggcaagagctccactgcttttaaatagtattatcctacggtgcttgtgaagattttttaaaaggattttattttctcatattcagttgacagaattggaattaaaattactgtaattcttaatcatagatcaccagaccatgcagtttagtcaaggctgtgctgttttttctcccagaaatctggaaaatactatcagttcactatttttatcagtataccattctgcaaagatgaaatgtgattgcaaaagtgctgccaaagtaattgaatgaagaaaattacatatttgaatcttctacttcaaaaatgaaaaactgaagtttcccgttggcttttaaaatgttatgtctgtctaacaggaaaagacaatcagcatcaaggttcttacagtgagggggctcagatgaatggcattcagccagaagaaattggtagattgcgagaagagatagaagaattaaaacgtaatcaggaacttttacaaagccagctgactgaaaaggactctatgattgaaaatatggtaaagtaaatgtttaagaagttaaaataagagttcaagagtggttctcattatcctgcctttttttttttcccttggatcttttaagccagaatatcatatgttaagattttacaggatgggccaggcacagtggcttacgcctgtaatcctagcactttgggaggctgaggtgggcggatcacctgaggtcaggagttcaagactagcctggccaatatggcgaaaccctgtctctactaaaaatacaaaaattagccgggcatggtggcaggcacctgtagtcccagctacgcaggaggctgaggcaggagaatctcttaaacccaggaggtagaggttgcagtgagccgagatcaccccacttcacctcattgcctgtgcgacagagggagactttccatctaaaaaaaaaaaaaaaaagattttacaggatgagctttagagtcaaactgtttaaacttcaatgcttcctggctcattgaatttaagcaatttagttaacctctttaaacttgtttcctgatctataaaatggtagtggtaatgtctagttcattgttgtgagatttaatttactcttctaatagatggaaattatttaataaatgtctgcttttatgctctttctccatatgaacgcaggtaaatgcttagatttaataaattgctcggtaaaataaaaattttatttttttttctttagagacagagtctcgctctgttagcccagtctggagcgcagtggcacaatctcggctcactgcaacctccacctcccaggttctagcagttctcctgcctcagcctcccgagtagctgggattataggtgcacgctgccacgtccggctaattttttgtattttagtagagatagggtttcaccatgttgcccaagctgatcttgcattcctgagctcaagcaatccactggccttggcctcccaaggattacaggcatgagccaccgcacccagcctacaaatggatttttagccatgaaaaagttgtagacaatatgtgctgtgttggaattttatcttgggcataaaaattaaaaggttggtgtgaattttttggtaagcacatatgatatagtttatatgtgtacagttctgttttttttctcatctctttagactgaatatattttatagtttatttttgtgctatttgcagaaatcttcccaaacatctggcacaaatgaacagtcttcagcaatagtttcagctagagattctgaacaagttgcagaattaaaacaggtaattttccactttgatccaattctactttgtcatgttttaattataatagaataacagccctatagtttcacaaatctagaactatattagcagatgtaagtaaaatttaagttaagacagccatttgaaaatccagaagctgtttctatttatatggtaatagtactttgctttttattgtgtttttatttttcagaggtatttcttttaaaaaatctcagcatctcacccatgttatttatagattatcagtgaactaacaaggaaaaatttaaatttataacttgcaaatatgaaaatgtaaaatcttatgcctaattttaatatactatgataattgcttgactaaatgtatggggtttttaaactgttttgtctagaaaatatagaattttagaattggaaaagagaagaaaggtaaacttacctatatctcaattaaatgactccagctaaaaagcaaaataaactttttctgtggtaatttataacatctagaaaagcaagttaaacttttttctacttgcttatagtatttataaattcctgttaaactagatcatacagatttacctttatccaatgaaaaaatttaaatgtattgttcaagaaaagaatcaaaagagagaaatgaactctgtatacttacaattaaataatgtagcaattggaagaaaactctagagtatattatccctaaacaggttctggggttgtttttctttcctcctctcttttcttctctctcttttcttctttccctcctttctttcttattataaaagaaatgcatacttttttttttttaatccaagcaatactaaaaaatgaccatcctcactaacctaggactaactgtcttccttctctctccactaagcaactggccctagtccactgacatggctgctttgaaagagaaatgactgaacatagagaaattttgtcttattttgataatgtccatgtacctcagagtagattctaaatatctgacctctttttaaaaaaagaatcacttatcatttgaggattttcaggtctccaatatttgttcacaatgttttatttgtgtgggaagattaatatgctcttttggttttattaagtgtacctatactagaactgtattaaaattaaagggaattaagttactaatatatagccttagtttgtaaattctaagtaaaaataagccatttaattatctttcccagtgaaactttaattagatatttttataaaaagagaattgccttttagtttttttactttctccagtttatttacttttataaactttagattgttaaaatatatgtattttttaagtgacagttttgttttttataatatatagtaaagtactatatatagaaaactgtaactcattttaataactaaacaaaataaattagaaaagccacaaatgtacatgatagaaattttaaagagaaccaaaagaaaagagccttttacttgccattgtcccaccacttactcagtgtctccagacattaccaaatgtcctcggggatggggggatatggggagaaatcactcctgctgagagccattgttataattgcctttcttttcctgtactttttttgggggaggagaaggtgagaagtttggaaattcaacattaataaaaactttcaattaataccctggttttcattatagtactactgctttcatctgtgtttggtggtccctagtctaaagatgtcctgttttgcccagccacataataaacctcaagtcttcatccaggaaaggaggaacggttgcctgatgcctaagattgagacagggatctgatgatctatttcttaaatagtcttttaaccaggcctgcagtttttaacctcatttttatctgtacttccagaggtatctaatgataccagttcctaacctttctggtagttaatgcattcattgtaagtcaggtactatcttaactttctcagtggtcatcctagctttcagctttctcaggtgtgctgatttagttatcactgttacttgctttctcaaaattccccaattatattgctctcttctcttactgttcttgtttttgtaggtttcttcctctctccctcccatccttcctttctttcttccttctcccctcccttcctgtcttttatgattttttttttttttgcatgggatttcaggagggagcagaggtaaatgaatgtgttgaattttccatcttgaacccaaaattcaagaatagttctttagagttagattttaaaactaggaggttgtaaatcatttttttaaatgtctccctgtaaatatttccttgatgaaattaataccatttaatgttatgactcaactatttttgtctcttaggaactggcaactttaaagtctcagttaaactcacaatctgtggagatcaccaaactacagacagaaaagcaggaactgttacagaaaacagaagcgtttgtaagtattttctcttttttctctggaaggtaataaagacaaggttgatgtatcatttcttagccacaattaaaaagaaacaaattcatcagatagcaccttctctattctagtaacataggcttcatgttcatggtgacagtcgttctatagtcagtctcaccagattagtttattcagttacttaatagtttattttgctggtattacattctatttctgtcccttcagtccaagattggcagtttttctgctgtcataaaatattcagaaaccgttgttgttttctccagaacattccttctcatacttttgcaatataggtagactgagaattttccaaatcttctaattctgattcttttttgcttagcaatttcttcttcaatttatctctcttctctcacatttaactttaagcaacaaggagaaaccaggctgcactccaacactttgcttaaaaacctcagtaaaatatccaaattcattatttacaagttctgctgtccacaaaacactgcaacactatttggccaagttatttgccactttataacaaggattgcctttcctccgattcccagtaacatgttcctagttttcatctgagacctcaccaaaagcacctttaacattcatatttctgccagcattcttcttctcactatgaccatgaagcttctctccaactccgctcttttctttctgagctctcaccagaatcacttaatgtccatatctctagcaacagtctcatcaaggtaatgcaggctttgtctaccatgcacctctcttacagcctctactcattacacagttccaaagctacttccacatttttagatatttgttgtgtcactacccgacttcctagtattttagaaaaaagacaaggaaagactgaaaaactgttattcaggagtgtctcctctagcacttgagaaaagatttgcatttcactaataatgatatttggctcaatttatctacctatctagggtggtagtatggacttataggaaatttatgaaggaaaggctttgaaaaatattctgtgtttattaaatgctgggttacagttacattagagctgccttgctgattacttttctgggcttacctaccttgaggcaccttagcccagccttcctcgtactcttatgagatttgatgctcttccatgtgggaacagctcatctgacagtggagagcactttgttgcacataaatacataaggaattatattttctgttagtgaaagtaaaatatcaaaatggcaaaaaaattaaataaccctttgggagttcatattgattgtaatgtttaagagacatctttttttccaatttctaatttcaggcaaaatcagttgaggtacaaggagagaccgagactataatagccaccaaaactactgatgtagaaggaagactgtcagcattattacaagagaccaaagagttaaaggtttgtttttggtgcaacttttatttactgcatatgatatgaaatgaactctaggaaattttatatatctttcaaattcttagatttatgaagaaagctaatgatgtgtaattttatctcacaacattttcactcctatattgatgatttaagatggcacaaatgaaaattttttttgttttgggtttttttgttttgttttgtttttttgagatggagtttcgctctgtcaccagactggagtacagtggcgcgatctcggctcaccacaacctctgcctcccaggttcaagcaattctcccgcctcaacctactgagtagctgggactacaggcgtgcaccaccacacccagctaatttttgtatttttagtacagacagggtttcaccacgttggccaggatggtctccatctcttgacctcgtgatccacctgccttggcctcccaaagtgctggaatgctggaattacaggtgtgagctgccgcacccagccacaaatgaagcttttaaaatactatttcaaataatgataatatgtaagataagcatacatatgcatgtactataaaagtaaaatttattgaaaatatttttgttttctttctttctttttctttttttttttgagagagagtctcaattttgtgttccaggctggatggagtgcagtggcatgatctcagctcactgcagcctccatctcccagattcaagcgattctcctgcctcagcctcctgagtagctgggatttcaggcacctgccaacatgctcagctaatttttgtacttttagtagagacgaggattcgccatgttggccaggctggtctcaaactcctgacctcaggtgatctgcccgcattggccccccccaaagtgctgggattacaggcgtgagccaccacacccggcctgtgttttctttttaagatcaacatctaatcacaataacaaaacaaggagtacaaatttagctaatacacaagccacatgtaggctttccataagccgtggaacataggcacattaaatcctgtcagcatattattgtgtgacagagacatcagaataaatagcatgaagaaaggaatgaggtcacattaaggaaaataaggaaaataatgtataattgtgctttttggattgtggccaaattattttatttttaaaccatagatttttatttgaagctattttcatttaattgtatgcttgaagttgggataaaaaatttttttttaacttgagctttgagttctaaaattctggtactaatcagacttgttctgtaaaatgctttgtgtttctgtttactcctttgattatctgaaatggtactgttttttttaagtctcttaaaggttttttcagggatagctaactaaaactattttttggatgttaaactattttttggcaataaccatttttgatgaacagtctaataaattcatgttagtgtgtgtgttaaacctcctgtacccttaacctccacccctaaattccttaggttgaacaagtacagtgatttgtcatagaaagaaactatttgttaaaaactctaggaaagtgagtgctaattttagattcctgcctttcacctttcttttcctagaatgaaattaaagctctgtctgaggaaagaactgccattaaagagcagctggattcatctaatagtaccattgccattttacaaactgagaaagacaaactagagttggaaattacagattctaaaaaagaacaagatgatctcttggtgctcttggccgatcaagatcagaaaatactgtcattgaagaataaactcaaggatcttggtcatccagtaagattaaaatgtctccaaaaatgatttgtattatgttttagtataatgcatttaaaagatttttaatgtaacatggaaaagttgtgcctgtattataggaatggatatgtgggttcatgaatatggtaccatctatactgttttcactgttttcattgaatttacttaatacacagattaggttcagttttcagtacttatagactattttcttttggaccgtaagcctagaaagtgaattgatttgattggtaacaagactgtagtcacccaagcatgtcattatcttttgccatgtttgtttcagatttgtgtgtaaagaggtgtagccatttatcagcaaagttaactgatatatctcattcatattagaaatgacagagagccttggcatcaaatcaaagaaatcagatggcttatattctactgtagttactagaatacaaaatttgtctgggcacagtgctcacacctgtaatcctagcactttggggggctgaggtgggcagattacctgaggtcaggggttcgagaccagcctggccaacatggtgaaaccccatctctactaaaaatacaaaaattagcagggcgcttggtggcaggcacctgtaatcccagctactcgggaggctgagacaggagaatcgcttgaacctggcaggcagaggttgcagtgagccgagatcgcaccattgcactccagcctgggtaacgagcaaaactccatctcagaaaaaaaaaaaattatcagtagtatatattgttaaatgttgaatgtgacatgaacagattttcacaatattaaatacgtctttttcctctaggttgaagaagaggatgaacttgaatctggagaccaagaggatgaggatgatgaaagtgaagatcctggcaaggatctagatcatatctagttttcaaatctctaggaacaatagagattatatcataactctgaagatggactctaaactttggtttacctccatggaaaataaagatttagaaaccaggtggaaaacattcactattaagactattgatatatttttgtaatgttgccacccatgttgaaaaccttaaaactgaatttatgtagaacacacatcttttatttaaatccatctgaactgtcccaaaatgtaatttgcaaagagcttcaaacaccaaaaatataccattttaaggcatgtggtgacaatgctatttgccttagttcattcgttgtttactttgcaaaatttgtgacttttaagtactaacacatttgattgaatgtgtattgaattggaattattatttctaaattcagcatttgagtccttagttgatgattttcttttaaagaaattagtttatttaaaagcaagatagcctgggttgggagttagtgcatatcatcagccctccatctaatgtgattgctaagatgtgcaggataggacagcttagaatgagtgccttgacacctacatatggctgcattccatacctcagtgaagaagccgaaggatgctgacacacagtgatgtggagggcattccggagaaacttttgcaacagtgtattaatgtgattggttttctttttgttttaagctaaacatctaaaacaaatttcaagttaacagttcatacaactcagatttagtattattgtttatcataaaacatattatgttcctagttttaaaaagacccaaagtatgattaatataatttattggcatttttgctgaataggtttaagtcagataatagattttaaaaaagcaaatgaggcaatgtgtcaaaatttaatgtttcataataaaaatagatacgttgacttaatccttggtcatggttccctttgtttacatcttaaaagtattttattcttaataaaagatgaggcaagtgaaaatgatgaggcgacttttcttattaggggtacacaactataactgaatgttaaaaacaatcttctttaaaaccaatgattatgattccctaagattggagggggttagaagtacagaagtagaagaggttggaaaagggtttggacgtttttaaattcagcactggagttcttggcaatgatttcctgttgaagaagtgggtttacttaaagacaagatagcctgggctagaaaataacgtatttatctgccttctggggtcaggaataggacacaacttttgaaagagaaggaaggtcactgtcttgatgaaggagacagctgtgtgttacagagcactcgtgaatgctgcactgtgcccatgttccaccactactgccatcctaaggtggcacttgccatcagagaaagaactatattactgtcaccagaccagctcagataggtgaggtcttcctaaagttgacaaccacataatgaaccatgagttaatgactacctttcaggctaacgtacggttaaagaaaaatggatcaggagtgagaatttgtaaatacagaacaccaaagatcttcattaagaaacatcagcagaatcagtgctgctgtgctgaactcagtcactcaggatggcttgtagtagagaagacaggaggcctcatagctgcacagttcagcccagagccaaagggacatcttcccaaccccagctgtaattttttgctggtgagcatcctaaactggtctctgtctccagtccggttgttacctctctgaccccacactcccaccattctccatcttcaccacagtgagctatggcaggtgcctacagtttggagtccttagtacagtagataagattcttacccctaaggtgttggtattgggaattggagcccttggaagacaatacagtcttggggacagcggtctcaataatgggattagtgcccttatgaaagaggccctgaagagacaccttgcccttccgccatgtgcgagtagagtgagaagatgtgtctatgaggaagtgggccttgaccagacagcacaactgccaatgccttgatcttggacttcccaacctccagaattgggataagtaaatttctgttgtttataaaccacctgatctatggtattttgttacagcattccaaacagacatgacagatgacataaattctgctttctcctttctcactttgcttttgcacatgccctttcctctgggtcagcccagggctacagtagtggagcaataatcataaagcatgaaaccatatttgtccttatgatttgaaacttattcaagtgtagtttatacctctagcacctccaaaagaaaagagtacccaaagttactaaaagaggtaaagtgacagctcacattttaatgggttgagttactggtctgaaattatgctgatagaaaaagcaaacccttatgtttcatagttttgttacaaccagttaagggtctcatgatgctcatcagaactagtaatcttcactggtatagcaaaacgtattaaatcattcaactataggcattgggaatataacggtgaaaaagacaaagtccctttcctcatataacttacattctagagtgtaaacaagcaagaataaatctaataaaaattctacacctttaccttgtttccccccaccttttttttgttttgttttgtttttttgagacagagtcttgctctgtcacccagactggagtgcagtggggcattctcggctcactgcaacctccacttcctgggttcaagcaattctcctgcctcagcctccccgagtagctgggactatgggtgcctgccaccccatccagctaagttttgtatttttagtaaagacagggtttctccatgttggccagtctggtctcaaactcctgacctcaggtgatccgcctgcctcagcctcccagtgctgggattataggcgtgagccaccacacccagccctccccccactttttaacctattgtttatatcttactgtactgtctatgtcttggaaagttgtagttactatttttgataggttcatcatttagtcttcctatgtagaataagagtggtttatacaccacaattacagtgttataatattctgtgtttttctgtgtactaaccttcaggtggttacttactgctcatgaacatccttttctttctgactgaagtactccctttagcatttcttgtaggacatatctggtgttgatgaaatccctcagcttttgtcttggaaattattttcctttcatgtctgagggatattttcactggatttactgttctagagcaaaaggctttttttccttcagcacttcagaaggtggtatgtcatgtcactcttggtcacaggccacaatcaaggtatcagccaggttgtgtactcatctgcagatccaactgggagagaatctgctccacaaactcactgaggttgttagcaaaattcattttcttataactgtaaaactgagggcttcagtttttttgctggctgttgattgaagtgtgccttcagctactaatggccctagaacccctagttctttgcctaatgggcttcttcaacatgctcacttgcttcatgaaggcagcaagactgagtctcatataatgtaacatgatcacgggggtgacatccatcaccttgccatatgatgtaacacaatcatgggagagattgcccatcacttttgccatgttttattggttagaagccagtcaggtcctacccaccgtcaggatagggcatcacacaaaggcatgactaccagaatatagagatcattaagttgccacatacttttattttcttgaacctaattgttagtctcaagatgttttcaaaataacataggggtaaggggaactggggaggtacagttggaaggggataatacgtttaacagcaaaggtttgtgtgaaaccccacccaccttatttagtttcagactgagatctttgcaaatggacaactaaataggtcaaagtacctatcacattagtcaataagaaatgtaacaatggccaggtgtggttgctcagacctgtaatcccagcactttgggaggccaaggcgggcggatcacttgaggtcaggagtttgagaccagcctggccaacatagtgaaaccctatctctactaaaaatacaaaaatcagccaggtatagtggcgtgcacctgtagtcccagccactggggaggctgagatacaagaattgcttgaacccgggagatggaggttgcagtgagccaagatcacgccactgcatcctgcctgagcaacagagcaagactctgtctttaaaaacaaaaggcaaaaaacaaaaacaaaaaaaaagagaaatgtaacagtataaagagagagatgtaatagtgtaaagctgtcaaccacgatctagatattagtctcttacaaatttgtatgttcaggtcagttctctgaccttcatttccacttgttgtctctagtatctcagacatctcacatgtatcaaatgttaaaaatcaaattcatgttcctctcctccccatatctggtcctctcttatgcatatctcagtaatttggcaccatcttttatccaattgcacaaacaggacagctcagactcatctttaataactacctcagttttggtctgaatgcctaaaaagttctcatatttgtccatcttcttccatctgcctggtattctctcctggctcttaagcacttgctctaactgaaagggccacttggcaagaaactggggcagcctcccaccgacagtcagcaaggaactgaggccctcagtccagccgctcagaaagaaatcaacctgctcaacaaccactaactgagcttggaagtggttcctgccccagcagaacatgagctgactgtagacctggctgacaccttgattgtagttttatgagagaccctgaagcagagggcctagcaaagccatgccagatttctgacccacagacattgggagatggtaagtgtgtattgttttaagccacttagtttggggataatttattctgcagcaatgaataacaaatatataggaggtggtagtacatagtacctagttatcttcttttttaaattgtttttattttttatttttagagacgggggtctcatatgttgcccacgctggtctcaaactcctgggctcaagcaatccacctgcctcagcctcccaaagtgttggaaggcagtgagccattgcaccctgccccctttctttttaatgtctctttcacaattttgatagtttttaccactacaaatttctaccttatgtgttgggatgaaatctgctttcctgttgttgattgtagtttgcttcgttatgatcctgcagtcttaagcagcaagtaggtacccccgtgcctgctctctaggcaatcttccctgctttttcaagtgttccttggtggttccttgaataaactctgtctgtgtacactgtacccagattgagcagaaaagacaatcacctccatgttttgaatactttccttgtctgaaagccacttactccatgtgaagcaaggctggtaaggtgctcagtaaatgttggctgttaaaatcatgttctcaggccgggtgcagtggctcatgcctgtaatcccagcattttgggaggccgaggcgagtggatcacctgaggtcaggagtttgagaccagcctggccaacatggaaaccccgcctctactaaaaatctaaaaattagctgggtgtggtggcgtgcacctgtaatcccagctactcaggaggctgaggcaggagaatcacttgaactcaggaagtggaggttgcagtgagccacgatggcgccattgcactccagcctgggtgacaagagcaaaactctatctcaaaaaaaaaaaaataaataaaaaatcatgttctcaatgtagtccaacattttagtagctttttaggagacactgtagcattgcagacttgttgcctgcttattttccacaagtgctgttgttaagcagttttgtatttgagcagctgttctttttgactcccaaggacgctccagtttaaatttcaacttgtaaagttccctacattgctgcagcctttcaggctcttttttatattctgatttttatcataaacacttcatattctccatctctaaagaaaaaaactggtggaggaattgttttaccctgcggacctcaccatgttattgccacaattcaatatgctcatgcagtggaaaactcataaaatttcaggtttatttttttatttaagatcagttataacacattatataattgagattgcttatggtttagaagtgctattagatatctaataaagatacagaataaacatataataaagataataggattctgaacctcatttaatatatctaaataactttaaaattttctaatcttatataattggtatttttcttgttaataaatacaaagcatctagtgttgaaaaagtacacaaagtacttttgcaaagtacattgcaaaagtaagacattaatttgtcttaaatcataatctctcaaaactttcatactaaggcaagtaaatgaatacattatgacaaaaattatgtagatattgaattcaaagcagtatcttccttgttcaagttgcggtatgagcatatctttattctgtttggtcatttttgaagggtgttaacaatatgctgccatttcagtgacaaatttctcatatcaaagcactctttctcccaatttaataatcttgagtcatagtaacaatcagtattcaaaggaaaaaagttttgagttaaaagattttaatatttaaggtaacttgggttataagtaacagagaacctaattcagaataagtgagactagaatatttggaaatgagcatagaaaactcccgtgagatatcttgctgtcatagagagttgagaaatgagccaataattggagtaggatgtggggtcaacagggagacatattttaaaataggaaatactaaaggaaatacactgatggaaatgtttggctagaaaagaggaggtgtttacagtgctagagtcgtccttggggataaggtctaaagcacagtggcaagggaaaccttggattggtttataaacaatatatctgtagtaacaggagagaaggtggagaatatggattaaaaaggaaattgatgggtctgtggtggtgggaatgtgtcaaaattttatctcattgcttccattttctaatttaaacaggaagcaagatacccattgaaagtaagaactggggaagaaatttgatgaaagtggagatattataaagatagatgtcttagagtggagtgtgggaaactgaatgggccaggaaaatgtagttccaagcatcaacttcagacacaaaaatgtccagaggagtgagactttattgtctgtgtctctttttgagggcctggaaatcttttcttgaagcttccagccgactgcctatcagtaagggttaacatctctgaacatgtttaggtctacctgggaaggtgaccttgggtctgccttctcacagcactgttcccttggcaactaccaagttaagctagttgaggaatgctttgtgctaggaactgactacctgccttgtttgctgtgaaatcccctatctgtggatctccacgtgaactgggagagctatgagttggcacccagacagacaactgatgagagacctaccaagtgaagccgggcacttcaatcttcctcaggagctatacacaccctagaaaggtgatggaggccaagaaaatgtatacatagtagtctctgagcctccagacgacatgaagatactatgcactccgtattcctgtattgtatcactctataaagttaacaaatgaagtattagaatgaagtctgttatatcatatgagttttactggcaaccaaaacctgtgactggtgctgatagggacagaattgtatttgaagcaggattggcattcagatcctcaatttgcatcttcctgttttatggtcataattggctcacagacccatttactggcaaacctattactgtcaaagggaatgaaaccaccatgattgccttgactaattgcagttagtcactcacgttcctggtgtgtagtaggtgagtgggcagcacctcttaaagcacacttctcggggtgggtgatagatacataaacaaaacaagggttatgttaggaagaaggaaacctaaacccttgctcctacacttttaaatttctgagcgaattacaaaacctctaagaatcttagtttcttcctggagctaattatacctacctaatagggttattgtgaagattaaaattattgaatttcttttttcttttttgagacagaagctctgttgcccaggctggagtgcagtggcgcgatctcggctcactgcaagctccgcctcccaggttcacgccattctcctgcttcagcctcccgagtagctgggactacaggcgccggccaccacgcctggctaattttttgtatttttagtagagatggggtttcaccatgttaaccaggatggtttcgatctcctgaccttgtgatctgcccgcctcagcctcccaaagtgctgggattacaggcgtgagccaccacgtctggcctaagagtgggtttcaccatgttggccaggttggtctcgaactcctgacctcaagtgatccacctgcctcagcctcccgaagggctgggattacaggcatgagccaccacgcccagccttaaacttttaatacacacataaaagtctgcttaggctgagttatgctgtagaaacaaacaagtcttaaatttcagtggcttacccaaaggtacttcttgtacacattcatatctttggcatgccagctgtggctctgctccaaatcttcatttcaagaccaacactgaagaagcagcttctggctgggtatagtgcctcgtgcctgtaatcccagcactttgggaaggtgaggcaggtgtatcgcttgagcccaggaattggagaccagcctggccaacatggcaaaacccccatctctacaaaaaaaaaatacaaaaattagccaggagtggtggcacatgccgatagtcccagctactcaggaggctaaggtgggaggatcgcttgggaccaggaggcagagattgcaatgagcagagatcgtgccgttacattccagcctgggcaacagagtgaaaccctgtctcaaaaaaaagcagcaacttctctctgggaaaggcaggtcttgtgacagaggcaaacgagagatggcagaatctcacagtggcatttataacttctgctttgaagtggcaacatttccattcacatgtcattggccaaagcaagtcatgtccaaactaatatcaatgcaaagcataatcccataaggacacatctgatatagaggggcagtgaaaatgtcaacaataatataatctatgagaggatacagaagcataaccagtaaatgttagtgtccttccctttcctcttttcccttactggttccccctgagaaacacaagtgtacagcatggagaggctgtgtgatgtcataattaagagtgtagattctgagaacagactgcctgagttcaaatccttactctgccattttccagctgtgtggctttgggcaagttatttaacctctctgtgcctcaacttcttcatgtaaactggcagtaataataatacgaatgccacagagctgtggatgaaatgagcccatgtaagtaaagtgcatagtacatggtaagccctatatgaaagtgttaactttgttattgctcctgtcattattgaaggaaacctggtgggaagtcaaaagacctaatataaaatctcagcattataattctttttttttttttttaagatggagtcttgctctgtcgcccaggctgaagtgcaatggcgtgatctaggctcactgcaacctcctgctgggttccagcgattctcctgcctcagcctccagagtagctgggattacaggtgcgcgccaccatgcccagctaattttttttgtatttttagtagagatgggatttcaccatgttggtcaggctggtctcgagctcctgaccttgtgatccgcccaccttggcctcccaaagtgctgggattacaggcgtgagccagcgtgcccggctgcattataattctaatagtgactttgagcaagttacataatttctgcaaaccgcttattccttcgtctgtaaaattagaataacactcatttctggagaggccacttaggacaatggttaaaagtatggactgtggagctggaataccttggatcaaattccaactccaccactttcaaactgtgtgactttgggcaaattacttcaattttattatccataacacagggacaatcatcataccttaccttcacaggaatagtatgagaattaagtggattaacagttgacatgcaacattgttagaatagtgcctggtgcttaacaaaggttcattaactgtttggcacatagaggaagtgcttcataagtgttaactattctcacaggctatgaggggattggctgtatgaacaggcatgaaaatgctttatgaaaagcagtggtcaaacacggagactcaggaatctgcagtatagaagtctatggctatgtcgttaggcttaaccaggcttagcatgtccagccagtggcaagcactttcttctggaagcctgtctggtgcagagggacctccttaactgtttcctttcatggggatgggccctggctgctgtgcttgtaccttataacttgtagaagcaaaagctgatacttcaccctgtttccaacatgattgagcactttacaaatcaaattcaggacaaacaaagctttgcaccctgagataaaccaaaaccaccccgactagttctgatctctaaaataagaaaaccttgacttatttc

SEQ ID NO: 221 - DNA, 4118 bp, Homo sapiens
cttcgagccgccacgtaatgccacgtccccgcgcatgcgcatcttggccgctgctggcggctgtttccgggcttagagggctggagtggccgccgagttggaggcggtggtggcagcagtaggagtgtgtagagtgcgggattgggggccaggccctgcggagggcgggggaagttgtcttcttttttttccggaggggccggtaaacctggtggctgaacggcaagatgaatttcctccgcggggtaatggggggtcagagtgccggaccccagcacacagaagccgagacgattcaaaagctttgtgacagagtagcttcatctactttattggatgatcgaagaaatgctgttcgtgctctcaaatcattatctaagaaataccgcttggaagtgggtatacaagctatggaacatcttattcatgttttacaaacagatcgttcagattctgaaataataggttatgctttggacacactatataatataatatctaatgaagaagaagaagaagtagaagaaaattccacaagacagagtgaagatttgggaagccaatttacagaaattttcattaagcagcaggaaaatgtcactcttctgttatctttattggaggagtttgatttccatgtccgctggcctggtgtgaagcttcttacttctcttttaaaacaactagggcctcaggtgcaacaaattattttagtcagtcctatgggtgtttcaagattgatggacttactagcggattccagggaagttatacgtaatgatggcgtcttactactgcaggcactaacaagaagcaatggtgcaatccagaaaattgttgcttttgaaaatgctttcgagagactactggacattatttcagaggaggggaacagtgatggaggtatagtagttgaagattgtttgattttgctccaaaacttattaaaaaacaacaactccaatcaaaatttttttaaagaaggctcatatattcaacgtatgaaaccttggtttgaagttggagatgaaaattctggctggtctgcacagaaagtgaccaatctacatctaatgctacagcttgttcgtgtattggtatctcccaccaaccctcctggtgctaccagtagctgccagaaggctatgttccagtgtgggttattgcagcagctttgtactatcctaatggctactggggttcctgctgatatcctgactgagaccataaatactgtatcagaagttattcgaggctgccaagtaaaccaagactactttgcatctgtaaatgcaccttcaaacccaccaagaccggcaattgtagtacttctcatgtccatggttaatgaaaggcagccatttgttttgcgctgtgctgttctctattgtttccagtgtttcttgtataaaaaccaaaaaggacaaggagaaatcgtgtcaacacttttaccttctaccattgatgcaacaggtaattcagtttcagctggccagttattatgtggaggtttgttttctactgattcactttcaaactggtgtgctgctgtggcccttgcccatgcgttgcaagaaaatgccacccagaaagaacagttgctcagggttcaacttgctacaagtattggcaaccctccagtttctttacttcaacagtgcaccaatattctttcacagggaagcaaaatacaaacaagagttggattattaatgttgctttgtacctggctaagcaattgtcccattgcagtaacgcattttcttcacaattcagccaatgttccatttcttacaggacaaattgcagaaaatcttggagaagaagagcagttggtccaaggcttatgtgcccttttgttgggcatttcgatttatttcaatgataactcacttgagagctacatgaaagagaagctaaaacaactgattgagaagaggattggcaaagagaatttcatagagaaactaggatttattagcaaacatgagttgtattccagagcatctcagaaaccccagccaaactttcccagtccagaatacatgatatttgatcatgagtttacgaagctggtaaaagaacttgaaggtgttataactaaggctatttataagtccagtgaagaagataaaaaagaagaagaggtgaaaaaaacattagaacagcatgacaatattgtgactcactacaaaaatatgattcgagagcaagatctccaacttgaggaattaaggcagcaggtttctacattaaaatgtcaaaatgaacagctccagacggcagtcacacagcaagtatcacagatccagcagcacaaagaccagtataatcttcttaaaatacagctaggaaaagacaatcagcatcaaggttcttacagtgagggggctcagatgaatggcattcagccagaagaaattggtagattgcgagaagagatagaagaattaaaacgtaatcaggaacttttacaaagccagctgactgaaaaggactctatgattgaaaatatgaaatcttcccaaacatctggcacaaatgaacagtcttcagcaatagtttcagctagagattctgaacaagttgcagaattaaaacaggaactggcaactttaaagtctcagttaaactcacaatctgtggagatcaccaaactacagacagaaaagcaggaactgttacagaaaacagaagcgtttgcaaaatcagttgaggtacaaggagagaccgagactataatagccaccaaaactactgatgtagaaggaagactgtcagcattattacaagagaccaaagagttaaagaatgaaattaaagctctgtctgaggaaagaactgccattaaagagcagctggattcatctaatagtaccattgccattttacaaactgagaaagacaaactagagttggaaattacagattctaaaaaagaacaagatgatctcttggtgctcttggccgatcaagatcagaaaatactgtcattgaagaataaactcaaggatcttggtcatccagttgaagaagaggatgaacttgaatctggagaccaagaggatgaggatgatgaaagtgaagatcctggcaaggatctagatcatatctagttttcaaatctctaggaacaatagagattatatcataactctgaagatggactctaaactttggtttacctccatggaaaataaagatttagaaaccaggtggaaaacattcactattaagactattgatatatttttgtaatgttgccacccatgttgaaaaccttaaaactgaatttatgtagaacacacatcttttatttaaatccatctgaactgtcccaaaatgtaatttgcaaagagcttcaaacaccaaaaatataccattttaaggcatgtggtgacaatgctatttgccttagttcattcgttgtttactttgcaaaatttgtgacttttaagtactaacacatttgattgaatgtgtattgaattggaattattatttctaaattcagcatttgagtccttagttgatgattttcttttaaagaaattagtttatttaaaagcaagatagcctgggttgggagttagtgcatatcatcagccctccatctaatgtgattgctaagatgtgcaggataggacagcttagaatgagtgccttgacacctacatatggctgcattccatacctcagtgaagaagccgaaggatgctgacacacagtgatgtggagggcattccggagaaacttttgcaacagtgtattaatgtgattggttttctttttgttttaagctaaacatctaaaacaaatttcaagttaacagttcatacaactcagatttagtattattgtttatcataaaacatattatgttcctagttttaaaaagacccaaagtatgattaatataatttattggcatttttgctgaataggtttaagtcagataatagattttaaaaaagcaaatgaggcaatgtgtcaaaatttaatgtttcataataaaaatagatacgttgacttaatccttggtcatggttccctttgtttacatcttaaaagtattttattcttaataaaagatgaggcaagtgaaaatgatgaggcga

SEQ ID NO: 222 - protein, 962 aa, Homo sapiens
MNFLRGVMGGQSAGPQHTEAETIQKLCDRVASSTLLDDRRNAVRALKSLSKKYRLEVGIQAMEHLIHVLQTDRSDSEIIGYALDTLYNIISNEEEEEVEENSTRQSEDLGSQFTEIFIKQQENVTLLLSLLEEFDFHVRWPGVKLLTSLLKQLGPQVQQIILVSPMGVSRLMDLLADSREVIRNDGVLLLQALTRSNGAIQKIVAFENAFERLLDIISEEGNSDGGIVVEDCLILLQNLLKNNNSNQNFFKEGSYIQRMKPWFEVGDENSGWSAQKVTNLHLMLQLVRVLVSPTNPPGATSSCQKAMFQCGLLQQLCTILMATGVPADILTETINTVSEVIRGCQVNQDYFASVNAPSNPPRPAIVVLLMSMVNERQPFVLRCAVLYCFQCFLYKNQKGQGEIVSTLLPSTIDATGNSVSAGQLLCGGLFSTDSLSNWCAAVALAHALQENATQKEQLLRVQLATSIGNPPVSLLQQCTNILSQGSKIQTRVGLLMLLCTWLSNCPIAVTHFLHNSANVPFLTGQIAENLGEEEQLVQGLCALLLGISIYFNDNSLESYMKEKLKQLIEKRIGKENFIEKLGFISKHELYSRASQKPQPNFPSPEYMIFDHEFTKLVKELEGVITKAIYKSSEEDKKEEEVKKTLEQHDNIVTHYKNMIREQDLQLEELRQQVSTLKCQNEQLQTAVTQQVSQIQQHKDQYNLLKIQLGKDNQHQGSYSEGAQMNGIQPEEIGRLREEIEELKRNQELLQSQLTEKDSMIENMKSSQTSGTNEQSSAIVSARDSEQVAELKQELATLKSQLNSQSVEITKLQTEKQELLQKTEAFAKSVEVQGETETIIATKTTDVEGRLSALLQETKELKNEIKALSEERTAIKEQLDSSNSTIAILQTEKDKLELEITDSKKEQDDLLVLLADQDQKILSLKNKLKDLGHPVEEEDELESGDQEDEDDESEDPGKDLDHI
